United States Patent 7,892,730 (COMPOSITIONS AND METHODS FOR CANCER) - sequence listing, part 8

SEQ ID NO: 685 - DNA, 58803 bp, Mus musculus
  misc_feature (1)...(58803): n = A,T,C or G
agaaaagggagggagggaggaggctagtccattttcctgaaaatcaaatcaagtcctgaactagaggttctcagcacgtgggtcaagacccaccccccacgaatgggtcacatatcagatatcttgcatatcaagatagttacattgcagttatgaggtagcagtgaaataattttatggctggtgatctgatcagtagcacatgagaaactgtgttaaagggtcagggctctgttctgaaacagaaagggcatcagggtaacatctgggatgtcactaaatccaaggtttggttaacagaactgtatggatagtgacttacatatttgtttctgtttgagacagagtctcatgtagcccaggctggcccaggacttgttgtgtagcaactcctgcctccatccccaaagcctgaggattgcaggcatgtgtggtcattggttaccccgggctggcaatgttactttcttagttctgacctataaagtaacatcagggggagctttcagaagaattcggaggatatatattatccacaattgttacgaagtaaaaggtttgtcttgaactcaatggagacatcagaaatttttgccaaattctttggcaagctgggcatagggtcacacacctttaatcctggcactcaagaggcagaggcaggtggatctctgagttcgaggccaccttggtctgcagagtgagttccaggacagccaaggctacacaaagaaaccctaactttaaagaaaagacttaaaactttggttgcacagtggctggattgcagtccttgctgggagacctaagtctggttaggggggcctgggttctctttactgtaaggcaagactccttaggttcgagcacaaggctcagacatgatatgtcttcaacagacagctaatattacattataggtccagggaagctgaagtgtgagcctgggacgtcatggtgtcctgtacgaatgccatccacagccgagtaccttcctctgtgctcagcctgccccctctgcatgccccttgccttgctaactggctctggcatccccacacagacctcattaactggtcactatctttctcttctccaaagaaacagggtctgccaacaccagcaggggctcgtcagggtgtgttacacacttctgtgacttggggaagcctggagagagtatttgaaggagattgggggagggcagaggactcgctctcagaccttaggctcctcaacctcagacttggatctcggactccttgaggtcttaagctgccagcaccggaggggacaatggcacggatgtctctgtctgtggaagtctgtgtcctcaggcagccaagtttccctcaggcagcagcctctccctgtcatagatgctcatggtttgtgtaaaaccccatggatgtgttaaagcgtgggttcccagcccatagagctatgcaggggtggtgggacatttctttaagtggtggggtctggtggggatttccttttgcggcgggggcggcagggagggtgtctgttgagactgagtcttactgttttagccttggtggacctgaaactcactgtgtagatcaggctggctttgaactcaaagagaaccacctgcctatacctctggctcctgagtgttgggactgaaaggcattggtaactatatcacccttaactagttcaaggttcttgggtcattaggagtcacactgtgcctctgtatctttgttttacacacacacacctctgtgacccacagtcccaccacagtctcctaaacattggagcctctaaccacataccagaccagcctttctcccttaagagtccttcacctcgggggctttgtcatggtgagaaagctgaaggacactgcagtcttggtggacctgtctgtcaaatagtcctgcccactttatccggggagtagggacactggctgaggagaaactgcacggttggggaatgccaagctccgtgctccttcttgaagactcttttaatccagaccccaaaattgtgtgtgcgcactccttggctgctgtctgagctctgaagcctggttggtcagcgttgctttcattgctgcacccattgctttcattgtttctgttgtttgtcatgagagaggctcagctgatcacctttgcaatcaaagagcctaggccacagacggcaaagcagtaactaagtaacgcatctatggacagaggagaggggtgccaggtctgctgtgaaggatgggaggctccttggccaatcaaaactcacccagagccagaccttagaggctgaagacccagcccgaggtggcaccatcttgcttcgctgggagactctcattccctcttccttgctctctcatcccacagtgaactccctaggggccttttcctgactgtaaagtgtcatgggcagctttggtgcctctcctcagcccctcagatgaagggtcccttgccctgccccgaggccacaggatgaagacaggaagtgttggatagacagacagaagggctcacttttccacgttgttctctgagttctcctgggcatcaatcaaaactcccagatttccccaggagatgggagctcagagccacgggggaatgcttccaatttgctttcagccaagttgcctcgtttgctttaaagggcaagcttgttttctttgattaccaagacgcccatcagctcctgacagcttatttgggtgaaaaagctgggggaatgggagaagtggccgatgtggagcgagggggtagatgatgatgccagcaaaaatgacccaagagtcggctccttgaattctaatatgatggctccctgtcctttaagatgccaccaaccttcatattgaaatcattgccaacccagcctctctttgtaagattcctgcccagagagtgaagcagggctgctgctggactgtgactttaattgtcatgaattctattgattcatctttatcatgcaaatatgcctccacttcattcagataggcataggcctcttggatatttattactgcactcttattttgaaaaaaaaaatgttttcaactaacagagcccctcaaacacttggagagaagctggaagaagaaaccccatcacctgtgactatgggaaggtcaggtagagagggaaggtcttagtttaagaaattttttttgtaatacaggccagtgttagaacttacctatgtgcccaactgttctaaatacacaagtgatcccagctcttgaagggggctgggggggcgcaggatgagaaaagttcaagaccacccttggctacacagtgagttgaaggctatcctgggctacacaatgaactgtaggccatcccaggctatatagggaaactctgtctcaaacaaaataaaaatcaagaagtactctctgagctgggcatggtggcgcactcctttaatcccagcacttgggaggcagaggcaggtggatctctagtttttgaggccagcctggtctacagagtgagttccaggacagccagggctacannnnnnnnnnnnnnnnnnnngctgtcctggaactcactctgtagaccggctggcctcaaactcagatatccacctgcctctgcctcccaagtgctgggattaaaggagtgcgccaccatgcccagctcatagagtacttcttgatttttattttgtttgagacagagtttctccgtgtagccctggctgtcctgaaactcaccctgtaaaccagactggccttgagagatcagtctgtgtctgccttctgagagctgggctcaaaggtgggcatcgctactgctgagctaaggagtacttcctagggatgagtgctttcggtccttataaccctgcaaggtcatggttattttctctgattcacagacaagaagagggagctgagagagaggtacaggagtccagttaatcatgctgaacgcatccattcatgctcagtggttaaagatgctgcttaccaacacggaggacctgagtttgagtcagcggaaggaggaaaccaactcctgagagtccttcttgacctccatacttgtgccatggcatgccagcacacacacacacgtacacacaggcacacaggcacacacaatgctactcctactcctactgactttatcttaagccgctatcacatagtagatgctcagtaaacagctgtcagtagatgaggagactgtggccctgcctccttgtcatttcctgcaggactgtggggaattgcaggctggtctccagtcgagctgaggtctgaaccccaatggtcataattcatctacatgacacaacaggcattccctcatgctcctggaactccagccctgcctaaggtaccacctcccacagccctcacaagagaagcatggtcagtagtcacataagcaatggcccaagcttctgaaccttcaggctaaactcctccccagttacctagcaacagtgaagaccataaaaaggggtgctcagccccccttctcactcctttgtccttctctcacttctctctcctcttccctttctctctgtcttctcctccctctctcttctccttcctctcttctcttctcttctcttctcttctcttctcttctcttctcttctcttctcttctcttctcttctctcttttccctgcatttctataataaagctcttaaaccatagagtctctgctctgctccatcaagttccactgcacactctggtcagtgttgggaacttcttccctcttctctgtctcccacaaccctggtggctttagcaaagtagctacagtgggggggggggtccccaggcagggctgccccttggccaccccctgaagagtgggatagaggaatgcccagccagagatgagtggatagggtagatagcagccctcccacgcctgactgaccagagaatagggaaactctggcagggtgtgggcacctttttcctatcccacttctccccgggcaacaccccagggcccccctttttattttgttcccaacacaggtcgatgcagatgcagtaatgaggtcacaagccagattgtaacctccatgagagccagccaacatgtcattgggtgtcttagttagggcttcctgttgctgtgaagagacaccatgaccaaggccattcttacttaggaaaacatttcattggtgctggcttacagttcacagagtttcagcctattatcatcatggtgggaagcctggcaacgtggtaggtagagttctctatcttgatccacaggcagcaagatggggtgctctgtaccacactggtaaaccttgagcatatatatatatatatatatatatatatatatatatcctcaaagccccgcctccacagtgacacgcttcctctaacaaacccacacctcctccaataaaaccatacctcctaatagcgccactccctatgatcgaacattcaaacacacgagtctctgggagccatagctagtcaaaccaccacatttgggttggtttttttgtttgctaggcagaatctcactgtattgaccatgtgatttccaacctttgcctccaaagtagctggaaactacatcgtgtggattatatttggtttctggaggccccctgggacaggcttgtggcaatggtgctgaaagtgtcgagagagagggtctcagctgtggtcaggggctgcagagtttcagagacagatggcggtcagtagcaactggggataggtgctcacatggctgcttgcagtggtcaacaaccttctgcagcttgggacagacctgggcgcggtcacctgcccttctacaagttccaaagtgaaaaagaggaagccagggaggggctcactgtatagtaactgagttcacttggagcccagtccctgtggctcccacacagtcacatgagtttttgtgatctgatcactctctccaggctttggctgcccttctctaaaatagggacagacaggggactttacagtactctcgtataaatgcaatactaccaaatatgtccagcttttatgactaatgcaaaaatgacaggtaggagctgagaagatggctcagtggttaaaagcacctgctgctcttgtcggatcaaggtttggctctcagaactcacatggagcaaccatttgtcgctctagtttcaggggattcagtgccctcttctggctgatggtagtactgcacaatatgacgcatatacatgcaggcaggcaaaacattcatacgcattaaataaaaaatcaaaagaaagaagttccaaagtacgactatggtatatcattctgcagactgaacagaatagcagaggcaggaggatgctgggggtgttggcttccaacctagatgagaaacgctgggttcagaggaacacactcagagctacagaggacacttaatcccgcttctggtttctgtgtcagatgctttgaattcctttcttggtcaaagcatgctttagaaatgtgcatttctgttcgcacatgaccgtatagtggattgttttggttgtttcaaaaaaaaggaagggctgatagtgacacatctgcttagcatgtgtgaggctctgagttccattatagcattaaggcatgtacctacacacatgtatacacatacatacacacatataatcacatacacacatataatcacatggatacacatatacatgcatacacacatgcacacacacacatatacactttttttttttttttttggtttttcaagacaggtttctctgtgtagctctggctgtcctggaactcactctgtagaccaggctggcctcgaactcagaaatctgcctgcctctgccttccaagtgctgggattaaaggcatgcgccaccactgccaggcatacatacacatataatcacatgaatacacatatacatgcatatacacatgcacacacacacatgcatgcataagtgaacaagcatgcatgcacacatacacacacatgcacatgcatccacatgcacacaatacacaatacatgcacatccttatacacacatccacatgcatatgcatacatacatatcgtgcacacacacatacacacatgaatacatatccacaacacatacacatgcacacacgtacacacaggaagtaaataaaacagaacttaaaatgcaggctagagaaatggctctgtcagtaaaatgcttgaatctgaagctccttcatactcatgtaagagccaggtgtgacacacagaataagaaaataaacccttcatctttaaaaaatattagttaccagagtataagatatcaacataattaatagaggaagcacagacttcgtatttgcctggtgtttggtgcagtgtgaacccgcgttattctttcaataattaagcctgcactgagagtagaagaggagatgcatttctttgtccattaaaaggaaaaagtttcctgcatttgagagcattcaggttaaaatattttcattggctacaggatctagcccgttgctataataaaagctgaagttcagagatactttaccctgatgttctgtttcaagtgttcttgatttttaatcacttttaattccaagaactctcactaggacctcaaagaaaaagtgtgtgtgcgtgcgcgtgcatgcatgcgtgcatgcatgatgttcatgagtgcaggtgtcttttgggccagtagagggcgctggatcacctgaagtcgagttacaggcagttgtgactcatgaatgctaggaactgagggccctctacaaaaacagtgtaatgtctaaatgtctaagctatcattccagccctcccatttcagacaggatttcatgcaactcagactgccgtcactaaccatactgttatggtttatatatgcccggcccagggagtggcacttttagaacgccctgttggagtaggtgtggccttgctggagtgggtgtggccctgttggagtgggtgtggccttgttgtaggtgcgtcactgtgggtgtgggctttaagaccttcatcctaaactgggcgtggtggcgcacacctttgatcctagcactctggaggcagaggctggcggatttctgagttcgaggccagcctggcctataaagcgagttccaggacagccagggttatacagagaaaccctgtctcgaaaaacaagaacaaacaaacaaaagaccttcatcctagctgcctggaagtcagtcttccgctagcagccttcagatgaagatgtagaattctcagttcgtcctgcaccatgcctgcctggatgctgccatgctcccaccttgatgataatggactgaacctctgaacctgtgagccagccccaaataaatgttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagttagggtagaataagtcgtggcgggggatcactgcaattagcctggcagtcacagcacacacacgttgtgaacataccttgtgcactcacatacacgtaggcacccacaggatacatataaagtaaaaataaataaagctttacgttattttaaaagagcgtgtacggctttttgaaaggactagagtttagtcccctgcacctatgacaggtggctcacaactgcccacccgtaattaattttagctccagaggatccaaaaccctttgtctgtattcacattcacataccccaccaacgcagacatagtgataataatattaataatgataataaaactttaacaattaaaggggaaaaaacctaattagaccaagggtggtggcacatgcttttaatcccagtactcaaaggcaaagactggtggatctctgtgagtctgaggctagcctggtctacagagtgagttcgagactacatagtgagaccttgttccaaaatcaaaacaaacaacaaatccttattttaagcatacactgaagggggtcacgcacccagcaagctgacctctgaacatagtgcggacagtgggcaccaaaacaaaccaacccatccaattacttgaactaagttcactcgatgtgaacttcacaaatggtatcagtaagagatgaggagagggactatgaaatggcaggtggaccagacaggaagcaagactatcagaagaggatacttgatggtgcttgcaggaggcctagaggaggacaggatggaggttgggcaagggagtgaggacctggagctggacgggatggcaagtggggcgcggacgcctggaggggagaaatcactggacggcgtgcctactaggtgcacacagcctgcagcctggggcttccccgctgtcactcaccagctcctcaagatgcaagtttcttggcccacagttaagcaactcggcggcccttatgttgctaggttacgagccactcttagaaggcgggactttgagtttgactgacattctttttcaccatttaacttcgaatcgggttgcgttggctccgcctcctgaaagatggccaatcaaaatccccgcctctctgacgtttcgccaatggaaagacgcaggattcctgttggttgcgcgagtgaggcgggggtgggggtggggtggggaggaaaggggtgttgcttcctcgccccgccctccctttgggaggagggctgtgagaacgctgagtgacgtgtagtctaccctgtcaaatttcattgcgaccctctgaggccagtaggctgggcctagggccgtgggcgggnnnnnnnnnnnnnnnnnnnntaggctgtggcctagggccgtgggcggggctttcggggctgagtgacaggagtcggcggatgcgaaggctggcgcagctgccgctgtggcagcggtgaggcggcggtggcggctgctgaggctccgcgctggggatattggcggcggcaactgcgggctgagctacgctgtgcagacccagtgcacagtgcgggatcccgggacggcgcgtgtaaggatccgaggggtgcgcgatcttggcccgagggcaagggtcaggggtcagaaggtgcagagaaggggctggggctgagtgctccagaagcccgaggcggggccctgggaggtggccggcatgctctctccttgcggatccccttctctctgcaccccttttctttggcctgacttcctggggcgacccggatcgcgatggggatcgtggggagctagagcccccgagcgacccttcctccctgctcacctccctgctgtgtcctcttgtgacctggccggggactcctgcctgggtcagtctgcctcaggggacagatcgcaggatggcagctagctatctgattccgggaccttcttccaggggtgaccttaccccaggggtgactcgctgggtctccgctagagagagaaccaaggtctgccaaagggctggaccttaggagctccgagtctgctgtgtgaccttggacagtttacttaccctctctgggccccgtttctttctctttgaaaagtcataggctcttcaggaggcaaaggcaggagaatggcaacttcaaagcttcaaagctccatagggatatccctaccaccaaagacaaaaaacaagaaagcggttggtggatttcgcctaagtggagtgcagtttctaggaatagttggtggggctgcgctgaagtgggcagtgtcccctgcgttccatgactacttgtggctctttacttgggagaggccacgctaagctgcctcatgtatcaagtgggcgctaaccaactgagggcagagccgttgagtcggagccaggaggttgtttcctgtgggtggggtctacagctgtgtactgtagatgttcagtagcctctctggactccctcgcaatcaatcccaagttgtgatgctggaaatatttctagacagtggggacaaagtcactccaggcgagagccattgaggtgagaccaggcatgttagaatggagtcatgcatcccgctgttaaaatgtaaaacccactgggaggatctccctaggatgctagtgacgaacattagaaacctgttgtcatgcgttgggagagcttcttgccttccaagtgaatagcgagaacacactgttagagcctcctcctcatggcctcaaagtacatccttgtaatccctctgctgtggagtgcgttagaagtgtgagcctagtctatgcaaggcactgggggaggagagagttaagccaaaattcaaaacacactgcagttctttaggcagccaaatgacgggtatcttgtgggagttcctcttctgtctccccttgttgagatttccaagcaaaataaattctcaaatctggaaaaggaaaacaaaaaacacaaacgaacaaccccctccccaccccccacttgcaggaactttgccaggcagagtctttcaggcttagcaggctgctgcagaaagtggtgtttatctccgctgccgccaccgcctctgttaagagagacaggctgtctctgcctggtgatgttcccatccatcgttcctggaaagggggcagacattgcccagttgtcctgccgaggattggtttggaggcggactatgtctggtgcactggccacagttggaggcagcaacctgctgctgtctctaagttcaaaggtccccgggcagatctgctgagtcctgcctttctttttatctcagtaagcagaagccggtctgtgtaaacagcttctcgaacaggccagtcctgagggtttaaacctggagagaaggaaggatggggcttttgaaaaggactctgattataagttgtaaggaatgtgcaagtgcttcttcctcattgaacatctcccgtagaggagcgcaaaggtcatgcaagaagaattcctgtcggccaccagcaaagccaggatgatcttatgtattcccaagagtaattactgctctctgaggacaagacctggtgactttaagagtcaccacacctggttaggaatgtaggcctggagacaaagcttggctttctgactgtgggcacctcaggaaagttacctattacctctgtccctacctgatgtgtagaggtttttatttttgtatagccctggctgtcctggaacacactctggctggcctctaactcacagagatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcttcttcttcttcttcttcttcttcttcttcttcttcttcttcttcttcttcttcttcttcttcttcttctcctctctctcctttctccctcaccttctctctctctctgtaagtacacttactatatacagttcaactgtccttaaactatgtcactctcctgcctcaacctcccaatcatagcagatgtggcaattcctaactttttttttttttttaatgttgaaacacagtggcagtgtgggctgtggcttaccaggtagagtgaggtctagcacacagccctgggttcaggccccagttccctataaaccaggtgtgatgcacagttgtaatcccagcagaggcagggggatcagatgttcaaagtcatcctttacttcatagcaactttgaaaccagtgtgggctgctccagttgcatggccatcgctgatgccagatccagaacacgttcatcagtaacgattatgttttaatcattacctttctttctttctttctttccttctttctttttttttcttttcttttcttattttaatttttttatccttcagaccttagaagatgcctctgatggaacaggctctgggaagcttccccggccccgtggctttgaacaggagctcaagccggaggcagtttaaagccctggccgttgtatcctgaggaccgcaggtcaggagaagatggctgtaagtttagatgacgatgtgccgctcatcctgaccttggacgaggctgagagtgctccgctgcctccttcgaacagcctgggccaagagcagctgcccagcaaaagtaagcctgtgggcaggtgggcggggcgacctgcaggtgggcggggcgactccgagcttgtctgttcagagagtgagagatggtgggtgggcttccgtctccatgagagaagaacagcccctgtgacccatctcaagtgtgacacagaccttgcacctagtgtgactgatgtgggtgtctgatgctgcagcccagctgtgtagtgcgtttggggtccctcacttctgacacagctttgaccctgtgccaggagacctcaggcaggcctctcttccttgcctcaatccttgttaatgaaaacgtctctgtgggtctccactgaagccggtagtggagacaagcttgcttctctctgccatctcaggatggggtggagggcggcgagctttgtggtgtattgatcggggctttggggtttcacattgtctttctgggaatcgaagcctgctacagagtaaaccccgagagtgggggtgagctgtcccgtgtttttaagtgtctttctggcagagggagaggccttaaaacccttcctggtccccatcccgaaaccatctcctcatttgttcaggacgatggttcaggagaggcttaaaataacttgcctttgcagagggtcctgagaagttagggagcagggcttcagggcttcccggtgagtgcagacagccttccaggatggagggtcaaaggataccacaagcccacaggggaagatgctatggaccaagcagcattgagcctggcacccccatctcctttgtccacaaagaatacagttgggctttgaggatctcggaggcttcctggaatgaaggagagcaatgttccagggtgaggatgctggataaccttgactccctacaaaccaccgatgcttcccccctcatgctcactgctatcccaagtggctgtgctgggtggtcacagaggatcagtcagggaagaaagacccatttcccctaagggatgtgcaggtctgtagaaccctggctctgactcgccatcttaactagctttctttctaagagctcctccacggaaggcagttttacaaaggaggaaacttgagggtcagagaggttcagtaagtttcccaaggtcacacagcaagctagtgagtgagaggaaagatttgaactcaggcctgtcttgactaaagtttcttcccttcttccttttttcttcctagtccatgtcctcctccctctccttccccctcctccatttttcttcaccagctcttaacacacatgggtggaggaggcccttagggttggctgttatttttatttgagttcatttatttgccgtcttgaggtttcaacccaaggcttggcagaagccaagcttgtcttgtgacttcaagacagttattgctacctattttatagaggaggaaatgacctcagagaggggagctaacttggccagggtcatacagccagtgggcagagccccctctgtttgttcctcccataccactgtggagctagctgctctgggggagagagaggcaaatgagtcagcttcaggggactccccttcagcatctctgtcatctgcaaaagggaatggactgaatggggtagggtggcctgctcgtgcctgccatgaggcgggtccatttctaaatgggaactttggctgtcttcaagacttcgatctctccagagtgcctggggttgggacaggatcctgttctcccatgccaggaaatttctgagagccacccagttctgtaccaggagcaggccttctgctcccggggccaccagggaggccaccagatcttgctgaagtctgttgccgattctcgcttcagaacagaaaacacaacatcccttgccacagagccttgtgttttctgctcaggacactcttgcctcggtatccccctctcacactgttacagggagctttctaaaagctctgaggaagaagcgtccctcatagctggctgaaagccagggcctctctgaggacagatattgtcttagtcgtggtttctatggctgggacaaaacaccataaccaaaagcaacttggggtgggaaaggtttcttcttaggtttctaggtagcacccataatgggaggaacttaaggcagggacctggaggcaggcactgatgcagaggccatggaggggtgctgcttactggcttgctcctcatggcttgctctgcctgctttcttatagatcccaggatcaccagcccagggatggctcaatgggcggggccctctgttgtgtcaaccactaattaagaaaatatactgcaccaaataaataaataaataaataaataaaacaaaaaaagaaaaagaaaatatattgcagtcgggcattggtggcacacacctttgatcccagcacttgggaggcagaggcaggcggatttctgagttcaaagctagccaggtctacagagtgagttccaggacagccagggctacacagagaaccatgtctcaaaaaccccccaaaaatttacatatatatatatatatatatatactgcagacatcctacagggcagtctgataggcagcattttttctcaagtgagattccctcttctaaaaggactctagtttagctccagttgatataggagacccacagacctttgtccaggcggagctatttcatgcttacatgttttgattttcacattgtcctgaggtcccctactgtcaatgggagccacacccaacctagcaatttcctgtcctaaaactgtttggggaccgtcctttccctccatggtggactcaagcagttttgctcagtgtcccttgccttctttcctgcctggtcctgattctagggatagcccatggcgtcagcctgcctccagtccggtgagtctccagtgctgtgttgagcccgggctttggtccggcagtctgtccggaagacattcctgagccttcttcatttgctcgaggattccagttggagctgaaaattcctcctgctcacatggtcctttgggaatcttgtcagcctccctctagagagagttaatgagtcactttgctgctgtccggggcaggcagggagagatagccacctgtggtaatgattcagccatccggtcaccttctgggccctgacttccattcatctttggacctctcagctcagtgcctacaggagcagggacttctcagggcgtgatgtgacagaaatgaactgagctgattttctggggcctggaagctggttggtgtggctgacaaatggctcttgtcagatgtgagtgacattctgccttgcctagaaccagtggcttgggtctcttctatcccaataataccttatggtcccggagaccccccaggccgcggtcgacggtggctgcaaacccctaggttttagctcatttacctctaaagatcccatcttgaaacctatgcgccatattgagagactctgggagtcagcatgtcaacatggggatttgcttcatcattcgactacttcgttttgttttcctgtgcgtgcatgtgtctgtgccgtagcacccgtgtggaggtcagaggacaacagcccgtaagactcggttctgtccactgtgtgcatcgctggaacagactctggtcatcagacgtggtggtcagggcctttacccactgggccgtctccactccacagtcctgggaggggagagaggggtttgagactgggtctctctggggttgccaaggctgatttgggaactcaaaatcttccgggggcctcccttgagttacagggggatcagtctcacgtggtctttgaggcccacagttcttgtaaccttttctccactgcccaccccccacccgaccccccccaccccccgccccaacttcctgtggcagccttcagtgtggattttatgtaagaactctaacatctttggctctaagggcggctagtgagatgctactcacgggcagaagggtgtcaggctgatgataaaggaggtgaggtatttaaaacagagagaagaacctttaaaagggtcctggggctgacggtgacagagtggttagagacaaccaataatccgcatgcattcgggacagtgatctcggctgcgtgtccatgccagtccatacagtgggtgtgcccagaggctcctggcaattcacatcaggatttgctccctcccaccccatcccccccttaagctcacacatgtgttttttggtgaagaacggactagggacgtgaggacggctgtaacacggtctcctggctgttttggtgtggcactggtgacactgttgtattttctaggtggcaagctggtcagggatgggacctaaggggannnnnnnnnnnnnnnnnnnnatctatctatctatctatctatctatctatctatctatctatctatctttctatctatctatctatctatagcacatatagcacaatggatacacatatacattgtacccacaggggcctgtgtgtgacactcaggctccttctctagagacttcatacggtgccaggtatcatctagatgaccagacttgctggcctcaagcggatgcggccgagaggagctgagaaggtgtggcgggaccattctggaaagatggtcagctcaatggtccctcctgcagaagtctcactgtatagctctttcttgggccagacgttctagcatgctcgtcaaagagccgaggacaccaggagccttccatgacctttgtagccggagcggtggggtggctgtgtgggttccggagtccgttcctagctgaggacataactggcttcgacaagctgcagcatcctagggttcttacagtatcccaggcatgggggtagaggggggggcggggacttggtgaagtgctacagatcacatggtcagtgcgtggccagctacaacgtaggtaggtgatgaggctctttcgaggaccgtctgcagtgtgtgaggcatgcgcccctatctcctcactccccaccccagcaggtgcctgccaccacacagggacaccgaggcagcatagcggttggaaaccaagaacaattaagtttccaccacctcccacttggcctggccacctggccacctggccctgccagagtcattcctctggcttttacagggctctaccaaggcagagtgccgggtgtcgccagattgtcggtggtaccaattaaaatgagcgagcacccagcctgctgagatggagcctcataatagagactcaaagcctcgtgtttcctggccctccgcatcttcatggggggatcctgtctgttgcctcagggccccctgccacgaaacgccatctctccctctgcacggagaaaagccaccgcatctaaatggcaggcacagcagctgggtgcgggaccggcacctgctgccctgttccgccagtcacccgaaggaggtctgagatcatatgtgctctggaagtattttatgagccagaacagttgacttcccagcctcccagtcagggaggggaggagggacatggggagcagccagaggatttactgtgctgttgatctggtggtttctggcctccgtgtctcctgggattgtcttgagtaacaacgcgaggcccctggaggaaaccccacgcatgcccttacagaagggaaccaagaccgaagcgttggggcccttcatgctcagggacctgaggggtaggtagctcttccttctgatctcggctgagcggattccctgacgtggccactctctggcttaaactcctctcccgctgcccagtcagtctaagtgagaaagttcacagaaaagtcacagtgagctgccactgtggggcggctcccgggacgcggtgcgcacgtcccctgtggcatcgtgaccccgcagacatctaggtcagtactttcaagatcctcccactgggaggaatctgaggttttcagaggtagtaacctgtatcataaagttacactggtacacttggatccaagcattctagctctgtgcctccatcagggagtgaaggttgagggggcaggattggnnnnnnnnnnnnnnnnnnnnnnnnnnnnnnnnnnnnnnnnnncttcggttttccaaaccgaagtgtgtgctgttccacagagttggctggcctccaaggcagcgttccctgttgtcagactggcctccctggtggtgttttgttgtacaaggtctgtgggatcaccaaaaccccagcttcctgtcttcagtgagccacggcttcctcctccgtgtactctcccccacacctgccatcaccaccatcccctccacactagagcctctgggtttgttttggctatgaaaagaggatgtgtcaggaaccaagattaaggagcaggaaagggagaaccagggaggatgcgcttggagtgtgtgggggatgggggggggggtagctgcaggccatgtggatcccagatgttggatccctgtggcaggccatcaatatggagaccagttgggagatgccccagactgggggcccactggcgatcatgtctttggttcctgagacccttgatcttgtttgctttctgtcagggtgtgtagctggtgttggacgtcttgggcggggcgtacttgtgtgtttgtataattcaggcccggaaggctgaggcaggtggatcatttacgttaaacccagaaagtgtagttctgaactctgggggctttggtgattgaaggagcagccttggacatgctaacacatgtgctctccgcaggggcagctgccaccttgctctgtcccccagtcatcacagggtcacaggctgccactgccagagccgcctaaggacgtcttaacaccgtctgcgtcctcacgctagctcacttctgcagatcacatcaagtcaaggaaaactgtgcccacatggccagccacctgtcctggtgtgaggtcacctcccctgggtgtcattcagggagcatcagaaccggttgaggcaggcttagcctgtcaggcagaaaatggagagggcagaagggccagtttctggcctccctggcttcaggccatcttctttctttaccactttttggttctcgtgctacagctccaacccccgaaccccacatctgccacaggggtgcagcaccgagccacacccctctctcagtgacttgccttagctgataacaagagtttactatttcacttttagctttgccctttttttttttgacagtgctaagaattatggcctcagccatgctagctgaggactctgtcactgagctacaaccccagcctaaaggtgtttatgtgtacacatgtgttctgtctttgactttggaataggtagtggagattcaagaagtgacacgtttaaacaaataattgtgtgggaactggagaggtggcttagtggttaggagcacaggttgctctgacagaggacctggggttctgttcccaggaccttcattaggcagctcacagtcacctgtaactacagttccagggcaaactggcactctcttttggtctccataggtacctgcactcacatggtgcatatgctgtcaagcaggtgcacacacacacacacacacacacacacacacacacacacacaaataaatgatgctttaaaacatttttttttaatgtaatgatttgttgtctggcccttcttaaacctttgccatctttgtaagctaagcaggtagcacattctaatggctggctcatctgtctttaggaggttgcagaaaatgacctgtggaggtgttgataggccggggagcatgtgatggacccgttttgttgcgtgtagttttgctactgttaggaatcacaaagtacatatttttggaggtagagggttgtcagaggggtcgcgacccacaggttcagagtcaacaccctagcgctaaggtggagtgtgccccacattttaaagggatagcgaacaggaagtgaaagtctgttcccaagaaggagccagagagagcgctatcctgttgtggttgagtgacacggcagtgttttaattactgggtggggtggggtggggagccaggattctgacggtgccttgcctccaccccaggcctgtactgagatgtggaaagaacaccagagtgatagagaaggccacaggagcctcaggcaggggctgttgtcatgctgcagggctctgaaggttcaccccatctgcctccagaaaggtgctgaaaatgagtgacaggaccaggtgggggccgggggcgtggccaagcgtgtacaaggccctgggttcaatcccaaccagccacaaacggggaggggagtgggggaaggaggaaatgacatcatggcagcggtccaggacaccacagtgcctgtttgattgggctcggtgtgtaaggggcacctgggtagtcaagtaggccttgtgcttgttccaacccgagccttaaccttctgaaaccccagtctcccacattcttgcatgtgcctggtgccttaagcacagagtttatagcccttgcagtgagttctgattgtcccactgtggtaggaggcgttagagcacagggagacatcgctcagttagagggagccggatttgttcaggtgtctgggtgagcaaggtcagggcttctcagactgtttctacttataactccttcttttttttttttttttaattaggtatttatttcatttacatttccaatgctattccatataactccttctttaaaaatttttttataaaggtttatttattttatttatgtgagtacactgtagctgttttcagacacaccagaaaagggtgtcagatcccatgacggatggttgtgagccaccatgtggttgctgggaattgaactcaggacctctgggagagcagccagtgctgtaaaccgctgagccatctcaccaaaccaagaaatgtattttaaaacaattcttcggtatatataatttcaccatttattaaagatgaaggcagatttgcatcctaagtgggaatgatgtggctgtttgctttcacatgcagggtcaaatcctggccgagtacttgatgccgcaggattcagggactccgtttcctagagccgatcaatatttggagttgatagccattactgagaacattgctctgcataattacctagggcacagaggcaggagcacgtttaggctcctctcagacagttgaaagttctgtcctaatcccaaaacagaattgatttagtgatttttttttccttttttaaatttttttttttttttgttttttgtttttttttttttttggttttttgagacagggtttctctgtatacctctggctatcttggaactcactctgtagaccaggctggcctcgaactcagaaatccgcctgcctctgcctcccgagtgctgggattaaaggcgtacgccaccacgcccggcccttttttaaatttaagaaacccaagttagtaactcaaccgtcagtgtttaaaatcaaatgttcaaacaatccaaagatatatgctggagaatgacgataggaaaagactttagagtctttgtttttcataactaaacccctgtcttcagtcagggtcaccaccacagttttaaaaagtgggatctgggggtgggggagggttttggaggacttttgggatagcattgggaatgtaaatgaggaaaatannnnnnnnnnnnnnnnnnnnattgggaatgtaaatgaggaaaatacctaataaaaaatattttttaaaaaagtgggatctggggaggggagggttcacggctgggatgaggggccagccctctctggcaggggatagcacgtatagacagaggaagggtgatataggctttgggacagggcggggaagggcaaagggtgtagaatgtggggtgagcctgggctctggggtcagatcagctgggtgtgagtccagcacctggccagcacgtctctcagcttgggtccccttattcataaagacgctgtcctgaggttgaaatgaaaggcttccagagtctcagcttacagagaggccgtcctgccgtgaagtgcctgagctgtgaagtgtggtcggtggagttgtcgtatgatgatataatagatgaccgtcccatggtgtgggttggtcttggagatgctctgtccatgtgatgaaggcagagctgggtttggcggttggtttactctctggttcaggctccccagcatcccctgagcttccctcagggccacgtgcagcataccaccttgcttatctacacagcccggatgcctaacaccctcctgcttcagaggtactaggaaacatctggaccaggaaaagcttgcaggactatcccggccactgtgccctggccagggaggtacttagattagtccaccctggcagcaggaggcaggggcaggaagtgagagctgacctcgccaccctcccatgcccttcctcatcccatccgcccagatccagatcacagaggcctttaagtccaggcccactgtctcaaggacctgctgtgtcccgctttccacccagctcccaagcctccatcctgaccagagatgggcaagtgtcccactgctcagtggggtggctttgatcttcacaaagcagaaacccgcttttggatggcttctctttgaggtgtgatgcagggaatagcatggtttctccgtggaagaccccactataattgagggaactttctggagatatttgcagggcatcccggtctccattaggttatggcactggccagtcctccctcattctctgcaggagtcaaccttgctccttggctggagaacaagtaaaggagctacaagtgaaatggcattcacaccacctaatgacagtctcctcatccactgtcattgcccacattgactttacaggcaggcatccccactcatacaatgtgggattggctcccgttctttctgcagtcaaacctgtggagatgtggtatagctggtcttcgctactttgtgggttcttctttttcccatcttttatctaacctggtttcacaccccctattactagatgagagagagagagatctgtgaatttaacttttttcttcttgtttcttctttgaacaggactactaacaaaccccaaccaaccccttggaatgaccaacaacccaccctgccaatggggggccctagcatttatacacactttgaaagttcccagaattccaaatgtcacataattgcagaaactatcggcagctggtagaaccacgcctctgctagagaacaaggctgctgtggacagtccaaagcagccctatatccccacatctggaattaaaacagaaacacattcttatctctctctctctctctctctctctctgtctctctctctgtctgtgtgtgtgtgtgtgtgtgtgtgtgtgtgtgtgtgtgtgtgtgttttaagaaatcaaaattccagaattctcactacaatgtgggagaaaggcctctaccctctaccccagggccttttcctttagcaaacacttgtgagccaccttggccaggtgacagagaaggaactggtggtgaccccagggccttgttctggctgctttaggctaagtatctgctccagttctaggacattccattaatagagttcaaagccagcctggtctacagctttgagaccttatctcagaacaaacagaagagaaggagaagagaagttgaggttggcaggtcctcagggaaagacgggaggagaagatgcctgaatcctgaatgactctagaaaagctgattcccaacccagagaagaagccatcttgggagcagcctgctaactagttcaagtttcaggatgcctggcagtgaggggctgagtgttattgacagcccaggagactggaagccaagttcccagacatgtgcccacctgagttagataaggggggtggttccctttttaattcccaagcatgttggtattctacacaggggatagaccatacagagctacgttaggcctcagttgacaataaatagtacactttttttttctcctggagacaggatggtgtgtagctcaggctggcctcaaccccctgtgtagccaagaatgatcttgaatttctgatcctcctgcctccaccttctgaagtgccaggagcacaagtgtgtgttccacacctagccgattaagtttggcctgttctgttttgaagttatggctggaaaactttctgtgtctggtcgtctgacaatccgtgtcttatctgctgctacatgaatgaaatttacacaactagtgtgagcttactttaaaaaaaaatagtagattctggtcagcaagatggctcagtgggtaaaggggcttgctgtacaagcctggtgacctgggttcaattcctgggacctacataaaggcgagagagagagagaaagagagagagagagagagagagagagagagagagagagcagtgttgttctttgacacagtgaatggcattatgccatatacacctaccccacccatccatttaaaaatgacaaaacggatccccaaatgccacatgacttgtatctttagcaccaacaccttacttctgtcttggtagtctacaaaagtctacgtatggtagcctatgtctgtagctcagttggtagacggttcccatccccagcatgccatatacccagcccaatggtgcaggtctgtgagcctggcacttgagaggcagaggcaagaggctcaaagagtgcaagataaatcagggcccctgggtcatgtttgcatagagagtgagacatgtattctattgtttgccaatatgcgtgtgtgtgtgtgtgtgtgcatgtatgtacatataggggtgggtgctttgaaggccagaagaaggcttcagatcacacatagctggcgttacagttgtgaactgcctctcctcagcgctgggagttgcaagagcaacaaatgctttaagcactgaaccatctgtccagccccatttttgcttgcttgcttgctttctttctttctttctttctttctttctttctttctttctttctttctttctttctttctttcttccttccttccttccttccttcctttctttctttctttctttccttctttctcttctctctctctctctctctttctttttaaattgaatttattgattgcttttagtatgtatttacgtgtgtgcatgtacatgcacgtgtgtggctgggctagggctcacatgaggggaccagaggatgacttgtgagagtcatttttctccttccacttgtgggttccagagatggaactcagcctgtctggtgtggcctcaggcatctgtgcccagtgagccatcttggtgaggacccgctgtttgttggtttttttgtttttgttttgagacagagtccagttggtgacaccagttggagctcgctggctggctgggctgggctggggaggtagagtgcccggcggggtaggtggctgatgtttcagagctgctagtcacacggctctgcctcttcctggtactgcagttttcacaaagacaagggcagtccttgtacaccttccctgtgcactttatatttgagatggagtcacagcttcaccagcccctggagttctctagggtaaagcagagtctctctcatgttcatgtgaccatcccagaatagcctgggtgaggtctgcctccttagagcagcttgcattgggagcactgacatctctctcagcctccagcctgcatgtattatagttccagcatcagcctgtactgtttggtgccctcatcttccttcatatctgagctccccaagcctgccatttggagactgcctgccattgctcaaagctctctttctttagtggaatgctacagattttcattttcttcttcgcttagccctcatggaaagtcagctgggtggcaactgaactctgccctagctaatggcctggagccgctccaggccactggctgcatccgctagcactcgtgggtggtccagagcaaacatcatatcttctctctctgtggctctccagggtcccctcttctcacgagctcggctattcacacttggctggcctgcctcgagtcatgtgcgatcgcggtccgtcatgcagaccctaaagcggatctggaacctcaccaagactcgattttattagtattgaagccacttggcccctaggccagtcggtcatttaagtctatgacatagtgggtttcttcccccccccccccttcatttttatttggagactgggcagtgtcccagaatgtgaaggggcagcagagcctggagctggggatggcttgggacaattcttaggctggaggaagctgcgatggaggggcagggtggtggtaatggccacacgtagtcagggattttaaggtttcttcagttgcccaggcttcttcagcccaagaaagaagttgatgtgccagctaaaccacttggaacaaagctgtcagcatttgtgtgtgtgtgtgtgtgtgtgtgcacgtgcgcgtgtgtgctgagcctcaattcctcatctgccagatgatctcaagaacagctaagtgagagtctgcgtggtgagggattaaacctgagattcactaaaggggagattcactatgtaatccagtcacacgggaaggctgggctgcaggattgtaggaacaaagtgtcaaggtcctgtcatcaacaaagtagcatcatcatcaacaaagtagccacactgcaggtgttgcccttatgagtcctgagtcatcgggcaagcgccctctctgagcccggctcttcctcattctgacttcctcttaggggatgcaaactggctttctgacttgttttcccagctgagcttctgaggataatttacttccttgattccccaattcttccccccacccccacccgcaaccccatgcactggacagtcaggagctcccttctaggcctccagagtgagtttcttcatgatgtctctatcgggccgttgtcctattagacagaaagggaaactgatgcaaaaagaaaaagtactcagctcaggcctggccaactgaccacccagggtttcagctccctgaggtgcccattgcaccccaacatccagatcttctaggacatagactccctcctaatgtcactttctggaggtgcctgtaccagggaggccactttgtcccagactgctgcttttctgaacagagtggcttgcagcagcctcagccccagatgctgtgggcacagcattcacagagctggatccaggctaccttccttgcgaatgaccctggtagccactgcgtagggactatgtggattctgacaggacacagctgcagtcttggacaggctgagtttcgagccagtctgccttctgagcatgggctgtctgctggcctcttaaagaggcccaaaatgcccctggttcttctgcactcctgtctgattccctgaggtaggtctcacggtattccagctacttccaagaaaccatgggtcaggtgtctgtatagatgctgatagatatctataggaagcagcggatggattagtgtgtatacgagcatgcatgtgtgtcttgagcccttacatgtttgtgatatttgtgatattctgagcattttgctaggcgagtgctaggataacaaggggtaagtggtgggcatagagacccactttgggagagcaggtgttaacaggtccaagctgggcctcaaaattcatggcctgaagaaagtgatatcatgtatggattagctaaccactggggtagcaggaccagacaactttatgcacagaatagtgttggggggcggggtggggggacgttgtgactgtggttggtctctgatgcaggcgtgccatggcagaaatggacctcgtagcttgcctgggtagagtgagcatagataggcttgaagaagatgggcctcgtggctgtgtgtcctcaggtggctcactgctgagtggggagagccttccttggaagccagcagcccaagtccatatctgtcaatgggcctgtgcactggcctctcatcctacaaccttgggctgtcagaagcagcagagaagagataagaacgcagcagcagagtccagctcctgaggggggtcaaggtatggcccctaggggctctgctcctccagtggccagcttcactgttgtcagtcccctgcctcagccttacctattctctgtgactctctaagcttctggattttggaatgtggctttccaaatatgccttgtgcgatgccaacttatgcttcttgcctgggcttcccactctctgctccccttccccagttctagaacacactgcttgtctgttttccaagtactagggttataagacatgtctagtgcctcctcttgtgtgtttttttttgggggggtgcacacagcagacagtttcacctacaacatcagtgatactgttggtctccttcccctgtgtcccctccctgcccgcaccaccccccttccagactcccgaggccagctgtttctctcctgctccctcctgccttcccttttaagtttactgctttcagccttctggccctttgcctgccaagtcctaggaaggcaagccgcaccaatgaatccctttagatttggccgttcaatcccagtcaggtggttgaagacagttagaggtggtacgatgctttatcctgaccgcttccgagccagaatttcttctataacagagcttgccccatgcagtcgtcctacagagccttctgttgctccttgggcccaagtaagcttttggcaggactggcattgagttggtgccagccattgaactagagaggaccctgggccctagaggccaccctgtgtgcctggatatgccttcagtagacacgctgataccagggatctactctccaccccgtctcccaaccagttaccagaaagcagaggtttggaagagggcagcgtgcctcctgacttcttattctgccgggtttctatctgggagtcctcaaagtgccatccgcccaggagcatcgaagcgccatggcccctgtgaacgccccagcagtgctctctgctttatccccaccccctctctcctcctccagcttcacccatggagtgggacttctcagtgacaactggcaagcagtttcgcggctgctcattgtcattctggtgggctctggtttccagcgggctccgagtgctttctgggtatttgcatttattgctgctgtgcccggagcacagctggcacaggtcccagcgcagagtggagaaactgaggctccgaggaagaggtttactgtgtggcaggggcattttgccatcaaagagggacaggcattcctggtgtgcctttaaagagtgtgggaggcccgagggcagtttggaaggaaagtgccgtggacttccagttcttgtctcatggatcaggccaagtcattcgttgctaccttttggatcagagctcctaccagggcagctctcaggctttttacccaaagctgcctctccaggcctcaaggccaacgggggctggcctgccctgctggacgtgtggaggcagagccgcccctctcctgcccaccctctccctctcctccctccctcctcgcctctcttcctctgctttatggctggcatatggaagccatttctatttatccacaacaccaggatgctgcctcttgctgtgctccagcgagcggaatcctcggattccccgcagggccatttcagaggctgcatgcgaagcagccagctgtttgcagggagcgcctgggcccgttacatcagcgttagaggcggcatggccatctgtgcacgcgggtcatcctgggctgtctgagtctcagggttggaggcggtgcgtgttccgcccaagtctgggcggtttttttctggcctattgctttccagtccctgtctctccgttctcccataacgttgtgttcatgtctctgtgcccatggccagggcttagggatggggttcccaggacagggacaacacaagtctttagtggtcaaggtcttcgtgtctgctcagcctgattttgaagagccctgcccggggcaccgacagagctgaacaccctttgtacctctagggaactttccccaggctcagggtgtcaccttcctggtggctgagtgccctgtcccagccacccagtcaccttctctggtttgttccaaactgtgggtgccagagaagggaatctgcttccactgcccatgaaggtcggtccctgcatccctgtgaatttctagctgactcccagacaagtggaaattcagaggccaaaggcagctgctctcctgaggagtccgaggaaagctagccctaggaccgtttcctgatgatgtcatcctggcctctccattgtggctcttgtggtatgccttgcctcctggcaatgcaggtcatctggaacgttctttcagacgtgccaaagtcccaggtgctgatggggtctttaacggtctgagttggacagggcctgttacagcagtccatgatgagaagctatactgaggtgatattgcgtgagcccagctcttttacctgaagacccgtcacctatttctcatgagaggctcttcaggaggagactgggcaggtcctgtcaccagggtaggtgggtgccagtgtcacaagggctggaactgtgcagccagggattctgtagcagtttcagggagtctggcctcagtgggatcagggggatagatcatgaactgtgtggtgacatacggaagagccacggggcattctccagtttacttccaatctggcctgtgttcatcggagccaggccgtgggatcagttcctcacctgatttgccagccacatggtccaccctctgagctttgatacatcctttgtgcccttccatggggttcttaattatcctttccctgtggaacactgccaagcccctgagcacagctcacacaagggacaataggccctgaggagctggaaagactccagcctcagagctaggcagacaagcaggctcaggcagggggttgcagcttagactgcaagaggttttggacccgaagccaccaaaacctccacatgaaagagctgggagggccagtggctccctgcccaccacttatgacctttctgtaatccctaaatatcctagccggccacctgcatggctgaaggaggcttttgtggaatcacctgtggcttctttgaaaagcccttcagtgacccaggttacccagagcctttcaggcctgtcctccccgcatgagagccactaacaagtcccaggcctcgccaaggtctgtgttgtgttctccacagtgaagggttaaatgctcagatgcgcagaagagggagagggagctcggctcccctacccgggggaactggggtgttggaaccacgttttccctttctgtgctttctgaaaggtccgtcctggctcacctttgtatagatccacccctctgcaaccctcaatctttaaaacaatacagagggaccgtggcatacccattaacacccctgggtgctgcctagtgcgccctgggtaaatgctgccgggtcctgagcctggctcctggccacatgttgttctgtgccccgtgggagtgtgtgattttcaggcaagatcccctacttcacatcagttctatagacttgttgactctttatatactgggcacacacacacacacacacacacacacacacacacacacacacacacactctgtgctttgaggacacaacagagactatatcgaaggtccatggtccatgtccctgtgtcactgacatttggccacagtctgagcattcccgggaccatgtaggggccagagatcatgggagttcacagcagagccaagggcagtctctcccaaggcagcaggagggtggaaagctgaaagaccggagagagcggactgcttaaaggtccttcaggcagaaggtttcagaataacgaggggccaggatattgatggagaagaggtaaaagggataagatgacatgacgaatggcctgtttaactggagtgtgtgttgagagtaaatgcttacggtttccccagggaggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacatacatatacacacaaacacacattcataaacaacacatacatatacacacatttacacacaaacacacatacacataaacacacaaacacatgtacacataaaccacaaacacacacacaccagatttctctggtatagaaaaggtcttggggcaggatgttgagaggacaagatcacgaaagtgcctgggttggtccacaggagagatggctccagctgtggcagagaggaggagcctgtgagaagattaaagacagttaacagcctgagctatatagagcgagttcaaggacaaccaaggccacacagaaagaccttgtctggaaaaaccgtgaatgcacacacacacacacacacacacacacacacacacacacacacacacacgaagacaattaaactgacacatgtaacttttttatacagtatttggtgcttgttggcagtggccagacagggagggtttgaagctggaatctgtgtggagcctttttttttttttttgatcctaggggcgggcccatcaacttcctgaggcctcctcggcctgtgttgattcagctgttgcctgtgcagttacaggccgaggatagtacactcccattctgcctcctcgcagccccccaccccccatgctcctccgccagcccgtgttccccaggaacatcccaagagcctcatcattggtcctctgagtccagacagagtttctcacatctggactcagtgccagctgcggaagtgcagaaggcgatgctctccctagtgaggaagaagctactcggtatctggtgctcaggccaggccctgtaggtgtgtggccattttagtgcacgctagactggctggtggactgtggttcacgaggcaaagggagagtggctcatgtgtgctaacactgttactgttctcttagagccgagctgctaggttgtgttgttagagggcctctgtctgggcagagtctgcagggccggagtgtggagttgtttctcgggccacctgcatctgccagtgagagtggagaatgatttttcctgggaatttgtttggcgggtttttctttctccttttggaggcagtgtctcactgtaacccaaacttgttaggatctccccgccccggtccccaaagtactgggcttgcatcgggccagccaccgcgcctggcctggtttgtgcttcggaggttacacttgtgactggtcacctgacctctggagcgagcttgctccaccgcctagccctcggcggctgtcggggcggacactggatacttaaggacacagttacagggtggagtatactcagtaatccagaactgactgactagccaaacagcagggatgcatttcagattgcatagactgagaggcaggcaggtgtgcagaccggacagaacctcttacagaacactgtaaggcttgcagggacaccaggcagggtgttggctgagtgattctctgcagccagacaggaaaccgaggaagccatgactctttcagtcttttatttagatttatttatgtatttttggtttttcaatacagggtctcactctgtagaccaggctggccttgccttcaaagatctgcctgctgggattgaaggtgtgtgccaccaccaccacctggcttcatttttatttatccttttagtttagtttagtttttgtttttgtttttttaaagatttatttattattataaatgagtacactgttgctgtcttcagacaccagaagagggcatcagatctcattacaggtggttgtgagccaacatgtggttgctgggatttgaactcatgactttcggaagagcagtcagtgctcttaacctctgagccatctcgccagccctagtttagttttttatggtgctggggattgactcctggcctcgagcaaaataaggttgtgctctcctgctgagctgtgctcctggcctacttgcttttaacttgtttgtttgagacaggatcttgctatgtctggaccacttttacttttgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctcctcctcctcctcctcctcctcctcctcctcctcctccttcttttaaagatttatttattacatgtaagtacactagccgtgtgaataactgtacctaaacaccgggttcctcctattgagaactcgtttgctgtggcttatggggaaccagattgtcatagattaatttctcctctgtaaattaaccgcgtgggactcactgccccgtgttcacattcacggaggggggaatcaggagagatggaggattgtgacaagccaggctaacgagctttggaagtcaaagggtccccattggttgacccttctgaggcagccaggagcaccgaaagagctcctctttcccagctgacccaggacaggtgccaaactcagctccagttggctggctccagtgctcgcccatgatccctgggctctgccggcaagtccaggtcagctgcctgtgagccagagccgcctctgtccaagccaaacactgtggccgagggtgggagcgagggtgggagccggcactgtgccggaacaaagcagcccggggttctgggagaggtgatcaagggtgggagcaaaaaagcaacagatggtcctgtccgtgccctccctcccaccccaggggaaaggggaggactcactgtggttaaatgattgactcagccggattgccacaagcttccaaaagtcaaacgtctgtgcagtaagccctcccttctgaccgccctcggtcctcatagacagctagattctttcttgcttttcttcctgcttttttttttttcctaaatatatatagacatgtgtaggtttagcctttccctccccccactccctctggtcttttctacttctttttcttttttaagagttacatgtatctgtttactgaaggggttggcctgtcttcacgcccctcctcccaccatgggagccccagggagtgaactcaggccgtccagcttggtaaaaggcacctttatccactgatctatcttgctggcacattttttttcctccttcttatttaagagaaagtatttttgaccagcttccctgatggttgttgctagaaatacagattggcacatggacagactgaccacccactgggcccccacaccggcagcagaagaccttgccacattgggcgtagcctgatcctaggagacctcaaagtccgcccctacagtgacacacttcctccaacaaggattcaaactatgggggccattcctattcaaaccaccacggcttctgagtttcttccctctcctaacacagatgggggcagccacagcatccacaactcccaggtccccagtctggtctccggagcggacagccccccctccagtcccaccggacacaactgggagatgaattatcaagaggcggcaatctacctccaggtgagtgggtctgggtcagtgtctggggggaggccctggaggctggagtgagggggaggggcgtgcttagcacagcagctcagaagcgaggctgggctctgcttagtggtctctgctccagacaagaagcaggggggggggtgcaggggtggagaatggtccagggatggaggggggagctcacctggttgtgccataggaacttgtgtgcccggtcctcctctgagccccatttgtggctgagcctgctctaggtctgtgccttctgtcttccaggaccacacagacagacctagtcagtccttaggggacattttatctgccttggatggtagcaaaaggttgttcatgcaatgggtggctccagggtctggtctcctcacgtgccctgttgctgttgtctggcctgatagttcatggttgttttggggggtagggttttttttttttttttttttgagaaagggtcactttatgtagtctggaactcacagagattctcctgcctctggctcctgattgttgggatcaaaggcatgggccactatggctagtactgtttagggattttttttttctttaaagcggtacttttctttaaaactactacatgcttgttaacataaattcagatagtctcaggcaacataattttctccattttgtttaagaaaccgggtctcactgtgtagccctggctgccctgaaacttgttgtgtagacctggctagcctcaatctcacagagccctacttgcctctgcctcaggagtgctgggatttcaagtgcgcgcccgcctcctgcagcccaggagaaggcccggtctctgtgtatgtgggatgcgggccctgggtggtgcatcaagggcggcggctgccagtggctccctctgctcttcccttggactgttaactttctctctcaccccagagaaccatgagtgtagaggttctggtgccctggagacttgaactccagagagcagaggcctggggtggttggtctgtacacaaacccagagctctgtttgggagctgagttagatcttacggtgtggatgctcagcccgtctttgctggtagagagaaacgagccctaccagccatcccctgggcggttattgatcctggagttgggagccgagcctcctatcaggctgtctctagccacaccttctcccctagctgttggtaggaaaaattgcacaagaactgcctatttttagtaatctaaagcagaagcttccatgcccccaaggccgccgtgagatggtgggagactccaccccgctcagaccatggggttcttctgcggcctcccctgggcacgacctgcctttgcttcctccgtctggtctgggctgcggtttgtcttctgtgatcggcaagggcagcagcgtgtgcagctgcgactgaatctcctgtcagctctggctatggtctcctgggaaggggaagagggtcatggggaagacggggaagacagggtgcccccccagccccaccccacccccagtgtgagtgctttttcactgcattcccagatgtgggaatctgtcgcagccttttctccaggacgttgagccatagaggtgtgtgtgagtgagtgaggtgcagcctcagtactgtggcgttttcggtgcagccccgtggggggctgttgtatgcgtcacaggacaccgaggggtgtcctggagtctgtccaatgtgaaattggggtgctgtagtcacccatgtaaaaaaaatccctaagcaaggagctaagtgtacacagagtgcaacagaggctctattggacagggctatgctatacgagcctcactgggaatggctcctcccaagtgttactatcattcactgtcccgtggccacagtttggtgtgccggccatcagaatcctggcattaagttcccgtatcttcgatctccgggaagctccagcctggtcctgttcaccattgtggaggaaggcagggaactttgccatgcctgcagagaaggctgaggaaggaagcctgggccaagctgctagtctggcctatgcatagactcttcatgcctaagaatttaccccctgtaaggatcagacaattctccgagccctcctggtttggcaggtttaagcagcagctcctgggtgggcagcaggcagaggcggggctaacctgcctgagccctgtgtgaccctctgtgaccagccccactttctgcccttgcacctcctgggcacctttgtgctcgcatgctcaggctctcctgtctttgtaggaaggtcagaacaacgacaagttcttcacccaccccaaggatgccagagcgctggcggcctacctcttcgtccacaaccacttcttctacatgatggagctgctcacggccctgctcctgctgctgctgtcgctgtgcgagtcccccgctgtccccgtgctcaagctgcacacttacgtgagtgccccgggggaaaagggagccatgatgctcctgtcagtgatttcaggggacctaacacggaacattccagaagcacagagaggaggtgcagctcctccctgctcccagccagagtgggtgcgcttccgtttcccagtgactctgtggacaggcaggggccttgcagagctcactcagaggcctgtctcactgggctacgctgtggtcacgcctgggagagccacagcccacgttggtgtggatgaagccccactatgggtcttcctggggtcactgtcctcctgtcctttgtttagagagttggctgtttatatgtccttcttttaaaaaaaattagttattactagcctgtgtgtgtgcatgtgtgtatctgtgagtgtccgtgtgtctgtgtgtgtatctctgagtatctgttagtgtctgtgtgagtgcatttgtgtagtgtgagtgtctgtgtctgtgtgagtgtatctgtgagtgtgagtgtctgtgtgagtgcatttgtgcagtgtgtctgtgtgagtatctgagtgtgtatgtctgtgagtgtgtgtgtctgtatctgtgtgtgtatgtgtatgtctgtgtgagtgtgtgtatgtgtgtgtctgtgtgagtgtgtgtgtatgtgtgtgtagcccagccatgccatatgtcagaggacaaacgtggagtgggttctctttctgtctgtatatgggtgcagaggatggaatgccggtgtctttacccactgagccatctccccagccctcgcagccgacttagacggagatgacagttatgtttggagtcttttgccttctttttgtttttaatccccagtttttgtttcctgaatgccttttgtggtttttttttttttaaataagtactgcacagttctcctcagaacaagaattttttttaaatctcttagagccttaaactccttccttctttctaactttttactatgtgggtctgcatttctgtctcttgaatgtcaggtttattcttagctatctgggaaaatctctgtctataaagccttgtctggcatcttgaggtttggtctctctctctctctctctctctctctctctctctctctgatatttgtgtgtgtgtgcgcgcgtgagtgcacgagttcatcatgtatggtctccttgaagacggttctcacctctgtggctgcaggtccacgccacgctggaactctttgccctcatggtggtggtatttgaactctgcatgaaattgcggtggctgggcttccacacgttcgtccggcacaaacgtaccatggtcaaggtaatacatctatctgtccatccccctgcggtgattcctcccatatccccttcacatctgtgtctacggttccatttaaaatctcctcagccccagcgtatgcttgggagtgtagcccagtgagattatttgtgtatgccagaaacctgtagggtcacatggttcttccatatccccaaatgagcagacctggaatgaactgagtcccaaagggcttcctggtgctgtgaggtggtcggggagaacatcggtgggcacccagggtggtgtttcactgtcaagaggacccacacaccagcttcatctcaggccacgtctctgtactggccgcaggagggctcactgttgctgttaagagaggcggaaatggaaagagccctgctggtcccccgtgggctgagttcatcagcgtctgctccgtgcgtaggaggctgggtcagggagctaaccgtgtcccgacctgtcatctccagacgtccgtcctcgtggtgcagttcatcgaggccattgtggtgctggttcggcagacgtcccacgtgcgggtgacccgggcactacgctgcattttcctggtggactgtcgctactgtggcggtgtacggcggtaaggcctggggctgggtaggcctttctggggactgcagccctcctcactatggcccagggtcctcccatgtctgcgtgtgtcatctttccagccctacaacaacagtagcttcaggcagacttctcagctctgtcctgtaggttcctcccacccagtccagagccctgagcccagagctaacccgacgtacaattaaacccatccgtaaagattccatctggttacttggtcagggacttgctgatggcagggaattgatcctttgtgcccaaagttagaaacaactctcctgggattgggtagcttagtgtgtgtgtgtgtgtgtgtgtgtgtgtgtgtgtgtgtgtgtgtgtgtgtgtatgctgtggaaggtgaccttgattccccaggtgatgtagcctctgccatgccttccctttaagagactgtcactcggtggagatggctgtgtacacacacatacacacactgttgttgtccctgtcacctgctgggtacattactaagctaagcatggtgccctcctgggttactaggtcaggtataccagatgcatctccaccagcccatccccccaccaccccagggcacagatcagccctcccacccctgccacccctcagctggccatctttctccccagcaacctgcggcagatcttccagtctctcccacccttcatggacatcctcctgttgctgctcttctttatgatcatctttgccatcctcggtgagcagagccaccaccacccacagcaccccatccctgggcatcctgccagtcagtctccgggccctgacagctgagaaggctacaaacccagcatttctcactgatagagcatccccacgtggtagaggggccggggaagccaggtctcactgtgtagcccaggctggtttagaacccttgaatgtcttgcctccgtcttctaaggaagtaataacatccctgcccaaggcctggcctgccttttgcatgattggctgccatgtccgcagagcacaaagacactctatcggcagccggcatctatgacccagtccgctgctgggatttgtttagtttgaaaaccttgtgaaccatcagcttaaaagtcaatcttgggctggtgagatggctcagtgggtaagagcacccgactgctcttctgaaagtccagagttcaaatcccagcaaccacatggtggctcacaaccatccgtaacaagatctgactccctcttctggtgtgtctgaagacagctacagtgtacttacatataataataaataaatctttaaaaaaagtcaatcttatgcaacaacagccacaacaataataaaataaactaaacagatttccagccccttttaaagactagacctgacagagccagcacacattcctaggtgtcagcaggcttgcatgcagcgacatgacctccgttagccagcacgtgtattctccagagccctgcagtcctcaccgaaccctagtgccctcctccagcgtctccccctgactctgctctaactccagccttggtctgtttttctaccacattctaggtttctacttattctccacaaatccttccgaccccgtaagtaatgagctcttggtcccttgtctatggaggggccttcccatcagacagggtagccaggagggccctggccatgttaagaagggtaccctgtctggtttctggttcccaagagtccccacccctcagacctgagccaccgagaaggagccgagggggacccccctcccttgtgttcttataggcgaagcttccagggatcaggtttggaacgttggggcattctagcagagagagtggaggaggggagcttctcacagggacaggtgacccccctcactcctccccaagaaactccctccctcccttagttggtagccagcttcttcactctgcacatactcccatgtgcactgcacctccgcccgggtgccccttgcattccgaggtggaagtggggagaggcgctctagaggagattgtccagacctggcagcaccatccccaccctttccttgcagtacttcagcaccctggagaacagcatcgtcaacctgttcgttctcctgaccacagccaagtaagtctggggtcactcctaccactgacctctgtcctcatccagccaagggatgtccatcacgccccccaccccggcaccctctccctggtctcagtgaacacagggctgagtggagggaagggggctgtctgggagtgcaggggagcagcagtccctcgcaaggtgcatccttagaggctaaggtgaccctctgccccatgcacacagctttccagatgtcatgatgccctcctactcccggaacccctggtcctgcgtcttcttcattgtatacctctccattgagctgtacttcatcatgaacctggtgagtgtccctcgtgaccccactgcagcagtggggccttcggagagatgtggggacaccaagcagatggtcgggtgtggcgccctcctgcagaatgcgatgaggacggctgggatcccccggctctgtgcctccactttgtagatggtgccggatctttcccacccctgcagtgaaaattttgcactaacagagccagcccggctctgcgcagagaggactgtacgcagatctagcgcctgccttgctgtgtggttctgttactgtcatgtgctgggggtggggtggggatgggggtagcagctgggtgtcagacctgcagggacacgtgtgcccatcaccacagctcagagcacttggcactgcaccctgtgaagggcaggaagctccagtgcacacggatgctgcagagacactggctggggctcagggccaccaggaatgttttctgccatcacaggcaagagccaacactaggccaagacccacagcgacagcggagtgagcagagaccagggcgtcccgtagcctttgggttctgtggtaccgcgaatcgaacctaaatcctctcggatgctggccaggctctgtaaccctggaccacccccagcccattggatttgagatgacaggcatgcgccaccacacttggctttatgtggtgctgggggtggaactggggagtcttgttcatgttaggcaaacactctgctggctgagcaacatactgccctcggagaggacctgggcttggtttccagcacttacaatgacaggactcaatgttttctgatctttgagagctcctgcacacacatgctgtgcacgtgtacactcagtcacacgcacacaaacaaaaggaagacaaggagaggaaatactctgtctgtgtggtttcctgaaatctgcaaatttgaagacttaaagaaatatgttcttttctccttccttccttcctccctcccttcctcccttcctccctccctccctacctcccatcacaaagtaacataccaactgtctcctgtagtggttttaagttgtcagctactgagaggcaccaggagaagcagacacttctctgctctcaccacggcctcgggagactcaagaagccccacaaggtgaggggcttctcgccaccaaccagcaaacaacgctagagtggacgctgactggtgtgtccccaatacagtccagagtgacacagttcactgtcactcacctctgaggggataggagaccgtggcccgggaacacagacagaggttgctccaaaccccatgttcctgtggtaactctgctgagagagtttgtctgaacagaacaaagggatgtcataaatcaagacaattttcaaatacattggtggaaacaccattaaggagaaggcaagttctgccgtggacctcctttgctagctgggggagttcttagcctttagatcgctgctctgttcgtacatcctgaaggatttccttaatagccaccaaggcattaggtcaatgcagaggtgcacaggaaatggctgtgaagaaccgtagctagtttgtacttaggtcctggaccagccatgatccaagctcttcagtccctgaaggtcatcctgtggtcacgcaggtgtgtgctttctagcaagttttggccacagcatgtgcagacagccccagaccccacaggtcaaggggcttgcttcccgaacctcaggcggctgtaagcacccagagacccctttgcttctggttcactagccgcacgtcggggtttctcggcccttttctcaagtgactcgcagaactagggagaagtgtttgcagctttatcataaaagaattgccaaggagttcagatggagatttgcgtgggcacagtggacgccctcctgccctccccacacgaggctctctggaagcaccccaaaccctgttttcacaaagactccatcacacaggcatgatgggagtgtggacagccccaggaaactttagggaaagaggccggcatagtgctgccaggctgaccgggcaaagcctgtgcctctcaacattcccctcaggcgggactctgggataccgatggtcggatgactacaacgagggaaagtcagagactttccacgtggctggcaccaagtcagaacactagagaaggcttgggcctggtgctacgtgcctataaccctggcacatgggaagtggagcagggggatagcgagttccaaaccagccatggctatatagcgagactatgtctcaaaatctaagagagagggctcagcaggtaacggcactttcctacaagcctcacagcctgagtaggaaagacagacccccccaaagttgtcctctgaccgccccccccacacacacactgtagcatgcagaggcatacacagacacacacatacatgcatgtgtatgcatacaataattagttttagtaagttggggggttttttggtacccagccacactcctgtgcttattctcatctgtagctcatctctccttggagcggtccagccacagagctgagtaaatgtacgtacgacagagcttgtctgcccacacacccaaatgtcttgcctgtgcgggctatggtagagacacactcaccttccatctgcatgggaagcagtgtgtgtgagggtgtgtgtgtgtgggtgggtgtgtgtgtgtggcgggggggggggtggccttagaaggatcaggagcacacactcagaacagctttgaaagacagagtggagagatggctcagcagataagaaaactgactcttccagaggtcctgcattcaattcccagcaaccacatagcggctcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcatatacatgaaataaataaatcttaaaaaaaaaagaaagagtgtcactcaggtcttcccccaccctctgtccccctcattaataaactgattttgctctggggcagttctagaatgttccattcctggcatgcaggttttctcctccccactattcctggagccttacccgaagctgtgactcacaggaaaagtaaccgtggaaggaggaggatgaggccccagggtcgaagtccatgtggcctcttccccaggcccttcctctggccagctaggggccagctatggggaaagggacagggccctggggaaaacccagcaatggtgacttcaggagagaaatatacaaagagcagcagtttctttcctcaagtacccacccctgtcccgagcagtgcagcccaccgtaggctttcctcagtgaaagccctgtatgggggacagagggtgacccccggatcctgtaggctcacctagggcggccaaggacgccatgcttgtccctttacagctcctggccgtggtgttcgacaccttcaacgacattgaaaagcacaagttcaagtctttgctgctgcacaaacggaccgccatccagcatgcctacggcctgcttgccagccaacgggtagggcagtgggggaggggtcacagggagggacttcattctctcccccccccctttgctgctgcacaaacggaccgccatccagcatgcctacggcctgcttgccagccaacgggtagggcagtgggggaggggtcacagggagggacttcattctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacatgcgcaccggagcttggagggactgagctggagagatgttggtgctggccttgaggccagtaagcacaagggtgccgccctctcagctgggcttcccctgctgtgaaagtgagggcagcaggctcattactctgtcattccgggaggcctctcttgccctcaggggcagcctctgagggtcagaggtggtcagtgtggcctgagtcatcatagcccctggagaacagaggcagtcaggccactgcaggtgagggccctggctcagggctaggtcccataaggtgtccgtcttcctgggagaggcagccttgggcaggtgggaggagcagagtgtgggtgtcaacgtgtgtgacaggccctgcctgtgaccgtcctttcactttgcttgtgacagcctgaaggacttctatgatatttacgaagtcgctgctctgcagtggaaggtgagtgtgtccctgcatccgcatccagcaagtgaggagggcagctcagccttcaatggtccatggacctcagccgcaaccggaatccagaccgcgtgacccagccttcccaaggcttctcagagagatgagccatatgcaaatgtggtccatacatggaccccagatgtccagtttagcagcaggagtgggaggccgggccctgtggaggtctgggctaggttctggaccctgggcctgacctcttctcccctgggtcctctgcactacaggcaaagagaaacagacagcattggtttgatgagctcccccggacagccttcctcatcttcaaaggtgagtgtgtggaaccaagctgggaaagaagctcaggaagggccaggaaagaccctgatcagtaattcaaaatccaagggccaagcgggcacccgtaaccgcagcaccgcagaggctcagacaggaagatggcaagtttgtggtcattctggaccacatagcaaacctcatttcaaaaactaagtaaaagtgcgttaagactgacagatgcctgcagttcttcatgggatagtcacttttcagtcaagggctaggtttgtttgcttttgagacagggtttctctgcatagccttggctgtcccggaactcactctgtagaccaggctgccctcgaactcagagatctgcctgcctctgcctcctgagtgctgagtgctagggcacccatgcccagcctaccttggaccctctaacctttacattttcttctcttcaaacagggattaacatccttgtgaattccaaggccttccagtatttcatgtgtaagtgtgacccatcgcagctctgggcccctgtcctcctgagcccttcattcttgaaggtagagagacaaacaatccagaaaacgccaagcactggattctgtccccagtacttctcaaaaaaaaaaaaaaaaaaaaaaaaaaaaaaagcaaaattctgagatcgaggcacgcccagatcaccaaacttattatgtgcagaagtgatcacgtgtggttgcttcctggccccctgctcccttcagtccctcacttcagttctgggtctctgttgcagaccccagtcctctgggaccacagtgttgatagggtccctcctgtttaaggacgcttcctcagcagatatgagtctgtcactatgcttagttaaggaagtgggtctgttttcgctctgcctgtccccctacatacctaagtccttttaatttggaacttcagtgcagagtcctatggtgatgtggtactcatagcaacatgtaattctcaacatgtaagccagttggggagcggggaacctaggagagtgtggtagctcatgactgtagtcccagcactcgggaggctgagtgattgtcacaagttcgaggccagcctggcccaacaccaagctcttatctgaaggaaaaaaaaattcaagggctggaaatagcacttggtggtagagtgttcactggccatgcaggaagtccctggttcccccagcatctcgcggagttagcagagcaactgttcaagtccccagcacatctcacttacttgacagccagaaggggctgggtggggcagtgccctcaggaagctctctgacttcttctgagaagaaataatgatcagtggccacagtctgagggatagagggctcactgcctggccctgactgtccccggggctttctgcagacaccgcccgggttttgtttgtttattcactattgacttagtgcttattggtgaaggtgatcattttattctgaggtctgattgaaagtgtggaggcagaaacccctagaaacacacctcccctgtagattttctttgagtagccttggctgtcctggagctagctctgtagaccaggctggccttgaactcacaaaaaatctgcctgcctctgcctcctaagtgctgggatcaaaggtgtgagtcaccacggcccagctggtgcttcagattttcaaccccagggatttttttttacctgaccccactactctgacatttcttgattcacaatcttaacctgaaggtccccagcagcgcaagcatgtgtgacctttgtcccagggtcccagcagcagccccaccacaggactgggtcagctggagtgtcacctagggacactttgcttagtgtgcgtcaggcccacagagaaagttcctttctctatatgtgggcaggttgccagaccttttcttgttctgagacaggctctcactgtatagccctggctggtctggaactcacagaaatacccctgtctccgatttcccaggtgtggggatgaaaggtgtatgtcactatactgcccatctttatttcattttatttcagatctttagggcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggaaccaccacgtctgccacttctctgtcttctaggtgggaatttcacctcaaagcatgtgccctggagttacctcgtgtttcttaccagtaagtgtgctgcctgactctgcctggctgccggcttaacccaactggagggtttcgattggctacagcatttaatagcccttccctaaaacaacctggaaggacccccatcttagaggtttagtctgacccctttaccctgctttcaatccatgtactttaaaaaaaaaagatttatttattcattttatgtatgagcacactgaagctatcttcagacacaccagaagagggcatcagatcctattacagatggttatgagccaccatgtggttgctgtgaattgaactcaggacctctggaagagcagtcagtgctcttaacggctgagccatctctctagtccaacccatgtacttcttactggcccctggtcatacaacgtgatccaccatgtatcagccttgcttctagctggcccccaccatgtccctcagttttacctctagctggccccccgacatgtcactcagcctggcctctagctgtcccctcaacatgtccctcagcctggcttctagctggccttctcccccagtgggctgggaagagcccagatcagcccctgttttctccctcttgtcttagtctatggagttgaactgttcatgaaggtggctggcctgggccctgtggagtacctgtcctctggatggaacctgtgagtagagcacacggtcaccctgaggcagaggtgtccatgtcggctgtcctccccacaaccaaagggcaggtggctctggggacacccctggaggtgcagaggacagcaagatctgtctgcctgtgatccaagaccattctggtgatcttacctaaagtctctggggccacccacacaagtccccattgatccccactgtccccagagctggctcttcctagtctcaaacctcgtctctttcacaagggccacagaaggtgtctcctccccttggctggcagtgggaaaaagccacagggtagagccggtgtggcagagcctgtgtggcaaaaccagaccacactcacgaggacttggatcatcaaaatataacgagctagagcgggaagaaatcagggtggcagggccccactgtcatctccacttagggtagggttgagggcttatcccttgaacccagaagtccaaattctgcctaggcaacacagagacaccatatcaaagcggatacacacacacacacacacacacacacacacagagagaggagcaaaagacaaatgagctacaagtttgcatgtcacacgtgagggtcccatgccaggcaccatgccgcacaagaagagtggggcccgtgcctgcctggtgtgtcttgagtcctgccttcagtttctcagtgtggccagcaatcttgggactaccgaggccaaggcttctgccctgtccttagagtagcataccgtccactgaggcagtttccaggcacatacgtcccccggggtcggaacacccaagggtgactctcagacttgagcacacctggcaggcgcaagccccactgtatgctgtggccggtcaggtcgccatggaagccagctaagagcaggactgcaggaggggattgtggaggggaaacctggactgtcaccgacaaactggctccttcccccgccccaggttcgatttctcggtcacggcattcgccttcctgggactgctcgcactgacgctcaacatggaacccttctatttcattgtggtcctgcgtccccttcagctgctgaggtgacctgcagggcttggggagtgggtaatgggtgggcactgagggctgaggactcttgggattagcccatgagattttgccagctgctggcagggggccccccatctttagcctgagctattaaggataggggcacacagtgctctcgatgggcagaacggcccagcctgcagcccagggagagccacactgcctacttgcccagtcgttagtcagggtatcttacctttgagggactggagggatgtccctggtggtcacttgttcctgtttcaacctatgttcctgggcactttgttcccgctgctcggctttttcgggtcccagtggggttccacttacatagatacgccttcctcggggcttgggcttttggagactcagaagtcagggctgccgtgtctgcctaccatgtccccactctgcctttccttccaggccaactagagctgttgattgattgtgcaccccatttcctgagcttgtcccagttgtgcatcccatttcccgagcttgtcatgttacctgagctgctggcttcatctgtccactccagtaggggacttgatgcatttttttttaaaaccagtatgacatgatgagtctagcccagtctgtgccccagtgtcccaggactgtcccatccagtgccacagtttatgagtccccagggaagtgagctcagctgcgcaagtttctcagccttgtcttgccgtggggagaggagggcttacaaggttctggcccatctgaggaaggggcagtgtggccatgcccctgcctctgcagtcccagcaacactgttctcgtcgttcaggttatttaaactgaagaaacgctaccgcaacgtgttggacaccatgtttgagctgctgccgcggatggccaggtactgcccacctcttggcccgcaggtccaggccgcactaggctcatgtaggggtccggggaaatgggaacaaggaggaatctcaggaaggccggattcaggggcttgggggtggtcttcaaagagacagaaatctggaatctgcgggtccctttggcagcactggcctggctgaactgtctagcggggagggcagggagctgtcgacttaccacctgtgtctacgttcacaggtaaggggtcacctgtgagcctaccttcacaggtaaggggtgcatctctggtcaaggggcatctgtccctagcgtcccccaccgtgagccacgcggcccctcccctgcagacactttgtgactgtcactcggccaaggctaggggcatgcctcccgcagtcagtgccgggagaccaggggagaccaggacgcgctgcagctgcccccgtcccctccctcccgccctgaccgcccctgtccctctgcctccccagccttggcctcacgctgctcaccttctactattccttcgccatcgtgggcatggagttcttcaacgggcggctgacccccaactgctgcaagtgagtggcccggaaggctctgggcctgcccagcatgggctttactgctaggctgggcacaaggagctgaatgacagtgtgggagccagcgtcactcatccctagctcaggcctcagtcgatacaccccctccccagaaccagagcagccctcatccctgataggccccaggagacaccgagacctggcaagagaccagagagatgacacatggcaagaaggtcgcagggctgaggggtgaagagagagggtgacacctctgtggcccttccccttctcctcccctccaaaaggaaatgagcatgatccaccatcgctgtgtccagttatgactgcccgcgcagccttggctctgataggctaccagtgacccttgtatgtatccagcagacggctgcaccgagagccctgttgtcgtcagggtttctattcctgcgcaaacatcacgaccaagaaacgagttggggaggaaagggttttttcagcttacactttccacactgctgtttatcaccaaaggaagtcaggactggaattcaagtaggtcaggaagcagaagctgatgcagaggccatggaggggtgctgcttactggcttgcttcccctggcttgttcagcttgctctcttatagaaccccagactaccagcccaaagatgacaccacacacaatgggccctcctgccttgatcactaagtgagaaaatgccttacagctggatctcatggaggcatttccccatggagttctctgtgataactccagcttgtgtcaggctgacacacagaaccagccagtacgagcccataacaatggtcaccatagcacattctagtcctccatcatggtccatgtacctatcaggctgatgacacaggacacagccttgctagtgagctcccttgtgttgtgggcacctaactcttacaaatggcagaggagtataaagctggagtgtggcaaagagggtcccatccaagtggagcaactgggtcaaagcaaggacgcatgggtagtgatccagaggcccccatcttaccacctccccctcctgatggtgcatgaggcaggatacaggtggctcagagaggcaaggagacccctagccagaccttggtttgcattcttgtcccagggaaggtggttagtcatcttgtaaccctcctgccctcttgtctcctcgttagcaccagcacagtggccgacgcctaccggttcatcaaccacactgtgggcaataagaccaaggtagaggaaggctactactatctcaacaactttgacaacatcctcaacagcttcggtgagtgagtcctagagggtattcccggccttagtccggctcagagttgctgtaaggcctccctccttccctggctccttgggagcccttcctggggtccttcttttttttttttttttctttaaagtttattttatgtatatgagcacattcttgctcccttcagacctgccagaagagggcatcagatcccatcacagatggttgtgagccaccatgtggttgctgggaattgaacctttggaagagcagtcagtgctcttaaccactgagccatctcttcagccccactgggggtcccttctacagcaatgctgtgcgattgtagggcaggcagatccaggcttgcctaggcaccagacctcacagtgacagagagataagaggcccttgctggagggctgctgtgtcagcatggcatggtgtgcctcagtgccagcaggggttatagggcagggatgctgccatttcaa

SEQ ID NO: 686 - DNA, 1270 bp, Mus musculus
cggcggcaactgcgggctgagctacgctgtgcagacccagtgcacagtgcgggatcccgggacggcgcgtaccttagaagatgcctctgatggaacaggctctgggaagcttccccggccccgtggctttgaacaggagctcaagccggaggcagtttaaagccctggccgttgtatcctgaggaccgcaggtcaggagaagatggctgtaagtttagatgacgatgtgccgctcatcctgaccttggacgaggctgagagtgctccgctgcctccttcgaacagcctgggccaagagcagctgcccagcaaaaatgggggcagccacagcatccacaactcccaggtccccagtctggtctccggagcggacagccccccctccagtcccaccggacacaactgggagatgaattatcaagaggcggcaatctacctccaggaaggtcagaacaacgacaagttcttcacccaccccaaggatgccagagcgctggcggcctacctcttcgtccacaaccacttcttctacatgatggagctgctcacggccctgctcctgctgctgctgtcgctgtgcgagtcccccgctgtccccgtgctcaagctgcacacttacgtccacgccacgctggaactctttgccctcatggtggtggtatttgaactctgcatgaaattgcggtggctgggcttccacacgttcgtccggcacaaacgtaccatggtcaagacgtccgtcctcgtggtgcagttcatcgaggccattgtggtgctggttcggcagacgtcccacgtgcgggtgacccgggcactacgctgcattttcctggtggactgtcgctactgtggcggtgtacggcgcaacctgcggcagatcttccagtctctcccacccttcatggacatcctcctgttgctgctcttctttatgatcatctttgccatcctcggtttctacttattctccacaaatccttccgacccctacttcagcaccctggagaacagcatcgtcaacctgttcgttctcctgaccacagccaactttccagatgtcatgatgccctcctactcccggaacccctggtcctgcgtcttcttcattgtatacctctccattgagctgtacttcatcatgaacctgctcctggccgtggtgttcgacaccttcaacgacattgaaaagcacaagttcaagtctttgctgctgcacaaacggaccgccatccagcatgcctacggcctgcttgccagccaacgggtaggg

SEQ ID NO: 687 - protein, 370 aa, Mus musculus
SPGRCILRTAGQEKMAVSLDDDVPLILTLDEAESAPLPPSNSLGQEQLPSKNGGSHSIHNSQVPSLVSGADSPPSSPTGHNWEMNYQEAAIYLQEGQNNDKFFTHPKDARALAAYLFVHNHFFYMMELLTALLLLLLSLCESPAVPVLKLHTYVHATLELFALMVVVFELCMKLRWLGFHTFVRHKRTMVKTSVLVVQFIEAIVVLVRQTSHVRVTRALRCIFLVDCRYCGGVRRNLRQIFQSLPPFMDILLLLLFFMIIFAILGFYLFSTNPSDPYFSTLENSIVNLFVLLTTANFPDVMMPSYSRNPWSCVFFIVYLSIELYFIMNLLLAVVFDTFNDIEKHKFKSLLLHKRTAIQHAYGLLASQRVG

SEQ ID NO: 688 - DNA, 97247 bp, Homo sapiens
  misc_feature (1)...(97247): n = A,T,C or G
gcagaatgtattcaatatcaggccaggtatcatggttcacgcccgtaatcccaacactttgggaggctgaggcaggaggatttgttgagcccaggagtttgaggatgcagtgagctatgatcaggccactgcattccagcctgagcaacagagtgagatcttgtctcttaaaaaaacaaaaaaacaaaaaacaaaccagaagcccctttgggagcagaggattgggaattatcttcaatcactttgattcacacacacttcctgctccctaatgaatctcatgagatcctttgaggcttttcctgaagacaaagttttaggaggctgggcatggtggctcacagctgcaatccaagcactttgggaggccaaggagggaagattccttgagcccaggagttcaagatcagcatgggcaacaaaatgagacctctacaaaaagttaaaaaaaaaattagcctgtcatggtggcaggtgcctgtagtccccgctatttggggagctgaggcaggaggattgcttgagccagggaggttgaggctacagtgagccatgatcgcaccactgcactccagcctgggtgacagagcgagatcctatctctcctcttttttttttttttttttaagctggagttttgctgttgtcacccaggctggagtgcaatggtgtgatttgggctcactgcaacctctgcctcccaggtacaagcagtctcctgtctcagcctcccaagtagctgggattacaggcgtgcaccaccacgctagcctaattttgtatttttaatagagacagggtttcatcatgttggccagtctggtctcaaactcctgacctcaggtgatctgcccaccttggcctcccaaagtggtgggattacaggcgtgagccaccatgcccagcctagatcctatcttgtaagtgaaaaaaaagttttagggacagccatggagatttctcaggctctctgaggatgaaggatctttgcccatggctacaggatgaatgtgaacaaggtagttaatgaatgcagtcctctccattgtaccccaaagctctcaggcataaatcaaaatgcctgaattcttcagagagtgcggctggaaacgcaacgttacatgaaatgtttccaatttgctttcagccaaattacctcttttgctttaaagggcaaacttgttttctttgattatgatgacacccatcatttcttgacagctcatttgggtgaacaagataaagcccgtggaactaggattgaggggaaatgcatctgactctgacgacaaaaatgactggagaatctcttttccttgaatcctaatatgatcatttcatgtcctttttaatgccaccaaccttaatatttaaatcatttccaacttaagcatctccgtttaaaattcctgccctgagagtgaagcaaattgttaatggatgggaaactttaattggatattccctttatttgtcattaattctgctgatgaactttataaatggaaatatatctttatcatgcaaattatacctcgtcttcattcaaacaggcttgttggatattttattaattttgctcttagaatattttgaggaaaaaaaagatttgaactaaattatatattttttccccctggagagaaggaaaaaacccaacacttaacaactaccctacaaatccaaactggcaagtggaaaagtcagagggtgctaaaaaaaaaaaaaaaaaaaaaaaaaaaccaaaacaactggagtgtgggaaatggatttctctctctctttttaaattcactcttaatttaggttcgggttacatgtgcaggtttgttatataggtaaatttcatgtcatgggggtttggtgtacagattatttcatcacccaggtaataagcatagtacctgataggtagtttttccatcctcatccggatctcattttaaggaataccattttaacattagctaagtaagttcttgagaacttactgtgtagcagacactgttctgaatgctatatacgaattaattcctttaatccttgcaacaaccctatgaggtaggtgctattattacctctatttcacagatgaagaaagggagacagagagagaggttagatgattctagttagtttacagctaggaagtgacagggcctgcaccccatcagcactattctgtccagtctcttgattttaagattgacttctggccgggcgcagtggcccacgcctgtaatgccaccactttgggaggctaaggcaggttgatcacttgaggtcaggagtttgagaccaacctggccaacatggtgaaaccctgtccctactaaaaatacaaaaattagctgggcatggtggtgggcacctgtggaggctgaggcgggagaattgcttgaacctgggaggtggaggttgcagtgagccgagattgcagcactgcactccagcctgggtgacacagtgagactctgtctcaaaaaaaacaaaaacaaaaaacaaaaaaaccaaggtcttgctatgttgcccaggctggtcttgaactcctgggctcaagaggaattttctttttagcctcagaaagatctcactaccctccaaacctctagctttcttccgaactctgtatgttttatctgaggctttcaagtctagggagggggaaagtgaggggctagaaagaagcaacagattcatgatgaaacctgctatcccaaccaactactatacagtaggtgctcaataaagaaatcactgttgcggttgggctcagtggctcacacctgtaattccagcactgtgggaggccgaggcaggtggatcacctgaggtcaggagtttgagaccagcctgggcaatatggcgaaacatctctactaaaaatacaaaaattagccgggtgtggtgaaacatgcctgtaatcccaactacttgggaggctgaggcaggagaatcacttgaaccagggaaatggaagttgcagtgagctgagatcgcaccactgcacactccagcctgggtgacagcgtgagactccgtctcaaaaaaaaaaaaaaaaaaaaagagaaaaaaagagaaaagaaaaagaaatcactgttgaataaatgagatggcaaacccagatttaccaacaggcttgtctcctcactgggagatgctggcataataggataatgttgttttgcaaaatatatatgtcctgaattggagccagaaaagagagtcatattttcatgatagaactgtaggccaacaattggcctatgaattcttttgcatccctttactcagggcttggaattttttaaacaaaagttttaaatgtaatgaattttttactttttcatagttgagtggttttttttttctttctgtgactaattttgaactattacccaatcctcctctcttgttctttttgagaacctgtgttttatggtttacaactggtctgtaaaagattcccaggctagggctgcagcaatgaatgctggaggtattgacagttgggaccctgtttgtaatgctggctgggtggctgcaggctccaggattatctggtgctttggagacagaggacatgggatagtgactcagattgggagggaacatgccccccgggacagatttctatgttgctggttatgatgaaatactttccactgaccacaagctatatagccttgggcaagtccacttgatcttctgggctttcatttcctcattactgaagtggaaacgaaaaacacatttggaatgcaattccagtgtctcaccacttcctggctgtgtggctttgggtaagtcgattaacctctctaagccttgacgttctacctgtgaaatgggacacagcactgttgagggaatgaaatgaaatccttgctcaaaagtgttacgcttttatgacttttagtactacttcaaaaattatgttaatatcaacactttaatgtttcttaaaatagatgtgcttttccacaaaataatatggtatatgtttttgtatcaaaggctttataaaaagtcaaaacagaagcagtttttactcctttttactattttgtttttaattttgctggtttctgcattattcatgttctcctgttagtgaccgaagaagaccaagttcccttaaatcactccccattgtccagtctcccctccttatcaatcagttcatcaggaattttaattcctcttttggttacagtgtcactttagaaatgcttatttctggttatatctaagtgtagacagcatcactttggcagtttcagacagaaggaagaatttcctagtagtgaatttagattattctataatcaacttctccaacttgaaaaaaatatttaactactacacacctattagaatggacaaaatctagaacaccgacaactccaaatgctggtgaggatgtgaagcagaaactctgtcattgctggtgggaatgcaacatggtgcggccacttgggaagacagttgttttcttacaaatttaaacctgctcttactgtacgatccagtaattgcactccttggtgtttacccaaaggagttgaaaactcatgtgcacacaaaaacctgcacacacaaaaagcttatggatatttatagcagcttcattcacaactgccaaaatttggaagcaaccaagatgtccttcaggagctgagtagataaacagtggggcatcccgacaatggaatacaggattattcagtgttaaaaagaaatgagctgtcaagccacgaaaagacatggaagaaacttaaatgcatatcactaagtgaaagaagccaatctgaagaagctgcatatggtatcactccaactatatgacattctggcaaaggcaaaactatggagatagtaaaaagatcagtgttgtctaagggctgggggaagggagggatgaataggcagaacagggaggatttttagggcagtgaaaatactatgtaccttactacaatgatggataccatcattatacatttgtccaaattcacagaatgtacaacaccaagcgtgaacccttatcccttatgtaaactatggaatttggatgctgctgctgatgtgtcaatgtaggttcatcaactgtaacaaatgcaccactctggtgggggaggttgacggtggggcaggctgtgcatgtgggaatagggggtatgtaggaactctctctacctttctctcaattttgctgtgaatctaaaactgcttaaaaaataaaatcttaaggttgtaaccctttactgggcagtgaaatcagtttgccaactgggactagagttaaaattaaacgaaacagggttgggtgcggtggctcactcctgtaatctttgggattacaggactttgggagcactttgggaggccgaggtgggtggatcacctgaggtcaagagttcgagaccaagcctggctatcatggtgaaacccagtctctactaaaaatacagaaattagcagcgcatggtgttgggcacctgtaattccagctacctggtaggctgaggcaggagaatcgcttgaacccaagaggcgtaggttgcagtgagctgagattgcaccactgcactccagcctgggcaacagagaaaggctctgtctcaaaaaaacaaaacaaaaaacagcctatctcaaacccgtcctgctctcaggcactaatgtataatgttccttttgtcagaaaccaaccccccaggaataatttctccctagattaacaatttctcattctttaggtcttagctcaatggctacccctcctcagactggaacagacagcactttacaacctgtggaaactctctcacctttcctgcatagtactaatcacacgtgtaatttttttttttttacagctctattgaggtataatttacattaccataaaattcacccattgtaagtgtaaaactcagtgactatttttgtaaatgtatctgaagttgccacatcactacaatccagttttagaacatttctatcactccccccaaattcccatgagctaatctgcaaacaatctctgcttccactcacattttttgttgtggttgttttgtttttgaaactgagtctcgctctgtcgcccaggctggagtgcagtggcgtaatctcggctcactgcaacctccacccccctggttcaagcaattctcgtgcctcagcctcccaagtagctgggattacaggtgcgtgttaccacgcttggctaatttttacgtttttaggagagacagggtttcagcatgttgcccaggctggtcttgaactcccgggctcaagtaatccaccttccttggcctcccaaagtgctggaattgcaagcgtgagccactgcccctggcctccactcatatgtaactttcctggatagttcatataaatgggatcatgcagtatgtaattgtttgcatctgactttttgcttagcacagtggttttcaacctggggcaactttgccctccagaagacatttggcaataatcgggagatgcatttgcttgtcacaactgagagaggctactactggcatcttgtaggtagaggctcgtaatattgctaaatatcctacaattggcaggatagttccccacaacaaagaattttctcacccaaaacatcaatagagctgaggttgaaaaaccctgaccttttttttttttttttgagatggagttttgctctcgtttcccaggctggagtgccatggcgtgatctcggctcactgcaacctctgcctcctgggttcaagcgattctcctgcctcagcctcccaagtagctgggattacaggcatgcgccaccacgcgcagctaattttttttttttgtatttttagtagagacggggtttctccatgttggtcaggctggtctcaaattccctacctcaggtgatctgcctgccttggcctcccaaagtgctgggatttacaggcgtgagccaccgtgcccggctgccttttttttttaatagacagggtcttactctgtcacgcaggctagagtgcagcagtgcaaccatggattactgtagccttgacctccccaggctcaggtgatcctcccacctcagccttctgaatagttgggactacaggtgcataccaccatgcctggctaatttttgtattttttgtagagatagggtctcactttgttaccaggctcctaggctcaaactcctaggctcaaactaggatcctcctgccttggcctcccaaattgctgggattacaggcgtgagccactgggccaaaaaccctcaacttaacatgtttttgaggttcatccaggttgtagcaattattagtatttcattcctgaatagtattttattgctgaatagtattccattctaaggaaatatcatgagttatttatttattcacctgttgatgacatttgggttgtttccagttttgggctgttaagggtgatgttgctaagaacatttatatttaagtctttgtgtggacttatgttttcacttgggaggggtaacttcctaagagtggaattgctaggttatgtgtaagtttattttttgttttatttatttatttttgagacagggtctcactctgtcacatagactggagtgcagtggcacgatctcggctcactgcaacctccgcctcctgggttcaggtgattctcctgcctcagcctcccaaatggctgggattacagggacccgccagcatgccctgctaatttttgtatttttagtagagacggggttttgctatgttggccaggctggtctcgaactcctgacctcaggtgatccacctgcctgtgcctcctacagtgctgggattacaggcacgagccactgtgcctggcctatgtttaactttttaagaaactgccaactatatttcagattggtggtaccaattggtattctgctgtacctaccggcaacatatgaaagctacagtttgtttatttatctacatgatgatacttggtattgtctttttgatttttaaatgtctactcaactcttttgcccattaaaaaaattgagttgtcctcttattgagttataagagttatttttatattctatatacaactcttttatgacacatgatttgcaaatatttcctccatgtctgtgtctgtggctgatcttttcattttcttatgaaaatatcttttgaacctcaaagttttttttttatatatttttttgagacagggtttttcgctctgtcgcccaggctggagtgcagtagtgcaatcatggctcaccgcaacctccgcctcttgcgatcaagcaattctcccacctcagccttatttatttatttatttatttatttattttttgagctggagtctcgctctatcacccagactggagtgcagtggcacgatctcggctcgctgcaacctccaccacccgggttcaagaaattctcccgctcagcctcctgagtagctgggatcacaggcacacgccaccaggcccggctaatttttgtatttttagtagagacagggtttcaccatgttggccaggctagtcgcaaactcctggcctcaggtgatctgctggcccaggtgatctgctggcctcggcctcccaaagtgctgggattacaggctgagccaccgcgcccggcccttagcctcatttaatcatcacaagaaactctctgtcttcagtaggtacaatgagatcacatcttaaggatggagatgggagttaaattccaaagttaggataaaggcaaaagtggtgtaataaaaattacctaatttatttatttatttgagacagagtcttgctctgttgcccgggctggagtgcaatggcgctatcttggcttactgcaacctaagtctcccgggttcaagtgattctcgtgccttagcctcccgagtagttgggattacaggtgcgcctccatgctcagctaatttttgtattttcagtagagatggggtttcaccatactggctaggctggcctagaactcctgacctcaagtgatctgcccgcctcggcctcccaaagtgctgggattacaggcgtgagccaccatgctcggcaaaaacaacaacaacaacaacaaaacaaacaaacaaaactacctaatttaaacactgaagtgagattgcctgctcaccgaggaacgtatggccgttgggtgaaatgggaggggacttataaactcccctcccacccacagctcccatgtttgacttgaaataagttaactacgatatgactctgcttgactgttgtcctcctcgttttagggatgagggagtggagccatgaagtgggcaggtagaagggcagaatggaggccggctccctgcaggttgtggagcgaaaggtccagactaaggcaggagctgagggacagggtcctgaagctgagacgagatcgcagcgggggcttctaattcctcagggagccaaaggacagagggctgaaccctattccacatctcccccgatccgcgaccctttcccaactggctactcacctgctctgaccgctccaggtttccctagccacagttaccgccgcggtccctgcgttgctaggttacccgccaatctcagaaggcgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgagtaaggcggggaacaagggaggagtaaggggcgtggattcttcgtcccgccccttcttaaggaggcgggcagggagtaccgcatcggcggcgggcgagacctgcggaaggacgtgatagttggccaatcagagttcatcacggtagcccagttagccagtaggacgctgtgaaggggaaatggggcggggccagcggggttgagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtgtaagaatccgagggatgcgacggcttggcccgagggagagggcagggatcaggggtcagaggacgcggagtaaggggttgcggcgcagcactctggtgtgggaggtgggccgtacgggcccagagggggcgcagggaagtctccaccgcgcttctctccgtccagcccgggccggggctttgcaccctctctcctcgcccccgacttcttagggcgaccctcacgtgggctcccagccaggggctgggagcacgtggagctggagccagctgtcctgcctccttcttcctccctccctcgctcttctccctggcgcccttaggtgaccccacaggagtcttgtgcctgggtcaggctgccccagcggacagcgggatggtagctgaacctcttcccctaggccctttccccagcgctggccagttgggtcctctgtagaggcagaagcaaagcccgcggagggaacactggaccaggacgcaggagtcccgggttctagccctactcctccactgtgtgaccttgggcaagtctcttcccctctctgggcctcatttttgtctgtctggaaaaatgacgtgtttgaattcaaatcaggggactggttctagtcgtaggtgtatatagggtaatggttaagcaggcagggtccctgattcagactgcctgggttgaaacttataaaaggcaagttaaccactccaagcttcaatttcctcattcctaaagtggggatattagctaagataggatttttcaacagcagctcagttgacattttgagccacataattctgtttcgggaggtctcacctgtgcattgaagcaagttcagtggcatacctggactccacccaccagcaatccccccactcccaagttgtgacagtcaagatgtctccagacattgccgatgtccccatgggggcaaaaatcaccccagttgaaagccagtgggcaaaggcagtacaggcaggcaagcagtcatatattaaacagttaaacaaccgtgttgaagcatttgaatgcgaggactttaatctatggtggcagatatcatgaaaattatgcatgaacaacccccctgcctctttttttttagctcatcattaatggtagtgtattttatgtgtggcccaagatagttcttccagcgtggcccagggaagccaaaaggttggacagccgtgagttaaaacatagaaaccactagccattatgataatggtaacattaagaaacctcttctctgtgagttaataaattctcctgccttcaaagtaaacatgggagataattgtcaaagctgagtaatggatacaaggaagttcacgtatatattctctgcacttttgagaatgtttgaaaatatctgtggtaaaaagttaaaccaaaacgacaatacaaccataattcttaagactgccaaatagtagtgtctcatctgggatttcctcttctgcctttccactgctgagatttaaaagcaaaataaatccccagatctggaggaaacttaagaaaaaaaaactcacaggaagtgtgctgggcagagagctacgggcttagcagcaagtagaatgatgtttactttcgctgccttgtttcaaaacgttgtactgttccctgtggatgcacaaggatttgcttggagttgttccaatgattcgaggaagaagtcagttgctcagctgccattgactaggtcagttgggaggcaaagtgggttgagcccagagcccacagcttgaggaaggaacctgctgctgtttgcaagttcaaaggtctgcagtcagatctgctgagtctttttttttttttttttggttcttctcagcggaaacgggaatgtgcataaataggagctgtaacaggctagctcggagtgttttacttatttagttatttttaaatttttagtttatttattttttgagatggagtctcgctctgtcgcccaggctggagtgtagtggcgtgatctcagttcactgcaacctctgcctcctgggttcaagtgattctcctgcttcaggctccccagtagctgggattacaggcatgcaccaccacacctggctaatttttgtatttttagtagagaccaggtttcgccatgttggccaggctggtctcaaactcctgacctcaagcgatccacctgcctcggcctctcaaaatgttgggattacaggcatgagccaccactcccggctgctctgagtgttttaaattgggagttaaggatgagcacttttactgtattaaaaaatactcaccagttaaaaaaaaatactcttttccccttcctcggacacctaaatctaagagaacaactcctatataaaaatgatataaaaatcatacattttggaagtatgtttctaactgttctgagaggctgcatggtaaagctgaagtgaaagatgtattttaaatctgtatatatgagcaagtatatattgatgattgaagctaggtgctgcctaaatacatggcccagactttgaggaattatagtgtaatggctgggaatacaggtttggagtcacaccgtagagctgaaagcttggcttttatttagctgtgggtccttgggcaggatacgtaatctgtctgtgcctgaaatacccaccacacccatcctgtaatggggggataataagcctgcctatctcatggggctattaagaattttcagttaacttttacttatgaagtgctagtagggtccctcatacatagtacgcactcattgagtattaactattattattattactattttgagacgagtctcgctctgtcgcccaggctggagtgcagtggtgcaatctcggctcactgcaagctccgcctcccgggttcacgcctttctcctgcctcaacctcctgagcagctgggactacaggcgtctgccaccacgcccggctaattttttgtatttttagtagagacggggtttcaccatgttagccaggatggtcttgatctcctgacctcgtgatccgcccgcctcggcctcccaaagtgctgggattacaggcatgagccaccgcgcctggccgcatattaactattattttaatggttgtatttttttgtcatttaatttaattaaattaatttatttatttatttgaggtggaatctggctctgtcgcccaggctgcagtgcagtgcaccatctcggctcactgcaacctctgcctcctgggttcaagtgattctcctgcctcagcctacagagtagctgggattacaggcgcaacgaccacacccagctaatttttgtatctttaatagaggcggggtttcttcattttggccaggctggtcttgaactcctgagctcaagtgatccacccgtctctgcctcccaaagtgctgggattacagttgtaagccaccgtgcccagccttttattttactttattttttagagacagggtctcactctgttgtccaggctggactgcagtggtgtgatcatagctcactataacctccaactcctgggatcaagtgtttccgtcacctcagcctcccaagcagctaggcctacaggcatatgccatcatacccagctaatttaaaattttttattttgtagagatggagtcttgctacattgcccaggctggtcttgaactgctaggctcaagcagttctcccaccttgacctcccaaagcgctgagattacaggtgggagccactgtgcccagcctatttttttctttgaagtctttacaaaacttacaaataaatgtaaagagaagtggaggtaggacatattggccctaatgtcactctccagacagaattacccttaacttttcagtatttgttcttgcagggttccctccctccgtattttaatgctattatactgtaataatgcttttattctgtttttatttatttatttatctttattttatttttttgagacagagtctcgccctgtcacccaggctggatggctctatctcggttcactgcaacctctgccttccgggttcaagcgattctcctgcctcagcttcttgagtagctgggattaccggcacgtgccaccccgcccagctaattttttgaatttttggtagagatgggttttcaccatgttggccaggctgctctcaaactcctgacctcaggatccgcccgcctcggcctcccaaagtgctgggattacaggtgtcagccactgtgcccggcctaattcttttattttttaagagacaggatttcactctgttgcccaagccagagtgcagtggtgcagtcatagctcactgtagccttgaactcctgggctcaagtgagccttctgagtagctgggactacaggtgtgccacctgcccagctaattttatttatttatttatttttgtatgttaaatatttattttatttttttctgtgtgtatgcttacccaaccagctttttttttttttaattttttatagagacaaggtcttgctatattgcccaggctgatctcaaattcctggccttaattgatcttcccaccacagccttccaaaatgctggggttacagatgtgagccaccccaccggccaatttttttaaaaattgagttttaatttaccattttattattttttaaattaagatataatttaccattttattatttattttgagacaaggtctctgtcacttaagctggagtgcagtggcatgatctctgctcactgcagcttccacctcctgggtttaagcaattctcatgcctcagttacccgagtacctgggattacaggcacctaccaccaagcccagctaattttctgtatttttagtagagatggggttttgctatgttggccaggctggtcttgaactcctggctcaagtgacccacccaccttggcctcccaaagtgctgggattataggtgtgagccaccgcgcctggccctagttcaccattttaaagagtatacttgagtggtttttattcacgaggttgtgcaaccatcaccactatctaatttcagaatagattcatcagtcatggctgtattttaataattatcttttatttttttaattcccaaaccctagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaagtaagatggtggggtgggctggggggaccccagcttttctgtttcagaggctgagaggtgataagcgctttgtggtctgatagtaggggtgtgtaacttgttgcctggccccacatttgagccccaagttctgatacagaaactactcctgggaggctgtgtgtttctccttccacacccccagcttggcagtgtttctgggggcctagctgcccctcttggtgccctcgctaccttctccactgcctgccttgcacctgaggtaccttggcctgcctgtggatgcttggtggggacctcaggccaacctactttggctgccttccctgccccattccttgttaaaaaaagaaacagatttcaacaccagcctccgtctgtccccatctgaaaccgttggcaggaaagcagcactgcccgcgtctctttgctccatctcagtcccttcttgcccaggacagcggggaagagggcgagtgttttgtcatgatccattgatttgagggcttggggttttgctttgtcttcctctgaaccaaagcctagcacaaagtgaacccaagtgcggcaaggagctttaaattttttaaattttaagtgtgtttctggcagaatgagaggccttgaaaacctttctggttctcatcccgaagccatttgtttcagttgctcaggccttgggctcaggagaggcttaaaataactcgccttttctggagggtcctaagacatcaggaagcagtgctttagggtctgcttagcaaatggatgttccaccgtctcccagtgctccccagtcagggcagagatgtttggggccaaggagagacgagccaggctctcccgtctcatttgtccagggagaattcagttgagttgcagggagtttggtggcctcccctgggaactgatgaaggagagcagtgtttccagggatgtgagtgtggtggggagccctggctgcctagaaacaggcctctctttgcttcactgtgttcaccctcatctagggtggcagagctggattgcccagaaggattcgaacataaacttgatttttccccaagtgccactcagggatgagaaagcagtggctctgatttcagactatctgttttctttctgaaatccctttgcaaggctaggcagtattatccctatttacagaggaggaaactatgggtcagagaggtcaagtaacttgtctgaagtcacacagccaggaaatggttgagcagagatttgaacccagcatcatctgactccagaattccttccccttctcctcttccttcttttacttcttcagctgctcctccctctccttttttcttcatcacccttaataaatgtgagcacaggccaggcgtggtggcccccacctttaatcacagcactttgggaggccaaggcaggaagatcacttgagcccagtgactttgagttcaagaccaacctgggcaacatagcgagacctcggctgtacaaaaaaattaaaaacttagctgggtatggtggtgcatgcctgtagtcccagctactcaggaggctgaggtgggaggattgcttgagcccaggaaggttgcagtgggctatgactgcaccactgcactccagcctgggcaacagagcaagaccctgtctcaaaaaaataaaaggtgagtacagacctttagcatttatattatctcctcatataacctcaatatagggttgttattattatctgtattttacagaggaggagacaggctcagagaggttaagtgacttgtccaaggtcacacagctagtaagcagtaaagcctgtctttcctcccacaccacagtggaaggcgctttggggaaagggatgaaagtgattgtggctcagtttcagctttagagaggaatgctgcctagtgagggagggtggttggcctactaagggtgtggcttgtgtctggaaatagccaggcttaagattctaaatgggaatcctggctgtcatcgtgagtgtcacttttaagtccctccaacgtgcctgacctgatggtggggtgtccagctttcctgtgggatgaaaggggcaagagagcaacccagtcctgtgtcaagatcaggctttgaatgttgatgaataggaaataggccagagacacaataagactccccttggctaggccactagcaaggctgcttttatcttggcaaagtcagtggcttgctttggtttgtttctcaagaataaagaaatgtataactaactgctggggtccagggacattgtttttcctgtacagcacattagtatcttagtttcttctctcagcttcttactgggtcattttttaaaacctcaatgacttgtgggtgtaattcaccaagcctggctgggaagaagggtaggacctgtgcaagtaaacaagagttttcagaggaggcctgctctgccttagcatagtaggcctttgatatttcatgcttggattttggccttgaccttctaccccagcgtccccctgtccctgctgtctgaggagcagtccttcagtccttttttttgagacagtctcgttctgctacccaggctagagtgcagtggcacaatctcggctcattgcaacctccgcctcccgtgttcaagcaattctcctgcctcagcctcccaagtagctgggattacaggcgtgagccactacacccagctaatttttttgtatttttagtggagacgggggttttaccatgttggccaggctggtctcgaactgttggcctcaagtgatccacctgcctcggcctcccaaagtgctaggattataggcgtgagccaccacacccggccctgagcagtccatctaaaacacaagcccaacctggttgttgccttgttttaaagcttcctgggactttcccatccctctatgggggttggggagggcaagctcttcagctggcaacgaagccttgcgtgttctagtgccttcttgcttgaccagtcccatttcctgcctcagtccacagcatcatactgcatttagttcggtgaatcccctgtgcattcttaaacctttccaccttgctggcaagtcagtctagaatccctttctcagcctcttgtttgctcgtggcctccagttctgtcttgaaaatcctgctgataacaccatctctttgaagccttcactgaacttccccttcctgacagagctaattactcactacccttttctgcttcggtatcttgattaggcttccattattacaagtagattatagtggggtaattacacatttaaccatctgatcacctactaggccctgagatccattcatctttttttttttttttttttttttgaggtggagtatcactctgtcacccaggctggagtgcagtggcaccatctcagttcactgcaacctccacctcccaggttcaagtgatcctcccacctcagcagctgagactacaggcatgtgtcaccacgcccagctaattttttgtattttcagtagagcctctttccttggctcccaaatggttacctttttgctgtgtccccacgtgattgtccctgagtctgtgtgtctgtcctcttctgataaagacaccagtcctattggattagagctcatccatatgaccttgttttatcttagtcacctttaaaggccctttctccaaacacagtcacattctttcaccatgttggccaggctgatctcaaattcctgacctcgagtgatctatccgccttggcctcctgaagcgctgggattacaggcatgagccaccatgcctggcccatccatttgtctttgtatcacatagctcagtgcccacaatatgcaggtactcaacaaatagtggtcagaatcaacgtacttggatttctggggcctcgcagcccatgggagtggcagtgtaagggcccgagttagaggtgggcagcctccctcctgccgcctctcctcaccattgctttgagtcccattgctctcagcacagctgagtgtcctggtggctgccatcactgacctttgtctttggttgctgtaaacctttgaagtactaaggagttggcagaatgcagatgcaggccatccgcggagttggcaacgacatgagcatgggctactgggaacgaagcaagctttctaaggctgagtcaccatcaagcctggcctttgttttggcccagcagccgctgaggccttctcagcactgtacctccacgctccatgtctggttgggcacccctaacaaaacaccatggactggtggcttaaatgacagaaatctaatttctcacaggtctggaggctggaagtccaagaccaaggtgtcagcaggtttggtttcttgcgaagcctctttccttggctcgcaaatggttatcttcttgctgtgtccccacatgattgtccctgagtctgtgtgtctgtcctcttcagataaggacaccagtcctattggattagggctcatccatatgaccttgttttaccttaatcacctttaaaggccctttctccaaagacagtcacattctgagctactgggggttaggacttcagcctatgaatttgagggggacacagttcaggccatcacactcctacccattcttcagaggcagggactgaggaatctggctgtgctgcctgtgacctttaaccctatgtgagggccttatccctgcaggaaactggagggtttgggtttttctccttatatgggcaattgtggatttaatccaagactcagacatctttgggctctaagtgcggctgctgcagtgctaatgaatgactcacaggcagcatggtgtcaggttgataaaggaggcaggtatgagcagaggtatttaaagcctggaaactaggaataaccttgaaaacagtcagcggggccactgttagagcagtgtagagacagaccacagtccacaccgcgtgacaggcggtggtctcacccaccacattcagggaatcaggacgagtctgaatgtagtgggcagtccaaggaatttcccagggtaactctggtcacactcagctctgccttctccctgcctttaaagccagctgctgcctaagatgggctggaccatgtgccttttctgagtgaaggaaggattgggctcgcgggggctggctgaggtctgagcaggatgctccgtctctgctttggtgccgggttgtttatggttttcaggtgacaggtcctgcagctaaggcccaaggtcacagcgcagagagctgacctctccctccttcacgccgatgcctggcacatcatctggagttccctaggacacagtgcagcctcagcaatgtggaggatccctgccccctggcaggggcccccatgtggcaccctggtccccttttcagggtcttcatgcagccagggcgagttggcaccaggctcagtcaaggtgggccagagctgttggccgcagggccgccgtagccaggaggagttgggagagatcctcgccggctggcaccagagaagaatacaccccgaggtgtgcgctccatcactgatgtctgtgccgtggctctgcctctgaccagatggccccagcatacttgccaaagagtgaagaagcccaaggggcttgcacagcttttgtcacttgtgataccatggtgagtggagtggttgagctgagtatagtgcttagctgctctaagcctcagcctgctcatctgtagaatgtgaccatgatggcatctaccagtagagtcgtcatgggggattgagtgagagcatgtgtgtgatcacatggtcagtgctcagccggtcataggcattattatcatggcagaaactgggcttccttggaatatcctccatgagcagaggtcctgaacccaggccacgattcagatccttcttgcctcactcctggcacagcaggtggcccctgccaagctgggacgcctccgtgtagcagctggagaccaagcagcaattagattttcacaggctcccaccgagcttgggcatttggctccgctggagtcattcccctggctttttcagggcctcaccaaggcagagcgtcgggtgtcaccagaccagcagtggtgccaattaaaatgagtaagcatccagcatgctgggcgagagccttgcagccgagccttggagctttcacttcctcagccctccacatcttcatgggggggatcctgtctgttgcctcaggccccctgccatgagatgccatctcttcccgtccccctttcccgcacacaagacgctgccgctctaaatggcagtcgtggcagctgggtgcaggctgaagcacctgccactctcctccccactcgcctgggggagggctgagttcacgtttcctctgagagcgcttcatgagccagaaccgtgaacttctcagcttccccatcggggaggcaatatgggagggcttggatggctcacagcagcgtgccgctgggggcatcaggttgcagtgccctctgcggggaggtttcaaatgacagcaaggtagcccaggaacaaacctggagtgacgtcaatcttgagacagcccccacgccgccttcctgctccaggagccctgggtggctctccattcttgcccttggctagagtgaatcctctggttcggacatcctctgactgtcacccttctccccgcagtcaggtatgcctggggagaggatgtgcctgggtcagggtatgtgcagtcataatcatggcctgtgggtgttgagccctcgccgtgtgtcaggcggtatccaaagcacttttgtgctgctatcatttggtcctccctcccagcagatttggggggccgttactttcaatatcatctcaaagaagaggaaacggaggctctcagaggttgaaacttatccaaggtcacaaagacactttgacttcctttgaacccatgtctagtgactccagaaccagtctcttacctagtatgcccccctccgtgaggtagagctctgtggaagaggtagcattttaggctgaatttctttgtttcccaaaaggaagttggtttctatctttatcctttttttaaattaaacttttatttcctccaaggcaattattctaaatggagttccatacctagagctccctttcatattgtaaaaatagcacaactgatggcgtttcatggtgaagctgtgttggatcatcccagagaagctccgagacagggcaagtgaacaccagaccacaaaggacagctacagtgtcaccatctgtggaaactaggcttttcccccatgcacgccttttcctgattcttcctctgcatagagacatttggctactttttccatcatggtggttagaacaagaaaatttgggcggaaaatgggagttctcaggagccaagatttgggcctgggaaaggaaggatgaagaggagcagtttggagcggggcatgaggttagactctcaaggccaggtgggcttgctgagggcagtgatcctctgaggttgttgactcccagtggcaggtgaccccttatcaggacttgcctggtagaagtccctggactgagccagataactaaattgggaccattggtgcttgtgttgccttttgtaccgggtaccctttacgccttgtttgctttttgttggagatatttatctccttgtaaaaagtgcagttctttccctaccccagtcatgaggctctggctcagaggaggtacaagattgtagcaaaaaatttgagagctgggccaccctggggcctgccggaccaggggcatactggggccagtgtgcactctctgaagggacaactgtgatttattctggctaatcattgtcgtgtaggatcacaggctgattgctagcacatttgccagtttttcaaaagaaattagaacctatatttttaatcaaaagtcttttgatttgtaaatagtggcaaccaattcatatatgtcttcaatgtatagtgaaatctggtcagtaggctgcccctgctctctctgacgtagaacataccgattcaccctttgttttctgttcagagcagactacttcaaattaaggaaaagagtacaaaaccaacaacaaactctccatggcccttgaggttatcttcctcttccagtggcttccagtgggaatcagaacaggtcaggcagtctcctctttgccactaaatgctttgcccaaagaaagaccagatttcatttggctttgggatcaaagctggggctggagggtggaggtgtcaagccaggccaggcaaagggagatttgaagccagagcaggtgggcgcatctcccaggaaaccctgcatcattctttcctggtgattctttccttctttgttatggttcacatgagtctatggagtgctcattctacattctccgttcttatcttcatcctatgcaactttagaccgctactgttttttaaaagtgatttgatttgggctgtaacctttttttattgttgttagctttgactttgaaatgtgtaataaagattcaagtgagcattagaagtttttttaaaagtagtggtttaaaaaaaaaaaaaagaaaaaagtgatttaatagctggtcttcttttttccttaaatcgtcactttcttgtcaactgaaaaactaagtcgagttactaaaatggccgcacatttaggacttagaacagctgccctggaagttagaagaagtgcgtcaagtatagttacagcttggtctggttggcagtgagatgagtatagaacatgctgcttttgtggtgtataactctagaagggtttaggggaggtggacatggcttcccaagaaggtggaagatgggggcaggaggagatggcgtgcttcctcttggtgaggggttggggtagcatccagattggctttagagatcggattaagcttgagtgtgctgagtgtctaaggagatgaacaggaagtgaaagattctcccagaagaaaggaataggggaggaaaggtatacatgtgctggagtgggtggcatctgagtcagagggttggggagaaaggttagatccaaatcttgagggtctccttgcctgcactcctagagccatactgaagaggagctggaccttcatcctggggtggcggaaaagccccgggcactttaagcaggggaatgaccattgtttttcagggtagtgtctgaacattcattcatgctgccctggcaagagcagttggcaatgatggcaagaccgggcagtgtggaggtggcccagggacacggggtgcctactgtgttttgcctgaactgtgttttaagaggctgcataaccaagcagttgctgtgcacgtacagcttggcatctgagtctcccaccccccggcaccccatgtttgttacctgcctggtgcctgtaggcatttgagtttgtagcccctggttgaattctgacggtacagccctttggctggacaccatgcagctcagccaggggagtagcagaagatcaactatggacaggtgtgacttaggaagaggtggagtttggggtgctggggagagggaccgaacatcccagggaggggaaatggcataggctgaagtaaggaggggggttgcagtgagtcgagattgtcactgcactccagcctgcctgggtgacagagcaagaccctgtctcaaaaagaaaaaaaaaaaaagaagtaggaactcttctgagacccacaccctggacggggccagagactagcatgctgggggcagattggatttgggtgtggttacatgcactctggggtcagacccactgagtttgaatccagccctgacttctcctgctgggactttgggcagatgatgtaacctctctaagctttgatttcctcatccgtaaaatgacactaatattagtattaccttttaggactgttctgaggtttatacaagatagcatgcctcacacaactagcacagtgcctggcttatacagaatgagcattgggtggatgtcagccattataattagggtcaggggtcagagcaggcatatctgttttacagagtgcctaaaatgctgatggcaggagtttggacctggttgagttgggcatgggagctgctaaatgtgtttgggccagaaagcaagtgatgacagagcatcttcctgctgacatcttgccagctcgggatgctgtctctagccaacttgataagccctgagcttagaaaccctggggtgggtcagccctgaataggggttacttttccctctggagattgagaggtggatggagaggaaactgccaggctattctgcagtagtaggagccggatttggcatttttctctctgtctccctgaccagtcactgaacttccccaggtcccagaagctcagctcagtagctcagttcctacttcttttttttttttcttgagttagagtcttgctctgttgcccaggctgcagtgcagtggcacagtctcggctcactgcaacctccgccttccgggttcaagcaattctagtgccccagcctccccagtagctgggattacaggtgtgcaccaccgcaccctgttaatttttttgtatttttagtagagacggggtttcaccacattggccaggctggtctcaaactcctgacctcaagtgatctgcccacctcggcctcccaaggtgctgggattacaggcgtgagccaccatgcctggccagtccctacttcttaagaggcactcaggaagcatctggacaatgctgaacagatgaggactttcataggctcacctggcctggggtctggcccaggagggtgctctttgatgagaaacatcccagcggtattgggcatggaggaagcagctagtgaaagaaaagcagagctgatgggaggaagatgtttgactgtgcccagccctgccacatatctcccactttgccctccctaatcccaccacacccagctcttaggatcagaaagtacgttgaagttccagggccactctcctgaataaaaagtgtggcttctgtttccggcagataagttcctgctttgttccagtgcactgacacagtcccctgaacaacccatcttgggttgatcaggaagttcttagtctgttcagatggcagcctacctctcattttatcatcctccttcacgataaagccctgatgttctgcctttcccacttagtggagaaacctatcctcatagccacacttccggtattgaggaattggcatcttggaatacagcttgggtatttggatgacaaattattaaaaatattctgatctctttgcccacatattttagctgtagaagcaagcagagagcatcatgttactgcagcagcagtgccgcttattttttttccttaaaaaacatgatttaggggtcctagttttggtggcttcctgcttcagcagcatttggaagacttgcagatatgtcctgtgagtgccacgtgggtgtgacccctgctccttggcctggcaacaatccagtagctgtatattagagtgtcctttttgctaccttaaatgaccaagtcttccccagagccattcttgctatctcttgctatccacctgcctcggcctcccaaagtgctgagattacaggcatgagccaccactcctggcccttcctgtttatttagctgaaggccttgagagccttccctaacctttgaggatagtggttgtgtttccacagtctctcattctccaggtatgctgtttatacctctttctctgctcttcacggcacagagacccactcgctccccagcaccgggatgtgatcgatttgatgattgaatcagagtttgctttgtgccatgatggattgtgagaaaatggagttttgatgaattaggtaatttaaaatacgggtgggagccaggcgcagtggttcaccctgtaatcttagcactttgggagaccaaggcgagaggatcacttgaggccaggaatttgagaccagcttggacaacatagtgagaccccatttctaaaaagaagttaaaaaaagttagccaggtgtggtggtgcacacctgtagtctcagctccttgagaggctgaggcatgaggattgcttgagcccaggagtctgagactgcagtgagccatgatcacactactgcactcgagcctgggcatagagtaagaccctgtctctagaaatacatatatacatatatatttcaaaataaaatataggtgggagggctaagtttggcaaagaatcctttcgtagtatgaataatacccattctgttcatccagcatcaagcagggttttgtgaatcctgctccccccagctagggcttacctggtttgtgagtttctttcttgtgtctccctgatgcctgtttgagatgactgggcagggcagggcaggaaggtagaggcctaacccagtgtaatgcctgggtgttaatggctgttgttttaggtgctgatgttttacacagctgtgcctctttctggtagtacaagttttgcaaaggcagggatcatgtctcttctacacatattctgggcacaataatagacataatagaagttgcatatctgggagtgagtcaccggtttccaaaaacatccagggtcccaggtgactgtcacagctaaaccagcccctggagccactggagggtgacaaggagactcattcacatgtgatcagaccagaagtagcccagcagggcatggcgttgctgcccctaggaacagcctactttttggatgtttgggtctctgcttccagcttcgaactccccaggagcccacacatgtccaatcccaaccttccttccatctaagcttccccgtcgccgccctaccatttgtagactgcctgtctctcttttttatctctctttttgttagattgggattttattatttttttttcctaattctttcagcacttgctgaaaaccagcttgggcagagcgacctgtgcttagtgctggctaatggcttggagctgctccaagctgccggctgcgctgcctttcacttgtgggtggtcgtcgacaagcatgatgtcttctctctgtgactctcgaggggcctctcttcttgcgggctcggctgttcacacttggctggcctgcctggttgtttggaattgcagtttttactgcacagcctcgagccagtctggtagcttcaacagggcgcagattttatgagtgctaaagtccactcagcctccagcctagttggcccatttgattttgttgcatgttgttttttgctatttcctcttggagaccagacgccgtccagagtgtatggggacacagaagtctataaatggaggtggcttgggagattcttaggctgtgatgaatgtgtgtctattgaggagtgatggtacctgctggtgtctacaacggttgaacattttctgagtgtcgcgcagtctgcaaaggatggggttgaatttctggcatcgtctcttgatagctgaacatccttgaatgaggagctgagcttgttttttcctaagttgcagtttcttcattgtaaaatcagtatatgattgtctacagtcagagtctcaacccatgagtaggtaattgaaggactttctgcattgaggatgtgaacctttcctccgttctcacattcttccggttcctcttaagggatgtgagttggtagtttgcattttctgaagtgttgtagcagttgagggacagtagttaacttccttgactaccattcctgttgtgttgcagggagaattaaaaatcaagcagctccatctcctgcccattcttttttttttttttttttggagacagagtctcactcttgcccaggctggagtgcagaggcacaatttcggctcactgcaacctcggcttcccaggttcaagtgattctcctgcctcagcttcccgagtagctgggattacaggcatctgccatcatgcctggctaatttttgtatttttgtagagatggggtttcaccatgttggccaggctggtcttgaacttctgacctcaggtgaactgctcaccttggtgagcctccctaagtgctgggataacaggcatgagccaccgctcctggccactcctgctcattctttagggtggcttcttgatttccattgtattttcctttattcacaatgctccttttgggctgccttccccaccaacagaaagggaaactgaagcaaaaggaagggaaggccgaaagcagtgcctggccattgactgcataggaattcagggccctggagaagtggcaggcctaggccatcaagctctctgtgggatgtagctgtcctccagctgtcacttccccaatgtgcccatgcttgcttcatggccgcctcacctcttgttactcttcttctgaacaaagccacctgcagcagcagcagcagcagatccaggtgctggggcgtggccagtgttcatggaagccgggtccagccagcccccaggtgtttctggttaaggactagagcggacttttgatctgtgctgagtggatgccatcagctgacacatcagtagccttcatgcagcttgagtctcaagccaaacttgttcttccgagcactggctttctgctgacctcttgcaggggaaccagagcgcaccagtgcacagtgaaaaatgcctttaatctccatttgctcttctccggctcccttccttgtccctgggtgtttcacaattagcatttcagatgcttccaagtgaatatggaacagatgttcgcacaggtgctgtactcttcactgggtaaacagtggcgtttgcgtgcctctgcgtgtgtgtgtgtgtgtgtgtgtgtgtgtgtgtgcgtgtgtgtgtatgagacagcaggaagcatagggcctttacaaatgttttttaaagcgtctaaaacactttacacatgacgggtactcaataaatactttgtgagtgagtgagcagtggcagggaaagccctttgtttcataataaacccagtggcatgggagcaggaagtacaattccaagttgggtcttgaaattcatggactaaagaagaagtcatgtcctgcctcaccaagaaattacccgtggacatctggcaaaccggggggcatgctgtagggacaagacacagttctccatctcaggaaggaggattagacaataaaaatgaccgtggcggcccctggcaatttaatctgcctcacgaatgtgagctggccacggctgtgctgggaaaaggaacttgcggttttgcccatgcagaatgtttgcagatgggttagggagttagccaggactgacctccttggctgtgtttttccaagtagcacacctgatcaggttgctccacaccattagtccccagtggctcaagtccaggccctcagcatggctttccgcctggcctacacccccagccttgcggaaacagtggagggaaaggtgagggcttggctgcccgtcgtttcctccctctgtgaccttgggcaagtcactcagcttctctgggccttagtttcaccctctgtaaactggggataataatcaagtcttgtttgtagggcctttgtacacttagaagaattaattaacgtaaagccctttcaaccgtgtctggtgtgtggtaagtactgaatgcgaatcgtggctgttacctttgcccactgcgtcatcctggtcactggtctctggcactttaagcttcagaattacagaaccctctgcagtttctcagacgtgccctgctgttgaagtctctgtgctctctgaatgactatccttgtttctagaatgtgccactcaccccatccccatccaccctgtgaatacctcctcatccctcatgcttgaaatgccagccctggcattcccctgagttcctccctgccactggccaccagcccccacggagggcccttgtcatcccagcccattttagatctcagtgcaccagagtcacgatccttcattacctactgatggagagttccatgagggcgagggccatggtttcaccttttctaatccaacacctagcacaatgcctggtatacagtaagtgctgaataaatgtctcctcaaattaaaccatatgtgtttgcatgtaggtggtcagtcttttaaaactacatctggccgggtgcggtgcctcacacctgtaatcccagcattttgggaggctgaggtgggtggatcacttgatgtcagaagttcaagaccagcctagccaacatggtgaaaccccatctctactaaaaatacaaaaattagccaggcctgatggcgggcgcctgtattcccagctatttgggagactgaggcacaagaatcacttgaacccgggagatggaggttgcagtgagccaagatcgtgccattgcactttagcctggatgacagagtgggaccctgtctcaaaaaaaaaaaaatactacatcctccctttttctccccaaaattatcatgtgatttattaagactagaggccaggcacagactcatgcctgtaatcccactccatgggaaagcatggctcatccctataatcccagcactttgggaggccgaggtgggtggatcacctgaggtcaggattttgagaccagcctggccaactttgtgaaccctgtctctactaaaaatacaaaaaattagctgggtgtggtggcaggcacctataatcccagctactgaggaggctgaggcaggagaatcacttgaacttgagaggtggaggttgcagtgagccaagattgtgccactgcactccagcctgagcaacaagagtgagactccatctcaaaaataaataaataaaaataaaaataaaataaaaaaagtttagaaaggtgttctcaaggcaatgtttgcaaccttaggatgtctgttgtgtgttcctcatgtggacggttaggaagtgggcatctcaggctgcagtcactgcccccgatgattttgatgtgctcatttcccagcccctctccctgcctacattctcctctgtcccctaactcccaaaagcctgtttctgatctgcacccctcctgcctttccatgtctttcacactccatttatagaactgctctccgcttccttgccccatcccctgccagttccaggctccctgggcctggcctcatggatgacagtgaacccctctggacttggccacttaggtccctttcaggtggccggaaacagagttagaggagacacagggcattatcctgaccactttcacaccagagtccctccctctagaacagggcttgacccgtggtactgccccgttgagcctttctttttccctttcctcctttggcttaagcctttggcaggacagattttgggctggaggccagcaattcaactgggagggctctgtgccagttcttgcctttctgaaggttggtacatttgcccagggctctgcttgggtttggagcctttactaacgtgtgtcaataatgcgggtccaccttccataccatcttgcaaccaattatcagaaagagaaggcctgagcagggggatgtgcattttgctttctttcggcgtagcatctcatgctagatttttatctgggggcctttgaagagccagccggcacagaagcatggtggcaacgctgtgcctggaaaactcatcagtgtcactctggtttattttcctctcctctttgagctctttcccatggtgtggggctctcagtgacaactggcaagcggcggggcggttgctcgttgtcattctggtaggcgctggtttccggagggctccgagtgctttgtgagtattcgcatttgtttctgagatgctgggagcacggttggcactggtcccagtttctggatgaagaaactgaggctctggggattaagatcgtgaactgtggggagtggaggaggcacagctggagtgaacttgggtgtccagggttctgtttcgtctcacagaggatgtgcgagggtgtatgtgtgcatttgagaatgtgtgaggttgtgtgtgtttaagaaaatgagaatgaggctgggcacagtggctcatgcctgtaatcccaacactttgagaggctgagctgggtggatgacttgagcccaggagttcaagaccagactggggaacatggtgatgaaaccctgtctctacaaaaaaatacaaaaaattagcagggcatggcaatccatgcctgtagtcccagctacttgggaggctgaggtgggaggattgcttgaacccaggagataaaggctgcagtgagccatgatcgcaccactgcactccagcctgggcaacagagtgagaccctgtctccaaaaaaagaaagaaagaaaataaaaaggagagaggttagaaaagggggctgggcgcggtggctcacgcctgtaatcccagcactttgggaggccgaggcgggcggatcacgaggtcaggagatcgagaccatcctggctaacacggtgaaaccccgtctctactaaaaaaaaatacaaaaaattagccgggcgtggtagcgggcgcctgtagtcccagctactcgggaggctgaggcaggagaatggcgtgagcccgggaggcggagcttgcagtgagccgagatcgcgccactgcactccagcctgggcgacagagcaagactccgtctcaaaaaaaaaaaaaaaaaaaaagaaaagaaaaggggtaggcccctcagtatcacccttcctgagaacagtcattctctgctttttctgatcagagctccctcccaggaggggcccttttatccaaagcgatctctggcccaggcaccaaagaaaggccccagtggtttacgcagccgggctgccccctgcgcctgctgggtgaggggtgggtcgtggaagccttcccctcctgcctgttctttcctgctcctccccagtgcatctttatagctggcatatggaaactgtttctatttatctggcaccaccaggacgctgctgcatgctgtgctccagcaaacagaaaccttggattccctgcagggtcatttccgatgtggcgtgcaaagcagccagctgtttcgagggagcgtctgggccctgtgacatcagcatgtgggagtgttaccgtgtgtgcaaacaggtcattctggtttgtctgcctgtcctctgcaccgggatgtctctcctgcttcgagtcagagtttgcgttgttgttttgtattctcatgcctgtcagttcagctgtttctttccactccttcccgtcctctgagtggttttacgttctctcctccgggctgattgccaggattcagggagggaggttaaggggctggtgccacataaatctttagtggccaaagtctgcaggcctgcaaggctgcgcctgtcctcttggtctggttttcccaagagagctgtctgcccagggcaccagaagggcaggacaaaatgtttcccttcgtggaactttccccagaggcccagaacagagatgcagaatacagtcttcctggttgccaagagtgttcctggtcagcctcctctggtcctttctgaaacctgcatgtggagcttgctggctgtgggagccagggagactgcaaatcctgcccgcctgcccacgctgctgctcatctccctccctcctatgtccggcccggttgcctcccaggaaaggtaaacatgcagaggcaagggctagctgccggccttctggaggaggcagtggagggccagcttcctgacagccccgtggtgaggtcgtcctgtcttctcaagctgggcccctgcgacgtgccccagttcctgcctttccagctggcctggaagaacccgttctgctctgggcaagaacagtgccaaggtcagaggccaaaggtgttgcttcttccgtggtccgtaatgagcaccagttggagagggccagccccggcacacagaggaaggggctggactggggtgatgcggggtgagcctgcccggtcactttgttggctaggatgcttcctgtgctttctgtgcctggtactccaaagatgcgagtgccagtcattgacctggaggttctgcccagggtctgtgggcagtaggaggtcagaacaaggcaccaggccactagagcaggtgggtgtaaacaactgttggcattcgaggctgcccaggtagaggtcctggagtgaacccagtgggcacgatgggcttcagtggggcagagtgtcctctagcttcacacacagtgctgatgactcaggccagctgggggcccctgcacatgctcttagttcccacgtggagggtattcattttgaggaagctgggcctgccgggattggttccccagcaagcaggggctcattctcccagaaaccactccatctgcactcacaccctgactcaccaggctcacatcctgacttaccaggacttggctatcagcctgtcccctttgatctgccccttctgccccctgccttcccgctttctgggcctgaaatgtcctcctcagaaagctgccgagccttcgagcataccttctgcgggaacaacgcagcactcggagtgggagcatatccattgtcccttcagccacttctgcaacctcttaagtggggaagagggttagacagcagacagggcaggggattagcactccacgaggtggcccagccccacccggcccctgccgtgccctcgtcttggctggtacagctgcactgctgcgtgaaggccacgtacaaaaggaacagaatggaactgtggctcctcgccttccatttgcaccctttctataatccctaaatatgtagcccagttgctcgtgccttgatgtgaaggaggccctttgcgatcacctgtggctttcttgaaaagtccctgagtggccagtgtcaccccaggccttccatccctctctccgtgtggagaaatgagcgatcatgctttgccttttgggaccacatgagcactccaagtcctgttttctgaggttgagtggttagaagcacagaacaaagtccgtcctgggagggggagaattcgctgttctttcaccttagctcttgagtcttattctcccctttccctttcaaggttctaccctgaattactcttaacacaaaacagcccctcttccgcagatccttaaaagaaaggtttttacaaatacaaacttaccacatcacaccccttcctaacaccctttggcgctgcccactgcaccccgggtggagcccgccctcttgcccgaggcctgccaggccccacggatggctccttgttctccgccctccaggccctggccatccttaagtgccccacgggggtgtgtggaatcttcagggctagcaagaccttctatttcacttcagttcagacatgtttgctgaccacttacacattgtgtacaacgctgttctggggcctgggaacaccacagtgaccaaaacaaaagtccctgccctcttggagctgacattccaggcggggaaacaggcccacgattaaacagataccctgtcaggtggtgacagccccaggaggaagcctcagcgctttgaggggacggagtgatgtggtctcaccttgtaggggaggccaagggtagcctctgataaaatgtttgtggaaactggaaggtgtgacaaagcagccaaagatcggggaggcagaggccccaaggcggagtgttccaggcacgtttcagaacaacaaggaggttagcatggcggcagcgaggggcaggcaggacgaggtgacttggagaggttgcgggtcaggttccacgagaccctctgatcaagggaggctggggcacgtttggggcagaggagtgataccatttggcttagtgttctttaggatttttgttatattaaacaaaaaagttacctaaaaacacacacacgcacacacacgatagaggatttctctgactggtgtcaagaataggccacagagggaagaacagacagtaggaagacagagaagggattgtgctagtctaggggagagctgttttgggccacagtgtggcaggggagctggtgagagcgaggtcttgtgggccaggtgcagcacctatttgtgggcctttcagctgattgtgggagaggaggagcctcctgattcctgaggcccctcctgccccaagattctctgttggtgcagctgttccattcagcaccggtatggccaggaaaatgtggtctcagtcaccccagggccttctcctgcccccagtcacttgtggcccataagagtgcatcccaagagccctggccaatggagggaccgtctgtgcgagaaccggccacgtgttctctttgatttgggtcatagatgctaagcctgtttcacagctgtatgctgtccatcagaagagacagtggccggcgtaccgcacggcagacagtgggtcagcggagccaccccctacatttctctagtgagaggtgagtggcagatgattgtatgaaggaaagctctggatggggagccaggaagcctggatgctagacctggcgctgtaaccaattggccctataccatggggacatcacgttccctgccctcagtttccccatctctaaaagctgggcaatgaattaggtggtctctaggatctgctcctgacctgacagtcgttgcttctaagacaacagcagaaagtgcctacaattcacgcaggagagctacgcagcagcgcttcccatactctgcagcagaggacctctacttccataaaacacaacaaaaacgaagtactaggagaaggaagtgccgcacagtgccacctgcggtgatggcctctacacgctggctctggttcctggatggttctcatccccgaccatggcacaccattaatggactgtgcagaccatgtggaatgacaccgcccacagttagagtggttccaagcacagacctcatttattctccagctccgtcactttctaaatgtgggagcccccggacaagctgaccaatctctgtgcttctgtcccatcacccttcttctgaaatggggatgctgatggtatccacctcctaaggttgatgcgaggatgaagttatttcacctataaagtgctgagactagtgcctgcctcacagaatttgttccgcaagtgtttgtgtgtgttattttagcggaagctgagctgctgagattggggctagatttgggggctgcagttaatcgggaggtgggagagggacgcgtgtgctaaaaaaagatgccattgccctccctaagcagcaaggaagtgtttgtggaaggcttttggcgccagcaggatctaggcagctgggccctgctcagattgtggcactgccagctctctggggcagctctgcagtttggagctgcttctgaagccatctgcacccacctgcctgctccccttgaagtcaccatatacctgtaaacatgtagatgccacaagttgcaggggcagctagttcagctgctcactggctggtgaacctcttctctattgaaatgtccataaccaatagctgtggagcctctttttgaggccacgtggtgatggggtactcactgcctctgtggacaggtgcccctggagggcaagggctgcctagttcctacagtccccactaagggcccagcacctaggagctgaccttgggcagggacaaccctgggaatgtctgctaaacaaaggagtagatgaacaggccagttgttggtcttagaatattttcattaagaattatttcccggccaggcgcagtggctcacgcctgtaatcccagcactttgggaggccaaggcagttggatcacttgaggtcaggagtttgagaccagcctggccaacatggtaaaaccccgtctcttccaaaaaatacaaaaattagccgggtgtgttggtgcacgcctgtgtgttggtgcatgcccagctactcaggaggctgaagcacaagaattgcttgaacctgagaagtagaggttgtagtgagatgagattgcactgctgtactccagcctgggcgacagagcaactctgtctcaaaaaaaaaagaaaaaatacataaaaattaaaaaataaaaatagaagaattctttccggccaggtgcagtggctcacacctgtaatcctagaactctgggagggcgaggcaggtggattgcttgagcctaggagtttgagaccaccctgatcaacatggcaagaccccatctctacaaaaaaaaaaaattagctgggcatggtggcacatgcctatagtcccagctactctggaggcttaggtgggaggatggcttgagcctaagaggttgaggctgcagtgagccatgatagtgccactgcactacagcctgggctcaataaaaagaattatttccaaatggaggccaaggggagaggatcgcctgagtccaggaatttgagtctagcttgggcaacatagtgagaccctgtctctaaaactaaagccctctgtgccggtccctcatttctagttattacaaagccctttcagatctagcagaaacaccctgtgaagtccattcccgagtcctcgttccaccattggcaacactgctacgtgtctgccctcacccaccagccatgtgtggtctgtggccacggggcgcatgttttgtctctgtgttgctcgctgtcccgtgggggggctccagccagctccctgcatccttggtgctccatggtcacctgttgccttcggcggccagcccgtgaggcccaggccacagccctcctgcctgttaggagtttggtacaggaatagggaaaagggagagggatgtagcagcagccagctctaaagatcctctcccattgttccaaggagtcagtctttttctgcaggcaagccatggaaggattttaagtagtggagtgacaccgtgagacttcggccttacccgattgattcatcctgcctcaaggcgtctgggtcaggtggtcaggaaaggcctggacagtgagagtgagtccaggttgctgcaggcttttaggtgaaagacaagaggccccaaagacctcttcagtagagatgagagggacgagacctttccagacctggtgagttacaggccatgaggagtgaaaaagaagatcgggttaagatttctggctctgaggactgtcctcccagggcagccagaagcttggtccttcctgtctcagtggtccttgtggatttcagttgaatggaactgtcctttgtggctttgaagggttatgtatcggggaagagggactatctctcacccaaaccaggacacctaaagattagcaaaggttacctgctcccaggagaaacctgttgctgggagtgtcattgaggcttgttagcaaggaatggcctgcaccgtgggacgcgtcgggccacctggtcccagggatgctgcggtataagtggtaagggataggggagcttttgaggaggaccagacgttgtctccccaccaggaacgggctgagagagcctcctgagcacaaggaggaagctcctgtcaattcgaggagacccctgtgtgagaagaagggcaggaaggctccaaagggggtcttcacggcagccgctcacatagacactcgtgtctagtgtcaagtgggagggtggcactaatggctgctgccatctgtgccagctagcagctgcctgctccgctccatcattgttatttatgttacctaggactcttctgtgttgccggtgccagcccctgctggggcatgtggaggtcgtggaggacagggcatgggctcacgaggacgcagctccatccagctgcttgcctgtggctttttctgctcaggagtcacgttttggctcaggcttccctgatccacatgagcagattgaggacggtggtttgaccttcttctgtctctgcctagggcttagttctttcagaaatgagcattgggatcagggtagggaatgctactctgttgctattgggaagagaagggtcagaattaccaagttcaaaccgcacccagatgtcccacctcctacttgcaactccactgtagtgatggaaatgctagtgtatttttggtccttttggcactaactaccctgtcacgcttttggagtttctgattcttgagaggcaagtagtctaccgattgggagctaggcagcctagtttgggatcccagcccctcttctcactaggagcatgacccggggaggttacttagcttctctgcaccttagtttcctcaagtctgaggtgggaatagtaatattacctacttgggagggctgttgtaagaactaagtgggttaacagatagatacaatgtatttagataggtatcagttatctgttgataataatattacctacttggcaggattgttgtaagaactaagtaggttaatagatacaatgtatttagataggtgtcagttatctgttgcccttgtatcaaatcactgccccaacatagtgccttaagatagcaacatttattttgcttgagtttgcagtttgagcagggcttggtggagttgtctttttgctgttgtacgtaacatctgtttggacagcttaactggggctggaggatctatttttgagatggctccttgatgtggcagagaagttggtgctaccccttggctgggtgctcagctgggctgtgaactggagccttgagtcttctgtctgcaccagctgcttgggcttccttacaaaatggttgctcggttccacaagtaagtgccccaagagaataaggtgaaagtatttttataacctcagaagtcatgaggttccctgttctctgttagtcacagcagtcataaaggctcacctgatttcaagaggaagaaacacagcttctacctgtgtgtggagaagcagcaaggttccagaagagcatggaaggtgaaagataatgcggtggccatttatggaaaataaaatctgccgcaggataggttttggcatacagtaaacctcaacaaatgtttgctaccagtagtttaaaatcatcatctgcattcctcatccccgactcctcttccttagagagatggtagtatagtgcagtggttaagtgcatctgctctggtggcaagctgctaggggccaaagcctggctcagcccttatagctgtgtgatcttggacagattgtttagcctcttggcaaatttcttgaaagataaacaaaccaccaaagctttctcaataagaatagaaaacctgagtggccctatatgtactgaagaaggttaatatgtaataaaaactttcccagaaagaaaacttcaggcccagatagctttcctggtgaacggtatacattagggaagaaataataccaatttgacacaaattcttccagaaaattgaaaaggaggaaatattttctagcccattttatgaggccagcattaccttgatacccaaaccagcaaagacctcacaaggaaagaaacctcggaccaacattctacacggatgtagatgcaaaaaatttaaacaattttgcaaatgcaataatatataaaaaggataatacatcatgactagggggacttagctcaggaatgcagggttggtttaatgttcaaaaatcaatcattgtaattcactatattaaccaaaggaaaaagaaaaaccatatacaggttgaatatcccttatccaaaatgcttgggtccagaagtatttccgatttttaatttttttcagattttggagtatttgcgttatacttactggttgagtatttctaacctgaatatccagaatgctccagtgaacgttttctttgagtgtcatgttggtgctcaaaaagtttggaattttggagcatttggatttcagattttcggattagggattctcaagctgaaatcatctcgaagtagacacagaaagtgtttgacaaaatgcaacacccattcatggtaagatctcacaacaaactaggcacagaaaggaatttcctcagactgataaaggatatctacgagaaacttctagcttacatcatactgagtggtgaaaaactgaatgcttttcccctaagatcaggaatgagacaaagatatcccttctcatcatttttattcagtattgtaagggagcttctaaacagtgccataaggcaagaaaaacgaaaggcatctggattagaaaggaagaaataaaactgtccttattctcagacaacatgatcttctgtatagaaacgcccatgacatatttacaaaagaggccactagaccttttaagtgagtttatcaaggttgcaggctagaaggccaacatataaaaatcagctgtatttctgtatcctaacaacaaacaattggaaattgagattaaaaggcaacttcatttgcaacagcatcggaaatataaaagacttagtgataaatctaagaaaagatgtgtcaggtctgtatactgaaagctgtaaaatattactaagaaaatttaaaaagatcaaaataaactgacagatataccatattcatgggtttttaagagtctccccaatagatctgacataatttcaatcaaatcccagcagacttttttttttaagtagaaattgactaattattattattaattaattttttttttttgagacagagtctcagtctgtaagccaagctggagtgcagtggcgcaatctcagctcaccgcaacctccacctcctgggctcaagtgagtctcatgcctcagcctcctgagtagctgggactacaggcgcatgccaccatgcccggctaattttttgtattttagtagagacgggcggggtttcactatgttgcccagggtggtctcgaactcctaagctcaggtgatccacctgccttggcctccctaagtgctaggattacaggcatgagccactgtgcctggcctgttattattattgagacaggatcttgctctgtcacccaggctggagtgcagtagctatgatcatagctcactctagccttgacctctcaagctcaagccatcctcccacctcagcctcctgagtagctgggactacaggtgcaagccaccatgcccagctattttttatactttttgttatgaggtcatagtatgttacccagactggtcttcaactcctgacctgaagcgatccatccacctcagcctcccaaagtgctgggattataggcacatgccactgtgcttgcctaatttttttacttaaaaaaaattttttttttgtagagatagggtctcactatattccccaggctaggtttctattgattgattgattgattggactcttggattagggacaaagaaattgactaattctaaagttcatatggaagttcaaatttttttactttttaaattttttttttttgtagaggtagggtctcactatattccccaggctgggtatgcatgtatgtatgtatttatttatttggactcctggattagggacaaagaaattgactaattctaaagtttatatggaagttcagaagaactgggctagccaaaacaactttgaaaaaaatatgaacaaagttggaggattaacactgcctgattttaagacttataaagcctcagtaaccaagacatcgaggtattgatgtgaaatctttgtttttatttttcttttttaaagacagtgtctttctgtgttgtccaggctggcttgaactactgggctaaggtgatcctctcacctcagcctcctaggcactgggactacaggcttacaccactgtgccttgatgtggaatcttttttattttaatttttttgtagagacaagatctcactgcgttgcccaggttaatcttgaactcttgggctcaagtgatcctccccaccttagcctgatgtgaaatctttatgaccaggggttaggcaaagatttcttagatatgatatcaaaagtattaatccataaaaagaataaatggataagttggccttcatcaaaatttgtaaaacttctgttttagtgacctttgaaaggcactgttagaaaagaatgagaagacaaaccacaaatgggaaaatatttgcaaatcatcatgtatctgatagacttgtatccagagtgtataaaagagctctcaatttaataataaaaaaaaagaaaaaggtgaaagatctggacacttcaaagaagatagatggtaaataaacatatggaaagttgtgcaacattattgttaggaaaatgcaaatttcaagcatgaacatgaaaaacaatgatataccactacccatcttttgaaatgcttaaagttggccaggcgcagcagcccatgcctgtgatcccaacactttgggaggccgaggcgggcagatcacctgaggttcggaattcaaggccagcctggccaacatggtgaaacgtctctactaaaaatatttaaaaattagccaggcatggtggtgcgtgcctgtaatcccagctactcaggaggctgaggcaggaggatcacttgaacccaggaagtggaggttttagtgagctgagatggcaccactgcactccagcctgggcgacagagtgagaccgtctcaaaaaaaaaaaaaaatgcttaaaaagagcgagcatatcaacagttggtggagatgtggaggaactggaactctcatatactgctagtgagaatgtaaaatggtacaatcattttggaaaacagtttggcagttttgtaaaaagttaaacatgtgatctagctatttcacctctagctttaccaaaagaaacaaaaagtgtacatccacacaaagccctgaatgaatgttcatagcaactttgaaataacccaaaactagaaacaatcttagctgttcatcaacaggtgaatggataaactgtggtatatttattactcagcaaagaaacagaatgaactgttggtacacagtgcaatgtggatgagtttttaaataattattctgagtgaaagaatccaagcaaaaaaaaagactacatactgtattattccatttatataatacatcatgtaaatatatatattatatgtaataatagatgcagattcatctaatagtaacagaatgcagctcagtggttgcctgggcatggatgggcaaggaggcacgggagggttatggatatgttatcttgattgttgtgatgattttacagatatgcacgtaggtcaaaatgtatcaaactgtattcttaaaatatatactgtttattgtggcacaacttagcgaaactgtttttaaaaatgggtagggttggccaggcacgatggctcacatctataatcccagaactttgggaggcccaggcgggtggatcacttgaggtcaggagtttaagaccaacctggccaacatgctaaaccctgtctctactaaaaatacaaaaattagctgggcatggtgttaggcacctgtaatcccagctgctcgggaggctgaggtgggagaatcacttgaacctcggaagcagaggttacagtgagctgagatcacgccattgcattccagcctgggtgacagagtgagactccatctcaaaaaaaggaagaaagaaaaaacaagggtggagtggctgggcacagtggcccacacctgtaatctcaacactttgggaggccaaggcagaagaattgcttgattccaggagttcgagaccagcctgggcaacaaagggagactccacctctataaaaatacaaaaattagccaggcgtgatggtgcatgcctgtagtcctagctgctcaggaggctgaagtaggaggatctcttgaactcaagagtttaagactgcaatgagccatgcttgtgccgctgtactccattctgggtgacagagtgagatcttgtgtcttaaaaaaagcagggagctggggaagtaagttgcatgtggctggacctcattgctcatgactggcaattcaagatcagaaggaccttttgcaacccagcaggcctttgagccctgtcagtctcctgtcccttgcatggttgtaagccttacacatttgctttctgccaactgtgcaaatcccagtatcaaaacattagatttttttttttttttttgagacggagtcttgctctgtcccccaggctagagtagtgatgcgattttggctcactgcaacctccgcctcccaggttcaagtgattctcatgcctcagcctcctgagtagctgggattacaggcaccttccaccacgcctggctactttttgtatttttagtagagttgaggttttgtcatgttggccatgctggtcttgaactcctgatctcaggtgatccgtccaccttggcctcccaaagtgctgggattacaggcgtgagccaccgtgctcagcccaaaacattagattctttatcttccttcgggtggatcatttacaatgcagatttacagatttctctcagattcacttcttcccaatgaatgcgtcatttcttggtgccgttgtttactgtgtgtaaactactgaatttcaggattattgtgacaaacccaactcagactcaatgggatctgtttatcagcttggattttggaaattaaggggtagatttcaggcacagctggattccagaggtgcagctggtgttagtgttatctattggttattgttttgttgtctgctgacttccttctcaggcaagttttccccatgtggtggcagaggcagccgccagcaacaacagggaaagagcccctccttcctaattggcctgggaacagtttcaagttcagctgtcactggctggacttgggtcagcagctatgcctgaatgcccaagggagatgaggggcttattgccaggcccaggtcacctgcctgggaaccaggggtggagttggccagagccaaacaatgtggacagagagcaaggaggggatgttctacagagacagatggcccagtgttgctgggagaggagggcgtggctgtcagcagggaagagcaacagatggccctgcaccaggggacaaatccagttgtttttaatttttaactaagtaggatattaatatgcttccaaaagtcaaaggattcaaaaagggtctgtctaccctattccttatagcccttgtagggcgactgatttcattgacttctcatttttccttcctgtgtttcttttggtaaagataagtcgatgtatttatgttttcttgtttcctcccttttgtacacattagagagcatactatttgtactcttttgtacttgcttttttcacttatcaagagaaaggaaaacatttgtaaccagctgtgctaattcttgccattatcagtacacagcatggaggttgatttgaagatgacgggatgtccatgtgagcatatgaagggactgccaggcttttcttctgccaaacggtgtctttttgctcttaagcctgggtgccaagtgaatctctctcctcttccaatgcagatggcggcagctatgccatccacgactcccaggcccccagtctcagctctgggggtgagagttccccctccagccccgcacacaactgggagatgaattaccaagaggcagcaatctacctccaggtgagtatctccagtcaggccctggcagttgtctgcacctgttggtggggtggggcagccaagactctgttaggtgcccagaaattcagttccagcatcagttcatgctgctgctgctcgtgtgtgagcttcaggttcataagatgggctgacctgactgtgctcataggggaaaactgctgtgcaccagcttgtcttcagacccctgtttagggctgtgccaacccccacaatttccggagtctggccactcggccttccctgccaccctccctcttctcagggcacactgagaggccacgttctcaggagggaattctttacatactgaatgcggtagctttattcctgtttaacttgttgctgctttcctgtttgctattttaggaatttttttttttttgaaaaatatatttttggccaggcatggtcgctcatgcctgtaatcccagcactttgggaggccaaggcctgcagatcacttgagatcaggagttcgagatcagcctggccaacatagtgaaaccctgtctctactaaaaatacaaaaaattagctgggcgttggtgggcgcctgtaatcccagctactcgggaggctgagacaggagaatcgcatgagatggaggttgcagtgagccgagatcgcaccactgcacttcagcctgggtgacaatgcaagactctgtctccaaaacaaacaaaaaattttgtatttttgtgtgaaagtaatacatgcttattacaataaatttagatacaaagaggaatgaagaaacattcacctaaggcagtcactgtcaacattatttccttccaggtttaaaaaaaatgtattataagaataatatatctgttttccaaaaaagtcatatggtatgtgcaattttatagtctgcttttttttttcatagcataagctttttttttttttttttttttctttttttggagacagtctcactccatcacccaggctggagttgaattgcagtggcttgatctcggctcagtgcaacctctgcctcccgggttcaagcgattttcctgcctcagcctccggagtagctgggaccacaggcacgtgccaccatgcccggctaatttttgtatttttagtagagatggggtttcgccatgttggccaggctgatctcaaactcttgacctcaggtgatccgccgacctcagcctcccaaagtgctggggttacaggcatgagccaccacacctggctatttaaatagctttaaattatatcaggtaaattattctaatttacttaacctgataatcttgaatattttcccttattgtaaattatagtccaaggacaatctatacgtagcaccccccacccccttacatctaggattattttactaggaaagtaaaagaaatggaaattctaagaaatggaattaccgggtagaaggaatcaacaatttttagggccttgatgtttcagcatggaatcctctgcacaggaagtatttcctctttactgagggccccactggcggtgacattttaaccttaatcttgccaatcttgtcactatcagatttcagtttctggtttgcattgagtaagagcttggatgaggaaatagactttttcttaaatgcattcgaatcataattttccctaatctttcttatgtgaagcagctctccactgcaagtatttgttttgtcatttaaaaaggatttagtgaaattcaagcctgggcaacatggcagaacccatctctggtaaaaatacaaaaattagccaggcgtagcatgtgtaccctctagttctagccacttgtgagactgaggtgaagggatcgcctgagtctgggaagttgaggctccagtgagccgtgtttgtgtcactgcacttcagcctgggtgacaaaatgagaccctgtctaaaaaaaaaaaaaaaaaaagatttaatgaaatttagacatttgtttgatggttgttcaatcatctgtttctcatatgttcatgcagcatcatatacacctaaatgatcatgttttgtttcaaattaaggcaacagaatgttttagggaaattgtcccaagcgcaggcatacttgttaatgatctagcagggacatcttatgcacatcaccttctctgaggccggataagagcgtgggataggtcagaacacagactcagaatggttgaagccctaaggatcctgatcattccttcctttcctaagcaggtgaggacattggtaatgaacataggaactttaagggggcacctgctaatctttgtaacaagcctctgaggctgtagtgatcatctcccactttacagatgtggcaactgagactcagaggggccaaatgatgcccaaggccacccagctagggagttgcagagctccacatttaaactgtttagcctccagatgatgttttttattctgtgtgctattgcatcacttatgaactgaccttgtgcatctccttgaaaatgggccatgtacttgtgggaaaaagcagttatggaacagctggtgttgtatgatcattttaaattgatgtcatacagcagcatgtgcatgtgggtatgtatgtgtacagatatccatacatatctcaaaaattgtttaaatattaaaggtgattatctctggctgatggaatttttactaccttacaaatttatattgtttaaattattttaccaaaaatgcattatttttaaaaaaattaaagaaaaacttggatttcacagtcattcacggctgtttctagaggatgagatggcctgtttttcttgagacagactctcactccgttgcccgggctggagtatagtggtgcgaccttggctcgctgcaacctcctcccaggttcaggtgattctcctgcctcagccacccaggtagctggaattacaggcacctgccgccacaccaggctaatttttgtatttttagtagagatggggtttcaccatgttggtcaggttggtctcaaatttatgacctcaagtgatccacctgcttaagcctcccaaagtgctgggattacaggcatgagcctctgtgcccggctcaagatggcctgccttttcacgcttgcagccaagctgcgggtcctgcagtgagccaggttgctggtgtgcatggataattggccctcgctgctttgagggtgtctggtgcctgcagtttcccctcttcccacattttacctgttaactcactcatcctctggagccacgtgctcagcagtcctgacgcctttgaaacagtactcatttctgtgtggacttggaccccagggagcggagagcaaaggcctagaaatcgctacaactggccttccttatttttccaaatctagtttatgatcagccaggaaacagggccgatattctctggggttttcatcagaatccagtgccatgggtgatatttccatctgttggtggagacctcattacccccatctcttctgggacaactccaagtcctagagttaaaatctgagccccatgtcagtggttcttctagcgagaccttcattcctggttatttgttggaagaaattgcccaagaaatacatttttttttttggttattgaaaccagaagctccccaggccactgtgtgtggccccctgcccactgctgtggtcatggaggtggtagtgaaaaccacagccctgcacagagcacagaactgtgttcaacttaccttctgttgactgccaaggtgtttgctccctttgacatgcctgcccctgccgggtttgctgctgggtctgtggtttgtctcgattttttgctaatggggcgagcagtttatccagcttcagggaagtgactcactcacagtcactctgcaaactgcaggcagggcctttcccagaataagtttgtgagaatgggccgagcatggtggctcacacctgtaatcccagcactttgggaggctgaggtgggcagatcacttgagctcaggagttcgagaccagcctgggcaacatggtgaaacaccatctctactaaaaatacaaaaattagccaggtgtggtggtgcacgcctgtcattccagctacccgggaggctgaggcaagagaattgcttgaacccaggaggcggaggttgcagtgagccaagattgcaccactgcactccagcctgggtgacagagcaagactctgtctcaaaaaaaaagaaaaaaaaaagttgttacataacatataaatatatcaaaatatcacattgtaccccatatacaattattatttgtcaattaaaacaaagtagggtatggggaatcctgaattaagtaaatgtatagtagcaatacgccactgtgcagctctttttgtttatttttttggagacggggcccaggttggagtatagtggtacaactttggctcactgcaacctccacctcctgggttcaagtgattcccctgcctcagcctcccaagtagctgggactacaggcgcatgccaccatacccagctaatttttgtatttttagtagagacgaggtttcaccatgttggccaggccggcctcgaactcctgacctcaggtgatccacccgcctcagcctcccaaagtgctgggattacaggcatgagccactgcacctgttttgggtagctcttgatgggtgttaaagggtctgactaggcagggttattggcttctttttttctggtaatgttcatataacttacgataatagcaaatacctgtagtgagctgactgtgtggcagacaccaccctaactgcctcacaaatgtcctcacctttcctcttcacaacagctccaggaggaagcactaatgttagttcctttatcgttgaagaagctcagcctcaagggtgaaggaaccttcccagcattcctcagggaaggagtagaaagccagggttcagcacgtgtggttcctcccaggcccctgagctctttacactctgctgggcactcctagagggagaacttggcctctgaggggattggacatgcctgtttctctttacctcctctcaggaccttttttctttttctttcttttttttttttttttgagaccaggtcttgctctgtggtccaggctggagcgcagtggcacgatcttggctcactgcagctttgacctcccgggctcaagtgattctccaacctcagcctcccaagtggctggcaccaggggtctcaacatgttgcccaggctggtctcaaactcatgggctcaagcaatcctcctgccttggcctcccaaagtgttgggattacaggcatgagccaccgcacccagcccctcccctcttttttaagagatggtgtcttgctgtgttgcccaggctagactcaaagtcctggctcaagggatcttcccgccttggcctccggagtagctgggatgtcaccacacctggctgtctctggacccttttagtctttggttcctccgagtggtttttaagaagcagcaaatctcttgagcccatcagcaggcaggagtgagacctgaccaccgtgagtttcgcgaagatcattttgattttccagcatcttctgtctctggcctgaatctctcctcgcctgcctggggccttcctttcctcccctgcccgcggctcctctttggcgttggatgggtctccaggcttacatgcccacactactctcatcttttcaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtgagcgcacatgctcctcatacggggggctgggagccacggctttcagggcaagcgatggaactccaaaaaggaacattctgggagggcaaacactgcaaacggacttaaaacagagagatacgaggtggtcatagaggccttgggagcggaaatgcctgggtgtccctgctggagtgaatggccttcacccagtctctctgggattctgcccaccagtaaattccagggaggggaagtgtcccaggccctgctcaggaccagtgcccacaccttggctccgggtggggagggcacccagtggacagtcccactactctgtctccagcctcaaaggagaaggcagttcggtgtggtcaccatgggaggtgggggatgtttcctgggcagccccagccccgcagatgtccctacacccaggcccagccatcattcagtgggggccagaacaggtgtggagctgtgcttgtccccttctcaaggggtgtgtggtaggcatggaagcagggaagggagcctgtgcctgttgagttaggaagcgctcatccagcctggcctccaaggccctccatgactcagtttcccttcctgtttctccttcttcatgcctggaactcacagctccagccagtctgtgtttctttctgtgcacacctcccccatgccgtcacctgtgctggagtccttcttcctgtcccttcactttgtcaattcctgcccactggaatgtccacaggccctggacctccctacccccaggaggaggagctctcctatgtctgtttcccagaagcacttgacttccctgctgggaaggttttccatctaagggttttccatgtcttgtccttttgtccaaaatgaggatgagagttttaggggctgctctctgcttgacagtccttgtttctttgacaatcggattttatttcttaagttcctaattgatgctttcttagtgtcttttatagatcttttgtaaattacatgaaatccctcttagaacaagactagatattaaattttatcttatcttgtttttcttactttttttttttttgagactgagtctccctctgttgcccaggctggtgtgcagtggcaccatctcggctcactgcaacatctgcctcctgtgctcaagcgattctcctgcctcagcctcctgagtagctgggattacaggtgtgcgccaccacgcccagctaatttctttttcttacttttaaacttcaggctccttcctgatttttcatcatttgggccagcatgtcagtttcatggatatcaagtttatgtttagttgttctggggaaagctccgtgaccaaggctctgtctttaggcatgcgaggccaggtttttgtaactctgatatgtgttgggaggatgtcctggggcactcccaggtcctgggagggttgggcaaagaggagtggccatgggctgggctggccatgacacatctccacaccctctggtctcaggtccacgccaccctggagctgtttgccctgatggtggtagtgtttgaactctgcatgaagttacgctggctgggcctccacaccttcatccggcacaagcggaccatggtcaaggtgatgtgtccgcccatctgtccctcccctcacagccttttctcccatgtcaccttcaaacctgtctctttggtacaattcagaatccaccatgggcccagtccatgctcagaggtgtaaccctagggtccctgtcctgaccgtgccctcagccttgtgggtgccctggatgtcgtgatgccagcagtagctaatgtgattgggtgtttggtacctgccaggcactggcgcagtcaccttcgagagagatgtgctgctctccgtggtttacattcatctggagacatggggctcacacccagctctgcccactgcgcccggctcacctgtccctagtgttgcgcatattctctctgtgccacagagagtggcatgagtaagagcacgtcaaggtggcattttgtagtgtgtggagcatgtgcgctactctaggagaatatagccaagtaagcagagctgaagaggagctgcaggccccgggatccctgatgtgagtggcgagggctgatcgaggggtcctggcagagtggcggttttgcctcctcagtggataccagcagtcacacagcccttccattcttctggtgccacacacctgtgccagcacctggagttttttttcttctggggctgcctgatgttggcaggaagtgtgagagggctggagagaggagaaggcctcccgaggccagagtgggcactgcctctccagccccccgttccaggtatgcaggatgacggctgggctgcaggggctgacggtgctccatgcctgccacccacagacctcggtgctggtggtgcagtttgtcgaggccatcgtggtgttggtacggcagatgtcccatgtgcgggtgacccgagcactgcgctgcattttcctggtggactgtcggtattgcggtggcgtccggcggtaaggcccgggtggggagctgggcagtcactatcctggcatggcctgacctctgggccagtggggcaggagcttgtgagtcagttagtgatgaggtcgaccctgcatgctggtggagtacacgcagactcactctccctctgccattccatccacgcacaggagaaagcggtattcctaccgcagtgtaggtttgctgcctctgggtccagggctttttcccatcttatccgcagccttccagagctgcttcctcgctctaggcatgttatctacccaaatgcaggcagctcagcagcgtccatgtgacacaagcagactctcctgccacctccatcgaggctgtaggaccaaactcaaaccagaccaagcctcgactgagatttattttgggagactcaatctggaaaattccttggctgggctactgttgctgagagtgggtttgcaattcattctctgtgcccatctgcaaagctagaaacaggactcagtgtccttgaaacaggcccagtgtcccaggactaagtggccttgaaatgtcttcatgccttccacatcctgctcatggaaactgacctttgcacccaaggtcatgcccttggccttctgctgctctgttccctgcttgcatggcactcacctccttggggcctcaccaggtggaggtggctgtgtgctacgcctgccctagttcttccctgccatccgctgagtgggggtctcaagccactttaggaaaaaatgaagcatgatgtcacaccagagtgcgtcagggtttagtatttcgagtcagaagcactaggcctccatctcaacaaggaggagtcccaggcagcccgccccagctggtgcctcccctgagctggcccatctctccccagcaacctgcggcagatcttccagtccctgccgcccttcatggacatcctcctgctgctgctgttcttcatgatcatctttgccatcctcggtgagttcccgcctctcaggcccaggtgcgctggaaaagcaagttcacggtggatgaaaaattattttgggcctggctcagtggctcacgcctgtaatcctagcattttgggaggccaaggtgggtgggtaacctaggtcaggagtttgaggccagcctggtcaacatggtgaaatccagtttctactaaaaatacaaaaattagctgggcgtggtggtgcacacctgtaatcccagctgcttcggaggctgaggcaggagaattgcttgaacccgggaggccaaggttgcagtgagctgagatcgtgccactgctttccagcctgggcaacaacagagtgagtgagactttgtctcaaaaaaaaaaagaaaagaaaagaaaaattatttagacagtgccttagtccttttggactgctgtaacaaaatgccatagactgggcagcttataaacaacagaagtttatttcacccctttctggaggctgtgagatctggaagtccaagatcaaaggccagctgtgggtgtctgttgagggcctatttcctgatccataggtggtgccttctggctgtgtcctcacgtggtggaaggtgggaggcagctctctgaggcctcttttttgtttgttttgttttgtttttttttttttgagacggagtctcaccctgtcacccaggctggagtgcagtggcacgatctcggcttactacaacctctgcctcccaggttcaagtgattctcctgcctcagcctcccgagtagctgggactacaggcacccaccaccacacccagctactttttgtagttttagtagagatggggtttcaccatattggccaggctggtctccaactcctgaccttgtgatccacctgcctccgcctcccaaagtgctgtgattataggcgtgggccaccgcgcccggcctctgggacctcttttataggggcactaatcccattcgggaggacgtcacactcatgacctcttcacctcccacagccgccacctcctaacaccctcaacttggggattaggatttcaacatagggattaggggcaggggacacaaacattcagaccagagcaggtagttttataaattcagaaagattttaaaaatacgccaggcatggtgtcccacgctgattgtcgcagcattctaggaggaggaggcaggcagatcgcttgagtccaggaggtcgagaccagcctgggcaagatagggagaccccatctctacacacacacaaaaaaaatatacaggaattagctgggtatggtggcatgtggcgtgcacctgtggtccctgctactcaagaggtgaggcaggaggatcacctgagcatggggagacagaggttgcagtgagctgtgacagcgcaactgcattccagcctgggcaacagagcaagactctgtctcaaaaataaataagtaataataacatgaacacccatggacctaccatccagcttaggaaatgaagccttagaaataaaatggaaggcatgtttgtgacctttagtgattgtgattcccgctttccccaaaggtaccccctgtcctacgcttatcattcccatgcacgtctttatattttacttcacatttacatttccccaagtgacaaagaaatgataatgctttgcatacttaaaaaagtctctaagtggttatataatatgggtgtccgcttctacacattgccctttcgctcagcactgtgtttttgaaatttattcctgttgatacatgtagatgctgtttattcattttcactggagcggagcaagtatgccaaagcttgtttatctgctcttctgtcggacgtttttcttatcacaaatcccaccgcagtgaacactcctgtgtgtttcccggtgctcacgcttgagagtttcccaaaggcgcttgcctgggccctgagagacggcaagcttcagcttcactgggtacagcatggtcacaggctgctcactcaggagggcttagtttttcaggtggggctgactgtgacagccacacaagagtcacagggcatagacatcggaagccgtggcactcagctgggaaagccgaggtcctttcaccaggactccgcagatggtgaagacagtggaactccagagccctgactctgaggctagagccagggccaacccctcccggccctcgtgactgccttgtcctgagtcatggctctcacttcctcccacccaccaccccactcttggtagaattttgtttgtgcttctccgggggtaggggctgatttcccctgagggcagagttcctcccttttcccactcaggatttcagggactcagggagtggtccattcctggagggaggaagtgaatggcattcccaccctgggaccctggctgcagggagcagcggatccctttggaatttagtcagctgtcatgttctcagaacctaagattgcgaaacagcagcctggattccagatccagcctacagatgggttttgtttggtctgaaaactttgagccagcattttaaaattagattttacacaaaaatacagacttccagccttttgaaagaacagagccgatagtgcccggcacattgctgtagggcagcaagcgtctggtgccagcagccctgctcccttccaacagagcatgtgttctcagggtgctgtggtccccagcagtccctgctgctcttcctgacctgctgcgttcatttgcatgtatttgtccagtccttttgacaccaggttttgggacctctgctctaatccttttgtttatctgtttccacccacttctaggtttctacttgttctcccctaacccttcagaccccgtaagtaatcagcacatttgtccgtctcttcttttatggagggcttttccctcagacagggtcaccggcgtgaccctgtggccatatggggaagggggggcctgcctggtttctcatcatagcttgtgtgtgcattgcacctgggagttcccatcactcagacttgaccactttcttccttgagagctggggatccccttttctgttcttgaaaggagtgccgccaggatcaggtttggaccattggaatattttggcagaggagcagtgggggagagccaggcgaatggcccagacatgtgactccctagaaaaaagtccccccaagtcaatagtttgcttctgccggaagcatcaggtgcaggaaaggggaggcctctggactgcatgtttgctctttcctctgcctccctcagggattccttgagagatgcaagagcggtcaaggcagggcatgccaggtggcccatcacagcctgttcctgatggccgtgtgctcttggctggtcccgacttctctgccctctcttcccttgcagtacttcagcaccctggagaacagcatcgtcagtctgtttgtccttctgaccacagccaagtaagtgcaggctctgccttgcctttggtcctctgctgccgccctggggtctctttctcttttctgccaagtatattccacatcccagcacaggcaggtgctgtggtgctattgggagacagggttggcccactgagcacggagcccagggatgagagtaggggaaccagggttggaggctgggaaggcagacaaggagctgtcctctgcaaggcatgtgctctgagaggatggagacaggcagatacagcacgccgggtcaccctctgcaaatacagtttcccagatgtgatgatgccctcctactcccggaacccctggtcctgcgtcttcttcatcgtgtacctctccatcgagctgtatttcatcatgaacctggtgagtgactatgcctcaggctacgctgaagcagcctgcccctacccatgcagcactaggcactgtgggagtggagaagtggggactgtcttctgcctctcagggcagaacgttggggcaggaagtcccagattcatagtcaggtgcggtgttgcagggaatgccctgtcgggacttcaggagttcagccagttgctgggggtggcgtcctcaccaaggcaatgctgctgatgctggtagtgctggatgtgaaacccaggcaaccctgggaccttttcattcttacatcagaaataagcagttgaccctcggtgtccacagggattgtttgcaggaccccctgtaggtacaaagatccacagatgttcaagtcccttatataaaatggcagagtatttgcagataacctgtgtacattcatcctctcatatattttaaattatcctgcattacctataacacctaatacaatgtaaaagctatgtaaatagttgttatactgggctggacatggtggctcacgcctgtaatcccagcattttgggaggccaaggtgggtggatcatttgaagtcaggagttcgagaccagcctggccaacatggtgaaaccctgtctctacttatgaaaattagctgggcgtggtggtgggtgcctgtaatcccatctactcaggaggctgaggcagaagaattgcttgaacccaggaggtggaggttgctgtgagccgagatcatgccgttgcactccagcctgggcaacagcacgagactctgtatcaaaaaaaaaaaattgttatactatattgtttagggataatgacaagaaaaagaaggctgtacatgttcagtacagatacaaccatccttttctttttggaatatttttgatttgcggttggttgaatgcatggatggagaacccacagataaagaaggccaagtatattataataaccataaaagctggcatttagtaagccttagccacttggcactatgcaaagtgctttacatatgaggatgaaataatttaataaataaacacaaccgtggaggtagtgagtatggttctccatgtgcagatgaagagactgagggtcagagtgacagtgtgatttgcccatggctacatagcttggagtggccaggccaggctcatcccagagccctgttcctaaccactctgttcagttgcactcacgtgccagaaatgtcttgtgtatttctacctcacttatcaggaaccatcagaaaatccagtatagaacacgttctgtgaaggagaacgtaaagcctctgtgctcaaagaactttgagggtgtttgtggaggtgtggacagcctccaggagtgtcccagccatcacagatcacatccgacaccaggctgttaggccggtgcccagaccacacatccatggcagagctaacggggagaggcttccgatcgagtcctgtgtttatttttatgcttctgcagagcattctcacaccagtcaccacagtcaggcccagtatagaaatgaaaatcatcttttccaggtagacttgtgaaatctaaaaaattttaagtccttttctcttttttgagatggagtctcgctctgtcacccaggctggagtgcagtggcgcaatctcagctcactgcaaccgccgcctcccaggttcaagcgattctcctgcctcagcctcccaagtagctgggactacaggcacatgcacatgccgccacacccgactaatttttgtatttttggtagagacagggttttgccatgttggtcaggctggtctcgaactcctgacctcaggtgatccgtccgactcagcctcccaaagtgctgggattacaggtgtgagccacagtgcctggccaaaatttaagtcttaaaaaggagaaaatatttcctttttttttttttgagacagagacttgctctgttgcccaggctgtagtgcagtggcgcgatctcggctcactacaacctccgcctcctggattcacaccattctcctgcctcagcctcccgagtagctgggactacaggcacccgccaccacgcccggctaattttttttgtagttttagtagagatggggtttcgcgctttgttagccaggatggtctcaatctcctgaccttgtgatccacccgcctcggcctcccaaagtgctgggattacaggccaccgtgcccggcctgagaaaatattttcttgttttaattcctcaaaaccaagaagaaatatgttgagtacttctttgtatttgatttaattcataatatatttagagctgtgaaaatttagggcagcagtcaacaaagtacgacctgctggccaaatttggcccatggcctgtgtttgtaaataaagtttcattgggacagagtcatgcccatttgttcatgtatagtctgtggctgatctcatgatatgaccacaggttagtagtcgcagcagagatcatttggccttcacagcctaaaacagttgctgtcgaaccctttacagaaaaagcatgctgacctttgatccacagggaaaaaatgggggaccagtttgagggaaaggaccagagagtttcccttaaaacatttttaaagacagagaaagtgtttctaaaaaggattctttcaagttcttccccggccttccatccccctctgataagctaacttttggtattagccaactctagaacgttatttccttgcatgcagagcctctcactcccctttttcctgggccacacgtgaagcagtgactcacaaggagaagtaacaaaggggcagggggaggaagggtccttctggatcggaggtcaggagggcagtgggcaggcagcctccgcctgccactggctggagtcggactgggctcagaatccagatgcgcccctcttgctactctctcctcccctggcttgcccctgcgcagcctgggacaagctgtagctggaactggggaaaggagtgtgggaaagtggaggggaacctgggaaagatggagtaacaatgccttcatgtatctgaagagggaaatttacaagcggaacaaagggccttcctctgttgagacttgggagactgacttcctaccccatgaggtgcaggcgagagggtctccccagggcctctctggggtgactgggtaagagccttgcctagatgatgaactcatacccccctgcactccctgccctaaccactcaaggtcctgagctagggctctgtgcttctctcccacagcttctggctgtggtgttcgacaccttcaatgacattgagaaacgcaagttcaagtctttgctactgcacaagcgaaccgctatccagcatgcctaccgcctgctcatcagccagagggtaggaactatgggccagggaggggcttggtccctgtcctccctcccttgcccagagcagcccctaagcatggccaggccagccactttagaaaccaggaaccctgcccttggaagaatgaacagagctggagtggatctggagtgggtgccccaagggaaggggagtagcctgggttccacactgctcttccctctcccccagaggcctgccggcatctcctacaggcagtttgaaggcctcatgcgcttctacaagccccggatgagtgccagggagcgctatcttaccttcaaggccctgaatcagaacaacacacccctgctcaggtaagagcagatgcctggtaggggcagcatggccagacaaggtgttcacgtctagagtgaacgggggcatgtgaaggcccttgaggtgggcaggcctataggcttgtcagagacttcctccacagatgtttatccatgtagacttacacactggattcatcaggatgccttttgcaagtgacaaaagtccaacacaaatccaattcaagctgacttgagaaaaaaggagctcatgaagtggactggcccagctgctggccctcgaacccccagtggggtgggatagtcccatgtgagccaggtggacagacaggggtgaatatacttccccaatcccctgcacacacctggctcggccgcagagaactgacccgagatctccaggggtaggattggtcttccaggctgttgatgaccaagccctgtccacagcagcctgctgtggagctgagaacaagccctgtttgagctgaacttgcagtcccaggtgttgcattaaggcccctgctaaaaagtgaagtttccgtcctcctaagaatcctagtgctccagcagctgcctctccagggcactgacactgtccgtagttagtgccatcggtggagacttaagtggattacatatttgtagtacctcaaggtcagaggagatccaaacgcttgcaggtaaaggatcccccagcactgctgtgctgggactcacatggtgtcccctctcttcctccctcaccccataaaggtgtccataggcaggcaagtaagagaagcaaagcacagtggaactatgttctgatattttgtccctttttattttgcttttggtagcctaaaggacttttacgatatctacgaagttgctgctttgaagtggaaggtgagttcttctctgagaccatagaaggagtagacagagaggtccccacgtggggcagtgaggagcaggggcaccccgagatccagctctctccctgctagagcagctcagcccccagcttggcatggtacacttcagggatcacaggtggccccagcccccaaatctgcccttacatttgtgatacagtgtcatcgttaacagcaccgaatcttacttagaccccattggttattgtgtgacatcaggcgggttactgagcctttctgaggcttgtcttacctgggaagtggcgtaaggataatccctactgacaaacctcatttcaggactatactaaaataaggcctctgcatggcacattgtaaacgctcggtacacactggctggctgtgttgtcatgtagatccctgaaggttaacattgttccccagtttagcagggtgaacaggaaaggaagccagcatcctggctccaggcagggccctggtccctggccctgacaccctccctcttggtcctgttgtctaccaggccaagaaaaacagagagcactggtttgatgagcttcccaggacggcgctcctcatcttcaaaggtaagtgggcttgagtatggcaggtgttggcagctgggggccgatggaggttttcagagaccacagataagcgtctgaggagaggttcagaggggtgtgtgtgtgtgtgtgtttgtctgaatgcctgtgtgaagagacagtgtgattaccccagcagggacgtaagggtggtaggaagcagattgggagagaaatgggtaacttaacccaaccaaaatgggtaacttaacccaaccaagacatttggggtatttttcttttttcatacaaaagcaaagatgttcattgaagaaacttgaaagtgagataattagaagtaaatggaaatttaccacccagataaccactgttagttctctgatgtgtttccctctgtgccatttttctatgcatttttaaaacagtagggtgacattatatattccattctgtaatctgccttttcatccaataacacatatgtgtgtgtgtgtatatatatatgtgtgtgtgtgtgtgtgtgtatatatatgtgtgtgtgtgtgtatatatatatatatatatatatatatatatattttccccgagggtctgttttnnnnnnnnnnnnnnnnnnnntgggagggtttcaacacctgcattttggggggacagatacttttcatccattacaggggtagagggcaggatttatttatttatgttgaataatgtggttttcagactattaaaaaaatgttttttaagagtcagagtcgctcgggtttgagcgcagtggtgcaatcgtggctcattgcagcctcaaacttccgggctcaagacatcttgccacccaagcctcccgagaggctgggactgcaggcaggtgccaccacacccagcttgttttaaaatttttttagagatggagtttcaccatgctggccaggctgatcttgaactcctgacctcgtgatccacccacctcggcctcccaaaggcctgggattacaggcgtgagccactgcgcccgaccccgataatatatttttgccctcctcttatggcaggatgtatactttgcatgaccccttgaataatgcttgtgtagtgtaaagtttgaaaatttgaaattgggtgctcgtattatttacctgacagttgccccttaatttcatgccagtttcagcagtgatcaggagagctttgtcctgctctatcttggttccaggttgctcaggctccccccagagcagctgtagtcagtgcagtcttgtctgggggtctgagcagaagcatgggtaccactctttgagcaggaccctcctttcttcacctctggggtaaagaccatgcttacctgcatgcacgaagagtgtggtaggtggttgcacctgcccagaaagagataataataattaaggatacagtagggggaacaagtgcgtaaatttacattttaacttgtcttttcttcaaataggtattaatatccttgtgaagtccaaggccttccagtatttcatgtgtaagtgtgaaatatctccactctaggccactttccccctgagtcctttgctgttctagaagcgggagaggcaagagattggtcctagagtcctgtgtttgactttttattgtggggaattcccagcatgtataaaagtgaagagaacattaccacacgcatccccgtgcccatcacccatctgtatcttcactccggctcatcatcctctctagacctagattttttggaagcaaattccagaaccacagagttgactggtcgatatgtctcttgagtttgttttaatctataggcttctcttcctcacctcatttaggtgaggaagcaggatttgggttttgtatgttcctctgttgccttttcctggaatttggtagttctgtctagagccatgctgtgcagtgtggaagccactggccacatgtggcaatttacatttaagctaattaaaatgaaaaattcagcttagctgtcacatttcaagtgattaatagccacaaatggctaatgactaccaattggattgtgcagataagaaaatttgtattgtcacagaaaattcccttggacagtactaacctagaggcttgatccaatttggtctttccaaggagctctggttccttttagtaggaaatggtgttagagacacaattcgaggtgctgggtgctcattgcttgggttggtcattgtttctaggcctttccatggacagaactagggttttgttttttttaaagataaactgttgtgcgttcatgctaatacttcacattcaggcctacagcaattttaagattaagaatctagatgtgtaagactgatttcatcaatcttacacgtctagattctcaatccttttttttttgagacagagtctcattctgtcgcccaggctagcgtaatctgtgctcactgcaacctctgcctcccaggttctaagtgattctcctgtctcactcacctgagtagctgggattacaggtgtgtgccaccacgcccagctgtttttgtatttttagtagagatggagtttcaccatgttgaccaggatggtctcgaactcctgacctcaggtggtccacctgcctcagcctcccaaagtgctgggattacaggcgtgagccacgtgcctggcctagattctcaatcttaaaatccaggttgtctttgaagacaatcagacaccaacaaagaaaaaaaaataaatatccaggttcccaactacactggcacagttattcatttgctttgtctcacagtcccaggataacaattgcaaagcaatcccaatgatataattactagaaacatcattccaatgatgtacattcagattactgtgggtttttttgtttgtttgttttgagacaaagacttaggtctggtgccctagtggcatagtcatggttcactgcagccttgacctcccaggctcaatccatcctcccacctcagtcttctgagtagctgggaccacaggtgcatgccaccacacctggctaattttttaattttttgtagagacggggtagcctcatgttgcccaggctggtctcaagctcctggcctcaagccattctcctgccttggcctcccgaagtgctgggagtacgggtgtgagccagtgtgcttggccttgtgttttaaggtcatgtgggatagttcctctccatgtggacatgtcaccaactggatacacatttggatttcttttttttttttttttttttgagacagagtctcactctatctctgtcacccaggctgtggtgcagtggcatgatcttggctcactgcaacctctgcctcccaggttcaagcaattctcctccctcagcctcccaagtagctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgctgtagttcaccactacctcaggagttaaggtgggaggattgcttgagcccaggaggtggacgttgcagtgagccaagatcacgccccactgcacttcagcctgggtaataataaaaccctgtcttaaaaaaaaaaaagtaatatgtagaaatgtacctcatttcttttctttcttctctcttagagagagggtcttgctctgtcacccaagctggagtgcagtggcacaagcatagctcactgcaaccttgacctcctgggttcaaacgatcctcccacctcagcctcctgagtagctgggcccacaggtgcacactaccacacctggctagttatttttattttttgcagggatttggtctccctgtgtgcccaggctggtttcgagcccctgggctcacgcaatccacctgccccagcctttcaaagtgctgggattacaggtgtgagccactgtacctagcctgtgtttcttttttatggttaaagtatgccagtttatgaatgtatcgtagtctgttcaaccagtcccctactgatgatcattgagattgttgccagtgttttgctatcacaatagtgctgcggtgagtagctttcagatacatcttatatttttgctagtgtgtcattgggatggtttctggaaagtgggattgctaggcgaatggcttaatgcatatgcagtttttctaaagagttcatgcaattattttaaaattagaagtctctaggggaaaacaagtgttttcaatacttgaatgcctggtatattgtccctcttttacctcaatttggaataatctctacatcataactggtattcatacagtgacagagggagtgtttttagaaatttatagctgtttctaggtgaaaacactggttgatttagctcccttggtaagagcactgagcagaaagaagttccctatcaaatgggtgtgtggagcagccctgttctccccatcccgtagagctccaggaagttaaccagggacttcagctgcgacctgcagatttctaagcccccctgttatttctctgtcttttacgggcctgtgtatttcagacttggtggtggcagtcaacggggtctggatcctcgtggagacatttatgctgaaaggtgagccccgctcagggactggccgtgtcctggccggcacacctggcttacctgtgagctgctacttctctgtcttacaggtgggaacttcttctccaagcacgtgccctggagttacctcgtctttctaactagtacgtttccgacatggctttgctggactgcttgttttaaaattgtctgggagaactttcattcagtgtagaacctcatggttcttctctaaaacaggaagctataaagagacggagtaatcagtctgattccatctcgtccccgtttaaaactctttcgtggttgtccgctgccctctggatggagcccagatcctaggcgtgtgtgaccctccactcggctctgcagccctgctgtttgccagcgccgtgtcccccgctgcacactgttgctctcctcagcagcctctgctccctgctgctcttgcctgcctctgggctgtgcacaggggtttcctctgcctggtggtgtcttcctctaacctctgcctgactttcctgctctttccatcaagtctgagcacactgtgttgtcattccctgttggcgtctttcctcccacctagctgataagctctgtgcccccagggttgccctgcactggtcacttttgcacacctggtacccaatgcaaggcccaaggtagaaggggtagtcaggacacacctgttggatggacagatggttagctgggccctgcccagagacaggcagggaggatttctctctctttttttggggcaggatctttctctgtcacccaagctggagtgcagtggcgtgatcatagctcactgcaacctcaacctcctgggctcaagggatcccgagtagcctcagcctcccaagtagctgggattacaggcacacagcgccacaatgcctggctaatttttgtattttttgtaaagatggggtctcactatgttgctcaggctggtctccaactcctgggctcaagtggtcctcctctcttggcttcccaaagtgctgggatgataggtgtgaacccctatgcctggccagtttctcttaagcagattacccagttggccaccatctaggccctctcctggagcacctgctctcacgctgggacatgagtgaggcctgggctcagcctggagggcttatggccagcagggaggctgcagactgtggaggagcctcaaagaggagaccgagcatgggggaggatgtggcggggctgctgccgatggattccttctgtccacagtctatggggtggagctgttcctgaaggttgccggcctgggccctgtggagtacttgtcttccggatggaacttgtgagtggacagcatgtttctgacccaaagctgagactcttgaggatggccccagacccttctctgcacaccctgatcccgggccatttctggaatcgcagagggagggtctgaggatgggctgaggcctatgtctccctcaagcagccctgcccacagcccaggaactccccagggtcaggcccttgtctgaagcctctcagaccacccacaccgtccttctggaaacggcctcttgaggtgccatagactgattggctcttcctgactcattaaacttttttctcttccataaaagccacaatgcccacagaaaagaatgctcccccccttccttgatcagcagtaatgagaccccatgtggcccttctccctattccccagagcgttggaggtcacttccctgccctgttcaagttaaccggcctgtgaagtcaggctgcactcatgaggtcttgggccgcgagggtgagcgggttaacacgcagagcggagttgggaggagccgacagcacgtgtgtgccctgcgtgtctggagaggagagagggtcctctggcttggggcagggcgagctgttctcccgatgggaatctcactggaagggcctgctctcttccctcaaaaagttccttggggtcaggctggtctgcagtgtgtaaccagatgtctgttgagcggaagacgaggcctgtctccagggctgcggaggccagggctgcagaggccggggcttctttccttcttgtcgttagaccagcatggggccctttgtaggggttcccgggcatttctggccttggggtcagagcactgaggcctgacccgtgagacgcatgctgggacagggcctggccaccttgaaaccccagggtggcaggaagttcttcccgcagccggctggttcctgttggtgttgctgtgtctgggctctgtgggagggtggctgtgcacagggccagggaggggagcaggcgcaggtaggctcagggccacagggtggaccttggcctctcccctactgcaggtttgacttctccgtgacagtgttcgccttcctgggactgctggcgctggccctcaacatggagcccttctatttcatcgtggtcctgcgccccctccagctgctgaggtgatgggcagggcagagccggagacagggagaaagagagggaggacgggaatgccccaggattgatccgggaagtgacccagaatgagccagaaggttcacaagccagagtcacagatgtcaccccctggagaatcaccatggggtcaacatccccacccctgagggtgtgcaggctgcctgtgcccttcccctcactgcaccaggtgcctctgggcagagaaacccagcccatgactcatgtgcaccccacctgaggtggcattgcaccagcgacaggagcccatatgctcaagtcacagatcacagagccacaggtctgagggttggaagggcctttcaggggccctgcgtgcttttctggctcagcgtcttatggagaaaaaccctcgtgtgggtcccactggtttcccagggacactggagaaagtcccagacgagcctgccccactgacggtgtctcttcctaatgaggggtcccgaggtcctgtgccctcagagcctgggcttgcctcctgaccctccagctgcaaccccatccacgtccgccccatcctctcccaaggcgggacaggcggggcaggtgcggggaggggtggtggcgtctatggaggaaaagcctacccccttggcgtgtgggggtggcctggggctgctcctgagtgtccgcctccgtcccgccccctgccacccttcttcactggtgagctccattgcccccgctccccggggcacatgggcttctccccgctctttcccaggagcaaggccttgctcctgtctgagcctgcagctctactgcaaggagatgtggcctggccctgctcctcttcgtggaaggaccccgcccagccggtgtcctggggctgccaccatcccttccctcatgcatgaatcacctgagcccagctcagggttggtggcgcccaagggagtggacgcaggtggaggagaggccctcacctgtcttcaccgcatggcgtgtggaaggcggggccggcatgttctgagggcgggggctgaggcgtgcacctgtgtgtggaggtgacgggtgtcctcctcgctcaggttgtttaagttgaaggagcgctaccgcaacgtgctggacaccatgttcgagctgctgccccggatggccaggtactgccagcccccaccctggcctgcaggtccaggtgccgtgtggcagtgccccgtgggggcgggagccgagtggcagtcgggggaaaggagttccacaaaggactgcaatcgagggcctgacggggctccaaggagcctggaatcttgaccaccacaggtctcctgggcaccatttttctccactgacctgtctgacatatttagtagggagggcagggagctgtcaactcgcttaccacctgtgtctacattcacaggtaaggggtcacctgtgagtctaccttcacaggtaaggggtgaatctctgggaaaggggcatttgttcatagcgtcctgacttgagctgtttttcaccccagagctgccccacgaggccccttccccgcaggcactttccagttggtgaaccgaccaggggcatggccctgcagtcagccccacgggtccgaggaggccggggctgcagaggagccgttccctcctgccggccccgcgtcaccctgcccctgtcgccccacagcctgggcctcaccctgctcatcttttactactccttcgccatcgtgggcatggagttcttctgcgggatcgtcttccccaactgctgcaagtgagtaggccccacccagccccaggcagcctgcatttcccgggcagagggctggccagggccaggattggtgtccttgtggccttggggtcctcggggatgttcctgtctaagcaaccaccttgctttgctttcagggcttagttgagtgcagtgagctaaatgaggggcctggactcggggtccctgtttctccatcccccaggcagggttgggagctgtcagctcaccctctgccgagggctggaggccacccccacagtagcctgggtcccaaggtcaagtcccatggcttcctcccacttctctcctggagtggctggggacctgggccaagaccagtcttctagggacagcatcgtaggataagacagacggacacgtgcaggaaggtcatggtgctcagggatggggagcagagagtgaaatctcccatgagcactccctttctcctgagccgccacagtgaaatcactgcacactgccattcattcatcctcaattcagagagtcctcttacatttggtctttacagcctcaagcaccgatgaagaaacagttttacaaagacactggtagctttgagacccagtttgagtgtcaagcttggtctggaaccagaagcctatagcagtgggtcccagactttagagcccattgcagtcaccagggagcttagtgcaagctccagacctcactcttgtgtctgatgcatgcgtgtgggaggaggctccctggtggcccaagcactagacttttataaacattagcatggatattaacagaacagccataaaagattggaaggaaagtggcaaataagagctcctcaaaacagggccaaccttttcaaatacttgctcaggccaagtattggggaagccccagtagggaattccttccctgggactgtggcctagtgtccagcctcaagagcagatcctagatggggcaggtgcagaggaggcccttgcctctcctccctcccctgcaagcaacggtgagagagaaggccctgcctgcagcagacaacttccaggtgacagaggtgggtcaggctggccaggggatcccgccaagcccagcaggcaggaatagccaagggcattccttcagcagggacccaggcatgaggtggagagggttaggcaggaaaccaggctgcgggcagaacagaaggatccttggccagaactcggtttgtttcagacttctgtcctctctggaggtgactgatcgccttgtgaccctccctcctttctcccttgtgctccggccagcacgagtacagtggcagatgcctaccgctggcgcaaccacaccgtgggcaacaggaccgtggtggaggaaggctactattatctcaataattttgacaacatcctcaacagctttggtgagtgggaaaaatcacagggggcacattccctggggaccccacccttgtcacccttgtcaccacgggtcccagaggtggtgtagcaagtgtctgggccacactttctggaagcctccctggcccaggtggaggacttggtctgcccagctttggcagtacagtccaggctggatcctggagctcactcagttgcctgattccactctttcctgatattttctcagtaccggggaggacaagagttgcaagccttagctgggcggggtcccctcatcacagtgccacttgcagaatgggacccagccacaccactgctgctgcagctgcactgccccctggctcagactgcacacagccctctgcccactcccatgaagaggcgaacacagccaaaccgcctctccagaaaaagggtgtgcccccatgacaccccagatctgcacccagtaagatccagatagtctgatgtggcacaggctgctgaggcagagggtgtgttctcttgggggcaggccatgatgtcctgtggagccagcgccctaggagtgccttgcctggtctttcctggagctcacaacccaagcggtcatatggtgaccctctcatcttagcacatggcacccaggataggtggcaagaggccacttgaaattgactttgaagtggggtctcatcaggatgcttctttctctcttccctcggcagtgaccctgtttgagctcacagttgtcaacaactggtacatcatcatggtaagagctcgggcagctctgggggtatcttcccgccagccctggggtcggccctgggtctcccccaacccagagtatataattcttcccgtagcttgcagggctgggggtcttgagtcatgctgtgttggtgttcagtggggaggccacaggatggctgggccccaggagccacccctcccagtgttggctggactcggctgttactcccatctccctgcatgtccccagcagccaggagatgccacttagactctgggtctctgtcctgtctcgcccactgtagagatgacttttccctctagtgacaaagtggcgagcattgctgatctctttattccattccttaaactttcccgactcccagccctactgggataaaggctgccctggttctggatccagtcgtccaggggagtggccagggctccttcagcagtcaggaattagtgttaggcccagaggggcaagcttcctctcctccatctctcacaaccagccacaaatcacggtggggtctgcgaagagccggggccatggagcagcctgtgtagacggggacctgccctgcatgggcaccccctcactggctgcttcccttggtctccaggaaggcgtcacctctcagacctcccactggagccgcctctacttcatgaccttttacattgtgaccatggtaggtcccggaccacagaacgctctttgtccttcgtcttccacatcaccagctgcccctgctcttcagcctgcagcgtcagggagtggggctgggtcccatctggccggactctgttgggcgtgggctgcgcagccacggacacctacccaccctcctcccctgcctctgcccctccctccctatccctggccaggtggtgatgacgatcattgtcgcctttatcctcgaggccttcgtcttccgaatgaactacagccgcaagaaccaggactcggaaggtctgtgcagggatgatgccttgggcatttgatatctgccgcctacccagctctgtctgtctgtctgggtggctgtccagccagccatcaggctgtcatttttctgctgtctggctgtccagcttatctatctggcttgtctttctagatcttgtatttgcattgattttcaaatatttaatgtcagaaaacgtaatctaactttaaaataagacagagcatgtcatagttggagaaaaatcaagaagtagagaaaggcttatgtggcagcagcagcccctgccctgcctttccctcccgtcctccagaggcttctccttcttggctatttcttctgttagtcatctccacgtttctcaataataggttcacactacggttcttgatttaaatggtgtaaatattgcttatggcacaggcgaatcgtattcctgctgcaactggatggtgctggctttagtgactgcctcactcttcccagattgcacagctttctgtgtgctgaccctcccttcttcccaaattctccatcaaaactgtctgcacttgatctcttgagcccaggaggtcaagactgcagtgagccatgatcacaccactgcactccagcctgggcagcggagtgagaccctgtctcttaaaagaaacagaaaaccctgtgcccacacttgttacctctcatcctcagatctctgtgctatcagaccatctgaccattttctctgtgcttagaggccccttcctgaaaccctctggccctgtaacagctgccagctagacctgcgctcctgacatcacagcagagggaggggaagggaaaggagggccaacgaggagagcaggacaccaatgcagtgtcggtttagagagagaaccttaagaccccctgcggaagggggcaaggaggtacgagacccagccaggttggcagctgcagccccgggcccttcccacacctgccttccatccctgcagttgatggtggcatcacccttgagaaggaaatctccaaagaagagctggttgccgtcctggagctctaccgggaggcacggggggcctcctcggatgtcaccaggctgctggagaccctctcccagatggagagataccaggtgaggagcccaggccctggtccgaaggagggaggcaggtttcagtgtgggtggcataatcccttccctcagatattggtaacattttgagtgacacagttgcaaaagccagagaagtgggagacgccaactgtggcaccaggggtgggacctgaatatctgcagccgagccctgcagcctctgctcttccttagcaacattccatggtgtttctgggacggcgatcaaggaccaagagcgacctgagcctgaagatgtaccaggaggagatccaggtaggagcctggccgaccacgctgcgaatcctcccccaagctatgtcctgggaggggcagggagctgctctctggccctctgagtagagggagaaggctggtagagagatgcagaccgtccatcgggaccactgctggggttgtgtgggacctgagcggggctcacttagccttgaacccttgactcgtgcccagcagaggcagctctccagcctgcctgccgccatatgtccctgccccttatgaattctccagaacctcctctccatctcttactctgagtcagctgcaaactcaaacatgtgtactaagaaacacagtgagcaaagaggaaagagcggcgaccgtggtgaactggcaaggatgtccctgtccaaaggagacagtctcctcccagctccaggatgtgcctgtccaaaggggacacagcctcctcccagccccagcgagtgctgcccaataggaagaaggccctactgcggtcgggctgcttggtgttttgttttgagatggagtctcgctctgtctcccaggctggagtgcagcagcacgatctaggctcactgcaacctccgcctcctgggttcaagcgattctcctgcctcagcctcccgagtagctgggattacaggcacacgccaccacacctggctaatttttgtatatttagtggagacggggtttcaccatgttggccaggctgggagtgcttgggatttttcataattgggtgttttttgttttgttttgttttagagatggtatcgctctgtcacctgggctggagtccagtggcgtgatcatagctcactgtagcctccaacccctgggctcaagtgatcctccccactcagcctacccaagcagctggaactacaggtgtgcactgtgacaccctaattaccttatttttgtagcagtgaggtcttgctggggtctcaaactcctggtctcaagcaattcttccaccttggcttctaatttaagaaaaggcaggccaggcatggtggctcatgcctgtaatcccagcactttgggaggccaaggcaggcggatcacttgatgccaggagctcgagaccagcctggccaacatggtgaaaccctgtctctactaaaattacaaaatttagccaggcctggttccgtgcacctgtaatcccagctactgaagaggctgagtcaggagaattacttgactccaggaggcagaggttgcagtgagccaagatcatgccactgcactccagcttgggtgacagagctagactctgtctcaaaaaaaaaaaaaaaaggcagaatcagatgtttttctttttttgcatgacctcccaatctttacatattggcagctaaggaaaatatctcacaaagcaccgtgtgggctggcatttggcacggtgccttccagaccatgggccaccagcccatgagccctgcagagtcttctcaaccacctcagggttgccagggctccggggagcctctcccacaccagctatggtggctttgctctgttttctggcattctaatagcttgaagcccttctgtttcactaaaacagtgacaaccagggtccatgcctgaaaagcggggggtgctgtccccaaagcagcttacacattctccgggaacacaagagactcaggcagtgttctttgggctgatgtgtagtggctcactgaacttggtgtcacagaaacatggaaataatagaagcgtttgaccttgggcagtcactccatgcctccctgtctgtgcaaggggatgactgtgcagcagcacccattcaggtgtggttggaaggaggtgtgctgcccttggcctctgcccttctgcctgtccatctgctccaggcctcagtttccccctctgtaaaacaagggggccagaactaggccatctcgaagctctaaaagtctatggttcagtcttttaaaaagtagggtagggtatggtggtgcacacctgtatttccagctgcttgggaggctgaggcgggaggatcatttgagcccaggagtgggaggctgcagtgagccgtacctcgccactgctctccagcctgtgccacacagtgaatctctgtctcctaaaaaaaaaaaaaaaaaaaaggaaatgtggggtatacttaattccttaattacctgaatacctcagtccctgaaaatgtcagagtttataatcatggccttaggcaggtgaggtattcagcacaatacagctctaagcctcggtgtctcgggtgtgaaacagggacacaattcctgccaagctcaaaaggggtcactcggggggccctttagtgaaggacaaaaggttatgctcacaaacaaggggtgagggttgttcctgcctgggcctgttagagagctgttatgcgcaaacctccagacactagggaaagatttcattgtcatttttgcctctggggccacattcaaaattcccagcatttctgggcctgtgacgggggtttcagtaccagctgggtgaggctggcagccctgccccttccagcctggatgctgtgggctgtgtgaccttgtggggtgggcggggcagggggtggggtgcagccctcagcaccccttctgctctcttctccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccttctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaacatggctgctgcctcttgacttctgtggctttgggtattgtcgggagagtggccccatccaaggccatggccattcctgatcctgcctcagccccaccccgagctgtgccctggggtcagccacttggcactggccccaggtgaggaagaactggtaaaagttgggggtgtcattttctctacacttgaaattttgactttttttttatttggaaaagagacagttgaatcccttttctttaccagcataaggcagtcaggcaaacctaagagttgcttatttcggcaacataaggcggggtcattgcatgacagcaagaaggcacgaggtcccctcatctgtcctttcccagctcgcaggccttggaaccccgcccagggccccgctgagggaggcacaggcacagtcctaccgactcctgcctggcagctggaggagcccaggttccagcacaaaggagtctgtggacaggcaggggcagaatcctggagggagcgcctgagccaccatcccatgtggcagctgctggcgtagcagtgcctcgggctggcatcgttttggaagcaagtgggttcagtgaagtgtgttgccacgaatagcacccgctgcttttggctttattaacgtggcaaggagaaattcaaaattaagtatgtctcgaattctgtttgtggcagatggtgcggctctggagctcagccctcggcggcctgattcccaggggtccaagccaccctcattctctgagtcagggttgggcagccacttgtgtcctgagaaggtgccagaaggcctgaagcccaggcaaggggaacgggcagtgcctgtgcctcgggggtacctccagcatggcctggagcacatccagccatccccttcccccaaactccagcccttctcagaggggctctgggggtcattcaagggggacttctagcttctctctggaaccctttgtccagagcaaagccaggtttccaaggtccccacggcaaggctgttgggtgctggcagcaagaggtacacagcagttctcccagctcacagcagtgacctcagatctccagcagcaagggccgcactctcgtgcccacaagggccttgcagaaatgctccggtccctgggcctcccccggcaggaggggcggggctcctgcctgcagtgaggccacagcactaagcggcttcagtcacatgcttttcaggtgaatcactccaaattcagtgaggagggccacgacaaggaagttcaggtagaagaggagcaggcagaagccatagactctgctgagctggaagcactgcaatgggactgagaccagggagaagacgaggctgagccccagggcgcctgccaggacccacaccagcagtccgtctggctccagctgtggaagaatgaggggagagaggctgagtcactgcccgtcacaggccccgccccgtctgtggccaacacaacaatgcagcctcaacaacaatgcagcctcaacaacaatgcagcctcagcaacaatgcagcctcagcaacaatgcagcctcaacaacaatccagcctcaacaacaatgcaccctcaacaacaatgcaccctcaacaacaatgcaatctcagccgagcacagtggctcatgcctgtaattccagcactttgggaggctgaggcaggtggatcacctgaggtcaggagttcgacctgtattggccaggagttcgagaccactggccaatacagtgaaaccctgtatctactaaaaatacaaaaattagccagacatggcagtgtgctactggggaggctgaggcaggagaatcacttgaactcaggaggcggaggttgcagtaagccgacatcgtgctactgcactccagcttgggtgatggagtaagactctgtctcaaaaaataaataaaataacaacaacaacaacaacaacaatgcagcctcaacagtgtttgagggcaccagctgggggccacttaaggaagactggcctgcagcagcccggcctgccctgtgggatggcatgccccaccctgaagttacccagacgtggccccagaagtttccagacgcagaaacagcagggaaaaggaaccttctcttccaacttcagccaggtccacctgcctgggtgcctctcccctgcctcgagtcagatgtcattataattccctctgtttttaatgctgaactctagtcaacgacatgcacaagcggatgttcaccacttactgtgaaatgcatcaagaaacaatatggatgcgttaggccgggcagggtggctcaggcctgtaatcccaacactttgggaggccaaagcgggcagatcacttgaagttaggagttcgagaccagcctgaccaacatggtgaaaccccgtctctattaaaaataccaaaattagccaggtgtggtagcacatgcctgtaatcccagctactcgggaggctgaggcaggagaatcacttgaacctgggaggtggaggctgcagcgagccaagattgcaccactgcactccagcctgggtgacagagcaaaactccatctcaaaaaacaaaagaagaaaaaagaaaagaatagatggaggcatggacagacaggcatggacaaacagacaacaaagcaaaggcagccaaacataaacagtagagtctgggtggtgggaatatgtgtgtctatcatacaagtcttttaactgttctatgtttgagttttcataataaaatggaaaaaatctttataaggcttttttttttttttttttttgacatggagtctcactcttgttgcccaggctggagtgcaatggcgtgatctcagctcacagcaacctctacctcccaagttcaagtgattctcctgcctcagcctcccgagtagctgggattacaggtgtctgccaccacgcctggctaatttttttgtatttttagtagagatggagtttcaccatgttggccagactgttctcgaactcctgacctcaagtgatctgcccaccatggcctcccaaagtgctgggattacatgtgtgaaccaccgcacccagcccataaggtttttgaagaaatggcagctataagtatctactgagtgcctgctctatgccaggcattgtgcgaagggcctaacaggcactgtcgtctttgatctaacaatagtcttgtatggtgggtactaggatggactccattttacagatgaggaaaccaagacccttagacttgactgacttgtccaaggtgctcagcagcactgggcctggcacctctgcctgactctgaacttgggaggatgccgccttctgggtgaaggaggggatggatgaatgataaaggagtggcagcagcagaaatgaatgagcgagagccaaagtgtcaggcacaagacaggctcctctgcgggaggaggagctgacagcaactcccgttctctagaactggggaggagcctgcagatttcagctgcaggtttttatatgtgtagtaggataagtagtgccccacccccaacaaattcacgcccatccggaagctcagcatgtggccttacctgaaatagggtctttgcaaatataataagctaagggtttcaagatacaatcatcttggacttagggtggcccctaaatccaatgactcatgtctccgtaagaagaagagagagatggccatgggaacacagaggcagagactgcagagatgggcccactgggcaaggaacgtcaggagccaacagcagctggaagaggtgaggaaggatcctcctctggagcttggaggtggcactgcccggctgatgccctgattgcaggcttttggcttccagaactgggagagactcaatttctgctgttgtcagccccctggtttgtggtcagttatggcagcactagggaactaacactatctatggtatacatgtcacacatggttgctgacatattttcaagcagtacagaagagtaaaagggactgaaatgtcccctccccgcttctcttccttccacacttagcaggtatatccaacacgcagtgaagacatgaggtaccgtgtgggctgtttctaggcaccgtggcgtttcgtcttcccagccacctgcatcctcctcgtctccaacccacagatgaagaaactgacagagtaagtgacagagcccaaatccaagtgcaagctcttaaccaatgcctatcctcctccccatgggatgccatattacacacgcctgtggacacacacacctctagacatgtacatcaattctgaaaacagagatgggaccgtacaataggtaagtgtttcaaagcgacttgtggttttcaaccaacggtacaccatggacatccttccatgttgatgtctcatgccatttaacggcaggagcgtttcctaaactcagcacaaaggtggtagacacacgcgcacacacacacacacatttcctaaactcagcacaaaggtggtagacacacacacacacacgtacacacacacacacacttcctaaactcagcacaaaggcggtggacacacacacacacacacacacacacacgcgcgcgcacaggagaaaagaggaaataggtcccctgaggagccaaccctaaagcctcattacctggaactaccctagaatctatcatgaaagggaacctattaaacccataaagagggacaacaaagtttgcagagggtgtttacctttcagaaaagaaaatttcaagccctaagtagctgtttgcttgtgggcatggccagtgtgaaagaaacaccctgcccccggctaacaggctctgccgagagcctattcaacaactcgtgcctctgggagaaacgggtgactttattcagcttcataacactcaaagagctttcccatggcgaggcttaaaaccaacccccaggccatctcttcctccccagcctacgtcttccttgctgagtctctggactcaagtcctccagaatagagatgcagggatgggactgccagcggctcaggggtccaatctgcctcatatgcacagggttttgtttgcatgtgaggcagattttcgaatagaaaaaaattcacttaggaatcttgatttcttctctagaggacctggaatatctggccacatgctacctacccaaatcacccacacatctctgtcacctcccctgtgggcagtgctgggatatggtgctcagtctggcccttccgctgcgtgcttatccaggaagctcagctggtgtcatcaatctcattttataggggaggaaattgaggcccagagatgtcctaactccattttttccctttttttctgagatgaagtctcactctgtcgcccaggctggagtgcagtggcgcaatcttggctcactgtgacctccacctcttgggttcaagtgattcccctgcctcagcctcccaagtagctgagattacaggtgtgcaccaccacacctgactaatttttgtatttttagtagagatggggtttcaccacgttggccaggctggtctcgaactcctgacctcaagtgatcctctgcctcagtctcccaaagtgctgggattacaggcatgagctaccacacccggccaagatgtcctagctcactcaaagtcatacagccagggacttaagtgatgggacccagatccaaagccagggccttcctgccccttccccatcaagctacatcttggttatatacacttgtaaacttacaaggaatactcaccttcacttctgtgtggcttcgggagatctggagcaggcagcccagccccacacccacgaggatgtctgcagcccagctcaggaagctttgctggaatggcctgcacataacccaaccacatagcccgttcctcctactgtgttcatccccagggcttgggatgccactgcaagaatgaacttgggccaggcgcagtggctcatgcctgtaatcccagcactttgggaggccaaggcaggaggatcactagaggccaggagtttgagaccagccttggcaacagagtgagacccgtctcaaaaaaaaaatttggtgggggttggaggtagagaagtgcagtggtgtgaacacggctcactgcagcctcgacctcctaggctttgtgattctcccacctcaacctcccaagtagctgggatcacaggcatatgccaccacacctggctaattttttaatttttctgtagagacagggtcttgctgtgttgcccaggcaaatctcaaatcactggactcaagtgattctcgtgcctcaggctcccaaagtgctgagattacaggtatgaaccactgtgcccagacttacaaaaaaaaatgaatttacttggctttctttatgatgtatgcccaactcccccaaacaccatatctgaggagaccctatctttttaggcctttaagaagatgggtgctgagtaagtgttgcagtcagtctctaaggatcgaacaccttagggtgccaggaatgcttggcgcatgtaagcactcagtaggtggggaaaccgaggccaggagagatgaagggactgcccccagtccctagagggaactggtgatagtgtgtgggccgaggccatctctaggggtcgttcagggctccctccttcccagccaacctgggaggtcaggcgaggctgcagcccgaaagccaggagtaggcctcagtgggcgcaaaagggccaccaagggccttgctcagcctgggagttaaaagggcaggcatcactgtctccgcagttagcctgttttgccggccaactgctcacactgcagcccctggtgaggctctgtcatcgtggagcctggagagagcggcccttcaggcactttgtgatcatctttctttctttagcagccaacagtatccactgctggccgaatgcctgccgtgcgccaggcactgtctggaacccacaaccatctggtttcaaagctctttctcttcatagccccaggctggctatatccgtcttttctatatagaccaaaagttggcaaacatcagccctccggccaaatttggcccactaactgcttttataaataaagttttattggaacagagccatggccattcacttatgcactgtctgtgcctgtttctgcactatagcagcagagttgagtagctgcaaaaccgcctgcatggcccccaaagtctaaaatatttattctttgggccaggtgtggtggctcacgcctgtaatcccagcacttggaggctgaggctggcagatcacttgaggtcaggagtttgagaacagcctggccaacatagtgaaaccctgtctctactaaaaatacaaaaattagctgggcgtggtcgtgggcgcctgtagtcccagctactcagaagactgaggcaggagaattgcttgaacccggaaggcagaaattgcagtgagccaagatcacgccaccgcactccagcctgggcaaccgagccagactccgtccccaccctgcaaaaaaaaaaaaaaaaaaaaaaaaaaaagaattctctggcccttttagaaaaagtctgccaaccctaacatagaccatgacatgtcgctatgagcaagagagagagggtcttccataggacacataagctcatcctatgggcacctgcttatcacaccactcactgtcctaacaataatagctgctgtctgctgagcccttaccaggggccaagaatttcattcacctcactggatccttacaacaccacttggaggttagcactccccaaatccctattttaaagccttggagcctgaggctcaggcagccacattacctgccccaggtgttacaccgagaaccaatccccagggtggggcatggagcacaccccacccacggctgtgacaccagtgctaaggccaagaacagaccacaaaggatactgaagatgatgccgccaaagcaggcggagaacgccatccgtgggtagccctggcgagccagtgtgaaatccgagaaggcatctgcacaggaacaagaggggcctgcagtggtgagtcgcttcccccaccctccctggtcatccacgccttcattctcacccacggtcattcaggcaacaaacacagatggatgcccaagtgtgcctgggcactagctggtggggtgctgtgtgagggggcacagcatctgggaagacacacttccctccttaattcctttaccccactctttcacaccaggaacaactttgcaggtgtgaaaaacgcggctaccagctgggcacagtggctcacacctgtaatcccagcactttgggaggccaagatagatggatcacctgaggtcaggagttcgagaccagcctggccaacatgatgaaaccttgtctctattaaaaatacaaaaattagctgggcatggtagtgggcgcctgtaatcccagctactcgggaggctgaggcaggagaactgcttaaacctgggaggcagaggttgcagtgagccaagatcacaccattgcactccagcctgggcgacagagcaagcctccatctcaaaaaaaaaaaaaaaaaaaaaaaaaaaaaaaaaaacctacggctaccaatttttcaaagtctcatctgctggtaacatgcacagcacctccacatgaataagaagaaggtgctcaaaaaggtaagtggaaggaggggctagatttcagctccctcatcctcttgtctggatgctctggagcagtgcataacctggccaaccacacctggctgctacagctagggaagggtgtatgtatgtaagtgtgaatgcctgcatgtcacacacccgtgtacacatcaagcacggccggctgcaatgggctccatgtcctgcctgaactctgggagccaccgaccatccccgcatcagagggtggggaagaggcaggggcctctatagagtttcttggtccaactgcagtcagggccatctcaccccaatgctggccactccacagtgacaggggacactgcacaggtgcagagggcagacaccctggacactcctgcccagatgcgactctggctgggggaggaaagagctaagatgtggccgcactcacccccactcaaccccacccagccctgagtcacctccaatgctgttcccccaggccagcagcgtgagccccagcacagtgttgctcagccggaagaccacacccagggaccgcaagatgttcaccacctctgtggcggccgcgttgatccacagggcgctggtcagaaagcccaggaaagcaaagagctgcggagggaatggtttgctgtgggaccaaggccagccccaacaggaacacagcctcagttcctcacctgtgaaacgggatgataacagtatctacctcatgagcttattatgagtataaaacacgttactatatgcattggtgcctgtgcaaagttagtgctcaataaaacgtgagttcaatattattttcttttttccttaataaactccctttcaggccgggcacggtggctcaccgcctgtaatcgcagcactttgggaggccgaggcgggcagatcacctgaggtcaggagttcgagaccaacttggccaacatggtgaaaccttgtctctactaaaaatacaaaaattagtcaggctggtgtcacacacctgtaatcccagctactcgagaggctgaggtgggagaatcgcttgaacccgggaggcagaagttgcagtgagcctagatcatgccagtgtactctagcctgggcgactgagtgagactctgtctcgaaaaaagaaaaaaaataaaaacaaaaaaacctccctttcatatactaaaaaaaaatattattttgtctggaaagggttccttatcactttcatcagatttccagtctatgaaccaaataccacccatcatcccaataagtatccctgtactcattagcggtcactccctagccccaccccaccagcccaactcgaccactactctgctctctgtctctctgaatgtgcctcgtggacatttcacatcaatggaat

SEQ ID NO: 689 - DNA, 1642 bp, Homo sapiens
ttgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccttctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaacatgg

SEQ ID NO: 690 - protein, 146 aa, Homo sapiens
MTSERGGGRRVASCSDPATEAGSVQRSLWFRFPGPQNGTQHRFCSRSRSGRMEGAKGKECTAGHSWPAPALWCLLPVTSEGRWTEPPSGLVLFPATERAGWHPTPGEQYLVPHPLLPTTSKAKLGPIASTAWFSPSPLPRSGELDK

SEQ ID NO: 691 - DNA, 28533 bp, Mus musculus
  misc_feature (1)...(28533): n = A,T,C or G
ctaaacatctgacaatctgacatggcgggctaaggggctgcttcactatttttcagagttttccttttataatcatcttgctgaggacagcacttcacataaaagcattgtgcaagatggcagacatgcatctcaggccatttcagaaactccaggacatcatgtcttaatctcaaaccaggattcatttaaggactttttgtgaaacttgagccaacagcccaagcagcaatttaatgaattcttagttctaggatgggatctcaaggtgtggacctggtgtggaactcagtgtatagaccagactgacctcgaacccagagaccacccgcatctgctaggactaaaaccatgtgccaccatgcctgcctcccagcagcaatttgtaaaatgaaacattcgtggctggagagatggcgcaaagggtaagagcactgactgctctttcagaggtcctgagttcaatacccagcaactgtaccatctgtaatgggattggatgccctcttctggtgtgtctgaagacagctacagtgtactcataaataaaataaatcttacttatttattgtttggtttttcgagacagggtttctctgtgtagccctggctgtcctggaactcactctgtagaccaggctggcctcgaactcagaaatccgcttgcctctgcctcccaagtgctgggattaaaggcgtgcgccaccacgctaggctaaatcttttttaaaagtgagaaagagtagagaaaggtaacattcgtgccattcacttaaaaaaagaaaaaagaaaagaaaaagaaacattctaacacaaccccaaccaaaggcagcctgacttgatactctcttgctgggcagggccaacaatctctggtttccatagggaagccatcctgtttctacaggaagagaaaggcttggacctattgtgagaacactgcacgtgttatccacgggactcatgaatttgagcagggtgctccaggaagaggtaaattaaagtgcaaagcctgtgtcaggtaagcttcgacagaaactccgcacatcccttacaaatttggttttgagttttcacccttgctgtgtgtttagaaacctcaggtagggtgacacccgctctaagtgagcaagggcccttcccgtgccacagtcacacaatcccttctgtgacctctgcgactctttaattactcagcggcagggaaggaaggccgcagcaggccctgagcaccacctgaatggaccagaagcagccggcgcaaagtgggggagggggcagggcaaaatacatacagggcatttgggaccaggagcagctctacaaccaccgtgctgtgtgactttcggtcaacctttggcctctctgggcttccgcttcccattttgaaaaagaaaaggaaatggcgtcctcctcctataggaaaaacacaaaggatgggaaatgtgtagtgatggtttccctgcagatgtggagaagttcaatgaatagcaataattagtgggtgcagcctggggtaccagtgaattggtagactgcttgcgcagcacacaaagccctggattcaatccccagtaccatgagaaaagaccttagacatgtagtcccagtgggtgggagcaagagggtcagaagttcaaattcatcttgagctacataatgatcttgtggctagcctggagtacatgacagcctgtctcaaaaaacaaacaaacaacaataataataatcagaaaagaaggagggcttactagcagctgtaaaaccttgagtaattctcatgacttttctagtttgaccttgtaccaaacagccacggatgaactaaaccagcactttgccccctttcactacatcccgttgtgctatttccaaacacagaccccatagtctgtaagattttgtcttaagctctatttagataattattatacactttcggagaaaccctgtctcaaaaaaccaaaaaaaaaaattattatacactttctaattattaagtaattactattagaaaggatttttaaatggtaacagtatttactggcaaaatagcacccaaaaaccctagacctagggatagcttcaggtaaagcttgatctaggagctgttccaaaggacccatgcttttttggactgtcagcttcatctcctgtgataattccaaggaagccagagattccaggcatcgctggcttttctcattcgtaatgaacagaaaacagtttgtttcccagtttgttatcaagaggagaagacccagaattgagtcacactgatgattgctggctcatctaagttgtgcctgcatcttttccggaccgctgattatagactgcaggatgagatttttctaacttgtttctgcagagcagaccccgccccttgattaggccacttctgaccaagttccacggctaggaaatcctctgttaggtggggtgagacgaagggtgctatagaggctcaaaggagctgatgtcagtacaggacacccccagatcctataaggcaatgaaatatagcctgtgacctgtcctcctagccccactccatcctccaatcctgtggctttcctcacagacagcttagctggactcccaccccacaccccacccccgcatccctgagtgcccttcagcattgagtcctcagcacatgcatagccttttcagacaggaactcttatgagctggcctcagaaaggaggggcagaagtcaggcggtggtggtgcacacctttaatcccagcacttgggaggcagaggcagggggatttctgagttcaaggccaaggccagcctggtctacaaagagttccagaacagccagggctacacagagaaaccctgtctcgaaaaaccaaaaaaaaaaaaaaaaaaagaaaaaagaaaaaagaaaaaaaaaagaaaaagaagaagggaaggaaggaaggaaggaaggaaggaaggaaggaaggacagcagaggtggccattgcaaagcaccatgagtgcttccaggcactcctctcccacaccagttcacagtgtgcaagctctggccagtcctcagcagccacaggcagagagaggagagagggcgatgcctcggctgggctggcgagtcagcaaggaaatcttccaagcagccagatctctccacattggggcacctcgaccagaaaacatgtcttctagaaacttcctatacattactggagttagggaattcactctctagttggggcccaaccctgctgcgtgcactcaggactcccacaattctccctgagcccttcagggcagtgattttgggtgatagcctcttacttgccttcaggcccacctctttttggaggttcaaacctttcccccaccccacccccccacaccnnnnnnnnnnnnnnnnnnnngagagtcacagggacacgggcccagtatgcagttgatgctcaactttgtacaaatagggccagggatgcatagggtggagaaagccagcctcaccctgttcccagcatgacctaagtgaacccagcaagccagggcaaggcctccaatatgcaccagcccctggtctataaaaaagtttccggtggaccagcctgcagggacttcccagtcggctgggccattcaagcatcaggaaggagggagctgaggcaaatagaccagggtagcaaggagaagggcaggcagaagaagggtcatctaatcaaagacgccagacaaagaggcctcaaatattgcctttggatggtgtccctaacataggtaggattcaggtacaggaaaaagtaaccagcagagatcagtgaaggcaggatcgtctcaggctaatcaccgaagcacacctctcaaacaagtcagaaaacatgtgttttccttttccagtgtgtgtgtgtatgtgtgtgtatgtgtgtgtgagtgagtgtgtatatgtgtgtgcatgtgtgcctgtgtgtgtgtgtgtgcacccaagccatgtgcatgtgtgagaaacacattgtgtgtcttcttcaattgcttctccagctcattcttatttatttatttatttatttatctatttatttattttgtaccaaatgagtgttgaatgcctccaatcacagcttccagcaggcagactctgtgagttcaaggccagcctggtctacattaagttttaggctaaccagagctacaaagaaatatcctatcccaaaaagaggaaaaggagggcggaggaggaggaagagatagagaaggaagagagggaggtgaagaaggaagagagagagaaagagagagagagaggggtgtctgtctgcatatatgtctatgtaccatgtaatgcctcctgtacacagagaccagaagagggtgtctgattcatcagattctctgggcttggagttacaaattgtgacctgccatgtaggtgctgttaaccaaattcagatcctctcaaagaacagcctgtgctttaacccctgagccatttcccccagccccctccagcttattctttgagatagctgaacctggcatcaaaatgtctgctctgtgtcccttgtgaacactgctctagctggagatgttggagctccaccagcccagcacccttaaccctgtgcctttgttccgtggttgactgtcctaagtgtctggctctaggaggtaccacaggctcacctttccccgtctcagccgctctgctgctctgaagagacacatacttttagccatacaaagtgacacatgcctgtgagcctagcactcaggaggcagaggtagaggcagaggcaggattgtcacaatttagaggccaagttgatctatataatgcagtgattctcaatctgggggtcgtatatcagatatttacattacaattcataatagtagcaaaattacaattataaaatgctaatgaaaacaattttcttgttggggtcaccacaacatgaggaactgtattaaagggtcccagcattagaaggttgagaaccactgctatagtgtgttttaggatagccagggccacagagtaaaacattgtctcaaaagaaccaagaaattaaaacaaaaagaaacatttttaaaacaagctaataacacaaatatattgcatcatatttgagaacttgataaaaattaattgttcggttactgtttaaaacagaaagaacaggaagaaggcttagcagttaagatttgaactccaacacccacatggccagagcagtctgtaacaccagttccgagggatacggtgccctctactggcctccttgaatattgcatgcatgtggtgcacagacatacatgcaggcaaaatactcaaacagcaagaacaacaacaaaatcttaatattttcctttttaattaaacatacgggttggcgagatggctcagagggtaagagcactgactgctcttccaaaggtcctgagttcaaatcccagcaaccacctgtaatgaaacctgatgccctcttctggtgtgtctgaagacagctagtgtacttaacctataataataaataaatctttaaaaagaaaacaaaacaaaaaatataccggagccagcaagatggctcagcaggcaaaggcacttgatactcaagtataacaacttaaattcaatccttggatcccacataaagactcagaggcccccacagcttacaggcttggtagctgaggatcccacagaagcctcttctcagcttacaggaggccttgatagctttatagtcacttaactaaggcatgagggtcactgttaaggcctctagagagatccagctcttttgttatccccaagccaggatcatttctagaaactttccctcgccagccttccccacttagccctaaggagtgacgatccagaagtttctagaccttctccaggtgacaaagaacagaaaaactctaggaaggaaattatgaagcctagtccccaagataggcatgcaaaaggcagaatgggacatgggtttggggtcaacagatctatagggctcctgggagctgggccagagcttgcaaaacccagttgtaaacggagcatggtttctcaggaatggccagggctttctgcagaagagggtgtctcaggaaggaatcatcatcacaaaccggaagagagggagactgtggcttacgggttgctgcatgactcatcgctagccctgccagctgcctctgttaagtgctggacagcacagagcctgggaacactggtggaatccctgtctagtcccctcaccagaagaggacccaggcaggtcagtggctcttaacccagatgtgtcacttaatatttccaccatctgaaaggtggttaccatagagaatgatgctcactaacactgagcccagatgcaagaggggatgcaggagatgatggtacagtacactgagttcagcaggactgaccgtgagcttgccacgtgtttagcaccggtcacgagctagcactcaacaaggacacattgggttccttctctgttcccaccgtccagtgccagacaccaatcaatcacatgtctatgtgtcttggtgacaccagtctcaagaccaaccagccacgtgtacttcttcctccctgcagcctcccatagcttccacaaccaggtatccaagggagatggatgcagtaaggaaggctgcagaatttccagccccaccgactccaggtcttaactttacccttctcatccttctagtgacactctcaactctatatgagggcaagccatggtggtgtgggtcagtaatcccaagactcaggacacagacaggaggatcacaagctagaatcaaatcttatctacatagcaagacactggtttgtttttttgttttttgttttttgtttttttgttgttttgttttgttttgtttttttcgagacagggtttctctgtgtagccctggctgtcctggagctcacttttgtagaccaggctggcctcgaactcagaaatccgcctaccgctgcctccctagtgctgggattaaaggtgtgtgccaccaccgccgggctagcaagacactgttgatggattactatgcaaataagaaaagaaaggaagctgctgtgtgtgtgtgtgttccacgccttttatcacagcacttgggaagcagaggcaggtggatctctgtgagtctcagaataaagtatagtatgcaggcaacagacacggacttttatcatcataagcctgtatgaaaagggagaccatgtctttttttgttttgttttgttttgtttttcgagacagggtttttctgtgtagccctagctctcctggaactcactctgtagaccaggctggcctggaactcagaaatccgcctgcctctgcctcccaagtgctgggattaaaggcgtgcaccaccacacccggctgagaccatgtctttataggactctagttacctaaaactctaaacaatgcagtgttaacacaaggggacaatgtgagggaatggctggcacagattcaagacagaacttcctccagaccagggaaggcggtgtgatagggacgcccaaaagtcctcaaaggcaccttgttttctgttttgttttgttttgttttgttttgttttgttttgttttgttttgttttgttttgtttcgagacagagtttctctgtgtagccctggctgtcctggaactcactctgtagaccaggctgtcctggaactcagaaatctgcctgcctctgcctcccaagtgctgggtttaaaggcatgcaccacgatgcccggctggcacctagttttcaagttagacaatagatacctggaaagccaggcagggtggcacattcttgtcaccacagtatgcagaaggtgtgtgggggggttaaaattcaaggataacctctgctacatagtgagtcaaagctaggttggaatccataagacccagtctctaaaaccaaaacagggctggaaaaattgccacttagaacacttgttgctcctacagagaacccaggttcagttcccacatggcagctcacaacaatccattctccagttctggggggaatctgacctcccagggctccaagcatgtacgtggtatacaaaattacgtgaaagccaggcagtggtggctcacgcctttaatcccagaacttgggaggcagaggcaggtggatttctgagtttgaggccagcctggtctacagagtgagttccaggacagccagggctatacagagaaaccctgtctcgaaaaacaaacaaacaaacaaacaaacaaacaaacaaacctgcaaaagataacagagatgcagctttaaaaattattgttgggagctgaagagagaactcagtgtttaagatcactggccactcttccagaggatcctggtttgatttccgacacccatgttgaagctcacaaccatctgtaactccagttccaggggtcctaagccccttgtggcctcctggggcaccaggcatgcatacaaaattcccatgcacatcaatacggtaattaaaaactaaataaagtcaataaaaattattgttatctctttttagactgaatgtatgtagctatgttggtggtatcttttactataaaaccattttattaaaacagccaatgtccttagaagacaactgcatttgcttagacaggtgagatatgactgaagtattgacacacagtaattaattcttacttttgagtgttttggcttcctgagcctcagtttccctatatgcaagcatgctggtgacataatagactttgtcttcctgtgtgcaggtcctgggttccctttctccctctcctgggcacctctctcttctctagcacacacacatgcattcgtgcatgcatgcaggcacactgacagccaggctcccttccctctgccctgagtcactagtgtcccccagaatgctcatagtggtccctggtgctacagagtgggagctcctattttttttttccaagacagggtttctctgtgtagccctggctgtcctggaactcactctgtagaccagactggccttgaactcagaaatcctcctgcctctgcctcccaagtgctgggattaaaggtgtgcgccaccacacccagctgggacctcctatcttgatctacatggctgaggcccttcagctttttcctgcatttctcagaggtaaatggagcaagcatgataactcacacctataacctcagcacacaggatcctgatggatggggccactgggctgtttgaggccggcatgggttacatagcttgaccttgtgtcagaaagaacaacaaaagccaaagaaaacagaaggtccctgagcacaaggatctgtccaatatctaagccccaggatgataatgtacagggctgtgctcgactgagggatcttgacctcttgaggataagggacaagatgagtttttgcagtctgcttgatagcattcttcacggactctcccatggcgattggtgtcaatgtccctccttttcctggcatttcctccaccactatgcaacttgtggtggtggagccctccggtcttgggaaggtatttacttcaagaaaagtgtccctggtcctgagtgtgactctatcgctgaacaggcttcagttcacaacctatgtgactgaactggagtggccggatctctgccggctgtggcctcaacttgtgcaactagaaacctggaccaagccggtggacgtgtcaagttgttgaagtgaacctgcgaggccgttctattccggttttgcatggtgcacggaacctgcttctgcagagccggcgttaagcagtcgggtggtacaagcctggagccgcccagacttcgtgtggccaggggcgtggctagagatgctggggcgggacttgttcagaaacggggcggagccggctccgacctaccgtggggcggggcaggagggaggcggagcaggaaggggcggcggccctgcccggcttccgcgtcattgcccttaaagcacctgcccgcctgtcgcggctacgaaggtgccgtcagagcccgagactcggctccatggacaccttacagacgacgtccggcgctcagcggggtgagtgctaccgggtggaacgggtgctgcgctgcgttgggtctgactccgggagggtcgcgcgcgggcagtgtctccatcgctgggaccccgctgagttcaccctggtgcgtggaacggggtgtcttggggcacccggcgttctccgggctctagccaggacctcctcgcgtcaccgggcccggtagccaaccagagtcgcccagcaacttttctctccgtgggtcaccccggaaacttgtccttcccagaatagaactctgtccctgagccgaagtatgagactcggagacgaaggcggtggccacaatggggaagcccctgggtcccctgcgcacttccagccccagtttccttctgagagccccgcccctgcctcttgggtcccttgggttggcatggaacagaacggggtttgggggtggagtcagaccaagttcaaatgtttgtatcacaaactttgagttgatgatcttgagtaaacgcttactgcctgtgcctcggtctccctcttgtaaaaataactaatgctgagagctctttgagagcacagcgtgggctgacacgtgagaatggctttgaatagcgtcttctcagttcgtgttgccccattctgtggaagagagtctgaaagagacctatattgggcattgcttgcccttaaccctgtggtctggtcaataggagctgtgatggacacattccaagaatgtgaaatatgagtgacccttgtggaacgaagcctgtccaagaatccaaccccaccatgagtctgtggagtcttgaggacagacacagcagccagggtcgacctcagccagaccaggatcctgtggctaaagaggcccctacttccgagctgcagatgaaggtggactttttccgtaaactggggtactcgtcctctgagatccacagtgtcctgcagaagctgggagtccaagcagacaccaacacggtgctaggggaattggtgaagcatggctcagctactgaacgagaatgccaggccctgacggcccccagcccccagccccctctggtgccccggggtggaagcacccccaagccttccactctagaaccctcactcccagaggaggacagagagggcagcgacctgagacctgtggtcatcgacggaagcaatgtggccatgaggtatgtgtggagacctgtggaatagtgtctgtagctcttcctttgggaagggggcttggcttttctcttggactggtgaaggaacacaaaagctgtctgtgagatcccaccatgtgccagaaggaaccccttaagccttaaagacttcctcagggctgtttctccaatgctataagaaggaaaacagctcaaatccttgccaagagtcacacttcttgataaatgagaagcaaagattcaaacccagccttctttgcctggagtgtaccttgtgccatggtctatccttgcctacggcatgaggcaggacagtataagggattaacccgtgggccagtcacttagccagttgggctttttcttctcctgtcaaactttccactcaggtggcccctgtggggagaaaattcatagaacgtggagagttacaagtactcagtggagccgggcgtggtggcacacacctttaatcccagcacttgggaggcagaacaggcagatttctgagttcaaggccagcctggtctacagagtgagttccaggatagccaggttctatacagagaaaccctgtctcaaaaaagaagaagtactcagtggacagatgttattccatgacttgagtcttctgggatctccttgtccccgactcgagctcccactgaagcaaggctcattagttattcagagcttcctagccctaaccagctgtgaccttttggtcagatctggcatcttcagatgcgtgtgtacgggtagcctgatgctctgggctcaggtgtgctgtaatgagaatctatactccctgaagccgctcaggctggcctgacctctgggggttcccagatctcctgccgcctttgcatatctctcaaggaatggggtggggtggaggcagaatgggagccaggctgcctctgaccttaaggagccctgatttctcccttctatccaggccgcaccctccagctctgctttctcccagctccctgcacagcgggctggtgagtcaggactgggtggataaagtacaaggaaaagatcctgttggcagggaccaggggagaccccagcaaaagaacaggaagaggagaagtctcctttctagatcccctgagggctctcccaagaggactgcccaacttgttatgatgtcagcttcttcgccacctggctcctggtcctacctactcccagcccagctgggtcaagtgagctgtccagctggtcctggccctacttagctggttcatggaggcagcccttctctaccacctttgggtctgttgtcacatctttaaaatgggccgatcctgggctggaaggctgagaaatgctggcttctctgccagagggcagaagggtcaactggttaccttccgagtctcgagttctctctgaggtcctgaattaggaggggggtctgacttcccctgagagtcctaggctgggtgttaggagtcttgtgggcagccatgtgctctgggtatttgtttctgggcaggaggaggaggggccctgggtgggaggaggggcagtagtggaggggttcaagagagctgataccaaagagacagacagccactgtctgccctcttgcctgcctgcctatctgctgggggtttctgagctagggtggccacggaaggggaattccagcctcacacttcctgtctcagcagctgcttggttcctaccctgctgctacacacacacacacacacacacacacacacagacacacacaagggcaggccggctaacccccaccatatgcaaatcgtggggaaattcacctctgtttccttctaagggaattttcctccacaggagttaggcccagcccaggttgttctctccacctggggaggctagccctgccttgtccttgggcaggaatgggagctttccagagtcacggccctgtcagggtggggggccctgaactgtggaccagcaggactctgtgggtgggaggaagttggttttcctaggccaaccaggcttcctgcattgcagtgagctgaatgagctgtccaggcggtctgggcctcaggcctcaagggctctccctgccaagaatagggctctgactacctgctgagggaactgtcccagtgccagcactgctgagggcagacgtgtccccaacctgggttttaaatgcccacaggcggtatacagcctaagcaccctggcgtcttgagatcctccaacttgtctttgctggtccaggggagggctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtcaaggtggactccgtgcctttcccacctatcagggctgttggtacctaagcaacaacagggtagttctgatcactggctactgtgtgaccctagtgactactaagttaccctctctggaccacaggagcggaggcagtgtacttctggttttgcttgctgatgattccgtgtagagcgcggaatggccaggtttgcagctccctgtgaatgttaaccgacttatgagcaagccgcctgggaccaggagggcgcgagggctcccttggggtgggctttcttcctctccaactcagagacctctagctagaccttggagccttgccctgagatagtgtccattcccactctgttctcttggggctcaagctatcgctcccccaaagccacccacaggatgtggtctgccatggacttgcctcttttgcgtaacatgtattctgttttatttgccaaatatgagtctgagtcgctcactctccccagagtaacaagaggcagggctttctggggagggagccccaagctccagtcctccttcagcactcccagaaaatccaccttgccagcgcctctggcctcaagccttagggagctctgtgtccctggggtgaaagagcttgtctgcaaaagctgtccaccaagcttgtgggcagagacacagaccagggcaagcagctaggctgcttccgaggaaagccgtgtttagatagaacaaggccagggcctgatgccccagccctcctgtgagcagagttccccagtaatttcctgcccatcatctgccaggggtcacgccctccctggggcggggggtaggggagggcagggaggggcagggcagtctttgcagggaacaggcctcttaagaggaaaagaggtggcctttcactttcacacggaaaagctcctggtgctgttatttcctgaccccttgtggaaggacgctccccgtgcccctgagacctcatgcagactgaactttaatcctcaacagtctggtttctcctgcttaacatggccggtgcctccctcccccgcctcccttgctggtgcctccttgctgtgtagtgttgagggaaagaggtgactcagcctgcatgtgcacatccacgtccccgtggtccctgcagcttgggtggggcaggatccccaagtctcccatcacttttccccacccccaggtatgttgcaaatggcccgaccctccccctctacgtggggagccagtgtggctagattcctgggtggatccacgcttttaggagatggaatcttagggaaagtcccttccaggggctggccatcaggcactgtgggaaccggcccagggacaagaccttaggccctactggcagagggccatgggctgagtcctacagttgcccagcaaggccaagcagggctagattgtggctcccttcttacttttgctctgaccggactgactacatacagactggctactctgtgagctaacctttccctcctctgccagccatgggaacaaggaagtcttctcttgccggggcattctgctggctgtgaactggtttctggagcgaggccacacagatattaccgtgtttgtgccatcttggaggaaggaacagcctcgaccagatgtgcctatcacaggtatgtatgccctctggaagtaggatagcctcactctactagggaccctggtgcttccccaaagggtccttaaatagggtcagcaccttctaaactgtaatgaggaccagcctgtctttttcaattcttgttgctttcagcagcccagttcaggcaggaaatggctggaagtcaccttgtgtcgctttgggatgccttcctgatcctattggagtggggtgtcccttcttcaacatccccggtggcagagggacagtgtagcttcatatttgaaattgtgggtgctgggccaagaagacagggtaaagggcttggccctaagttactcaggtaagggcttcaagtagacattagctgtgggctcttccatctgtgaaatgggacagggtagaggtggcatcctccaaacactgctgaaggagcagttgagaatggtacagaagtgcttaactcagtgcagtgtgaaagctcggcatagtgtgaatgcccagctgcgaccattgctctcatgaaagcccccaccttgaggaggagggagtgacaagaggcagctttttaagaagtctgcataggctggagagatggctcagtggttaagaacactgactgcccttccagaggtcctgagttcaaatcccaggaactacacggtggctgacaaccatctgtaatgggatctgatgccctcttctggtgtgtctgagctacagagtactctaaataaattattaagaaaaaaaaataaggttggcttagataaaaaccatagactacattttaaaaaaaaaataaagaagtctgcaaatcagggccatgctaggggcttctaggccttttctgaacagagctgggagtgttgttttgagtgtgtagaggacagggccaagacacttcttcctggacccctgtggtacaggcaaggcacacaggtcggaggggaagtaggaagagccactcttggctccgcactcttgctgaatgtgatggccctgcatagagatgcacttggttttcacacagctggtttccgtcctcttggaactggtgtgaacagcctctcatcccggccactgtgagccatgggaccctgtgggtccatcttagggtctccaatgggccctgacctgcagctctgctcatcccccagaccagcacatccttcgggaactagagaaaaagaagatcttggtgttcacgccatccaggcgggtcggcggcaagcgcgtggtgtgctatgatgaccgcttcattgtgaagctggccttcgaatccgacggagtggtggtctccaatgacacgtaccgagacctccaaggcgagaggcaggagtggaaacgcttcatcgaggagcggctgctcatgtactccttcgtcaatgacaagtacgttactgctggggactggctctgctgggcccacaggctgggctgcagctttcggggtgacatgagttgcagggagaaggctagggacagtggaactttttgatagggagcctgggagttgaagctggcccgagacagaaccaattcgttcctaggtggctctctcaagaaggtctatggccacacacatcccaagatacacttagccttcctgatagcctcatagttcccagcctagggagtgccccgaaggcgaccctggcctataccctctggactgagggatcccctcctcctctggggtgacccaactgcaaactcagaagactttaggggcatcctgcagacaagcatcttgggagctggctatctaaccctttccttggttcctcttcacgacttctgtttcctgagcgttctgcttcacctaccacaggttcatgccccctgacgaccctttaggacggcatgggcctagcctggacaacttccttcgtaagaaaccactgccttctgagcacaggaagcagccatgcccctatggtgagacccagctctgtcctcaatagtcttacttaccctacctttcctcttgcctgtcccatcccacttaggcccgcccgtggcttccttgtggggaccccctgttctagaccacctgaatcccaagtctgtgcctcgtcctcgctctgaccccatttagacaccctctctgttcttgcagggaagaaatgtacgtatggaatcaagtgccgatttttccaccctgagcggccaagccgtccccagcgctctgtggccgatgagctccgtgccaacgctctcctctcacctcccaggactccagtcaaggacaaaagtagccagaggccttcccctgcctctcagtccagctctgtgtccctagaggctgaaccaggcagcctggatgggaaaaagctgggtgccaggtcatctccgggtccccaccgagaaggctcaccgcagacctgtgctccagctggcaggagcctccctgttagtgggggcagctttgggcccacagagtggcttgcacacacccaggactcactcccatacacctcccaggagtgccttgattcaggcattggttccctggagagccagatgtcagaattatggggcgtgcgaggaggcagccctggggagtcgggccccactcggggcccctatgcaggttatcacagctatggatccaaggtcccagcagcaccttccttttctccttttagaccagccatgggtgctggccacttcagtgtccccaccgactatgtgcccccgccacccacctacccatccagagagtactggtctgagccgtacccattacccccacccactcctgtccttcaggagccccagagacccagccccggggctggtgggggcccctggggcagggtgggtgacctggccaaagaaagggctggtgtatataccaagctgtgtggtgtcttccccccacacctggtagaagctgtaatgagacgcttcccacagctgctggatccgcagcagctggccgcagagatcctgtcttacaagtcccagcacctcagtgagtaagccagaaggtggcgcaaggggctgtcgggcatcacagatagcggtccccagcccctgcctggcctaccctggaagctggacagaaggacaagtgaagcaggcaagggaatcctcaaaccaaagataccataggattggttctggccccgcggcaccccaacccgtcccgcacaggtcagaagtgatcaccctgttgatacacattgtatctctgtcatttaaggagacgctgccggtcaggccgtccatccgtggctgatgcccaaaccctctttttttttctcagagggccgggtgggaggcatgggggagcagaggcctgagctggaccccaccttccaccctgtccctgggacgccggcaccaccggctagttaggcaccatgtgcctgctctctgaggccccctcaagccaatgcggcctcatccctgttcacagggcatgaggcttcatgttagtaagcaagatgcttctttaagcccctcccctgcccgctctgtccacctacacaccccccccccaaccagggctccaaggccctctgtttccacacctcccatgggtgggaggacacatgtatgctgtgtacagaggcgagatttaaatattttaaatgaaaaaggttgacaaaataaaggctattgccaggcaggctggagagatggctcagtggttaagagcaccgactgctcttctgaaggtcctgagttcaaatgtcagcaaccacatggtggctcacaaacatctgtgatgagatctggtgccctcttctggggtgtctgaagacagctacagtgtacttacatacaataataaatcttttaaaaaagagagaaatttaaaagaaaaaaaaagctattgccagtcgttttgagaggaagttgtccttactgtgcctggtgggtagagctgctctggggtgacaggaggccagtagggcagatgtcactccctgtcctcagaaaggagggttcccagaagcagttggtcccttggagctgaaccttaataggaggcaaggtagcaggtgacagctgcaggaagaagtgtaacggcacagagccctgtggcttcagctgggtagaggggtgccggggcgggcgacagcagggatgaagctgttcctcttttctctgatgacaagaattgagggtaggaaacagggaaacgatttgatcagggccacagagggcggtgtgatccaagtaggtgagggagcccttgggtgcttgcacacaggctcctccttccagatctgctgtgtgtccaaggaaccagggttgcagagctggaggaagggctggggtagtagcagcagcttggagacgccctgccactgactctaccagctggagcaagggactatccttcccagacctcagtttcctcatctatgaaatgggaatcctaatggcagctaccttacaggtttgtcatgagggttcagtgagataatacatgctaggtatgtgacctgcctcctgccgcacaggcactgctcattagaaggcttccataactgactcctgtgggcaggcacacagactgaccccatccaccacgtcaaactgctcatcagccctagacaagcccaggcaagataacaccttcctccctcctcccagctccaacttcaaagatgaacatgaatattttaaatgaaaggctaggctatcacacaattcctaagcaaatattaccagccaaggaaaagggtggggggaggcggaattacagctttaataatcctacctttgaacaattcctctgatatttgtacttagtagtcggtgtaccttagtgcatatttctgttttaaaaactacttccgtacagaacagctgtgaagctctggaagaaaatgtcactgtgggaatcctccccacgagctccgcccaacttttccctgaccacccttccagaagtgcctgcttaggacaaacatcaggatccgttggcatgcaggagctggaagcttccctcccacaggaattaaaggtgtctatgccatgcgtgttcctcccggcctcctcgggagctgttagcagcataaggagagacggcaatgccttatttattcttacaaaggaactacattgtccagggctctgggaaggcagccaaccatgcactgagttcaatactcagcacctggtgttggagcgtacacctgccatcccagcatcccggaagaagatgcaggagggccacaagttcaaggccgtctttggttacaaagcaagttccaggccaacttggcctgcatgagactctggtctcaaacacacgaaataaaacacacggacacacaagggcgccaatgtattctcaggttaaacggccgtctgtgggcatctgtttgtctttatgggataggaagctaaaataccggacagtcgggttcattatcagttgcttggcaatgctgaatgacttgcccaaggtcccacggaggaaggcaggctggggcagggctttcagtacccttcctgatcccaaaacctgacaccagactgttgtgactcaagcctctgcagaaatgggaagtgagctgctcctcccactgaagcaagtagaatgctcgcccactcggctgctcagtacggccctgtctgtaccatactgtggagctttgggggccatgagattcaggggccgctcacaaggggaagtgagaagaactcttccactgtcctggctttcttagccggagtttgaagtcatctgtgactgtcctatgggggtgagaaatgggctgactccacaggcaggcagcagcatgagtgccagctggctatggctaatgttagaaggcagggcctggccctgctggtccactgaaaccagtgagggctacagattcaaacaataggtgccagctaggaccgggctctgggctcaggccttctgatgcctgtcttggtgcccatgcttcctgacagcttggctcagctggactagccaaccacgtggccatgcctccaggcctctttctcaatcttgcttccaggcagggctacccaagcagcctggctcaaagccaaggctgtttcttctctgtgacttgcttcagcattaactccaaagttctcaccacctcttgtcccctggccactgaggccactcagacaggtagcactggatcacacgggaccttggccttccacctgtgaaatgggcacaaagacacaccacctctccagacattacaaaagaagaccttaactagcagcatctagaggcagtgaggccccagttcacgccccactcactagcaggcagccctggctactcactgcccttctctcagggcttcagctgcctgacccacagtgatccacgtgggagcttaacggggagggcggcagggacaaaatgtaactcccaagaccaaagctcgagccaccaggcttgctgcaagggatcaaattccaagcagccgccccagctgctccttatgccagctcttcctggttacttgagccaagctgggtgatggggaaactggtgtgtatgcaaattctctgttgggaaatgatctctgggagctgagctgggccttcccaccctcccctcccacttgtaccagcaggtagtgaactctaggtgcttcagcaagttctgctccacaagactaacaccttgagagggggtgggggggaacccagcctgctcagaagtcaaaacgactggtctgcctttgcatgtagcctgagacaggaaagctttgtatgccctgccagactgagccagcccgtaacggtgtgtgtgtgaaggacccctgctctgggtcactctccactctgtctctgggaagacctggcagtccctgaagatgctggtaccacaaaggacaaaatagccaccgtgcaaagcccacttggagctgctaatgccctaaactgctggtgtctttcagtgattagagtagccagctgcgggggcaaggccagtgcccatttctgcagctccatttcctacttcccttttttcctaccaccaaggtcctctgcccaccttccccagggacagtacacacaggttaacccatctcaaggaggagtggggtaaggtgagcggacagaactgggaagagggtcactggctaagctctgccagaaggaagcccaaggaccccagagcctttgtcctaggcttcgatcttctatcacaggcccaaagcagactgggtggcaagaacctgtcctgtggacctcctagttcatgggaagggtgtgggagacttggctgaaagaggcaggaagtggggccctgtaattagggaagcccgtgccatcctaggccatggcatgtaaatccctccagtcagttcctggagggggaggaggcccagtctgtaaccgagggtgtgccttctgaagctgctttcaaggcagcagcagctggtgaccctaaactgcttacccgtgtaaggaacagcatgaagactccgtgggaggaatgacttagccatcccaggcatgtggcaccctgctgccgccttctggcagctcctgatactactactactgcctggagccagtggcttgctagcttggagttgctaataccccccaaaccactgacatctttcagggggcaagggtaggaatgactccatgaggtctgaaataacgggctgtagaagtataactctgtctgggacaatatgcaaagcagaacccgaaacagacggggaactccttctggcatttgttttggacagggtctcgctcaacatgcagtgccgggctgtctgcctacctcagttcccaaagtacttagctcacaggtgtgttctttttgtctaagcagtgaattttcaaaggcattcgcaggaagttctgactgtctgggcaataaattacccaagaaaaattattgggcaagaagtacggctgaacggtggaacatgtgttcaacacgtgtccatcccctcagcagcacgtgttgcacacacatgcactcaagcatgtacacacacaaacacacacatgacacacatacagacacacaatacacacatacacacatacaggctggaagaacaatcaaggagaaaaaataataattgcatatacttaaataaaatcaccatgagtgggctggagagatggctcagcggttaagagcactgactgctcttccaaaggtcatgagttcaaatcccagcaatcacaaggtggctcacaaccatccataatgagatctgatgccctcttctggggtgtctgaagacagctacaacgtacttacatatcatcaatcaatcaatctttttttaaaatatcaccatgagctgccattccaaatgaatcgagtcctgtcgatgtggcaggctgtggggaaagaggtagtgtcatcagtagtgtcctacagtcgaccctggaggggacctggtacttcagtcacctaggaaacagagctcttgactcggcaggcctactaatctatcccaagaaagccttcatctgcaagatgacggaaggcatttcctacgacagcaacagtcagtaagagcacaggctaagtaaactagcacactgcagggaatattagtcagtaaggaggaggcagctatctctggaatttggcttgcttttgttgttttggatagcttgagataggaacgttcctcctgcctcagcttcccacttgctggctgggatcactggtagacacgggtggtcagtatcagggagtcggttctcagcttttgaactgtgggttctaaggatcaaactcaacccgcagggctatctggccagcccaagaactggctttgagatatttcctaatctaagaagccacttcagaaagggaaggcagagcagctccctatcatttctggaaacggcgtttctgggggggggtgtggggggtggagctgggagacctctgaccaggagcctgcagtgtgttcttgtatgtgaatcataataaaaacccggagtacacatatttccaacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccaccatcgcaccctgcttcctttcagtacccacagtacgactgactccatagaacagtgctcagaaatgaacctgtgcttcaaatcctgaagctgaccaggcagatccagacctggatcacccactttgaacactgggttagaccagcatatcctgcactacactgctgtaccctcccctcacactcttccatgcaagggcgtgtgtgcgtatacacacacccacacacccacacagagccttcccaggtacacaaacacacacacacacacatgaatgcataaacacacacagccttcctagatacacaaacacacacagccttcctagatacacaaacacacacacacacacacacacacacacacacacacacacacacacacagagccttcctaggtacagacacatacacacacacacacacacacacacacacacacacacacagagccttcctaggtacagacacatacacacacacagttttcctaggcactattcagactgccttccttctaccagaacatcagcctgaatagatctgcgagtgtgcaaatgccttagtgatttggaatcaggcagaggtggcaaagcccaaataggtgcacaagccaaactggagagcccttcagagccacacaccaccggcttacaagtgcaggctccttagcgtttgtttcctttatacttccagggtgaagactaggaccaccactctctacacttgcagagcccaggaacaaaagctcacgttttcaggtgaagaccccactgcctgcttcctactctcagaacaaaagtgtttcctgaaagcaaacattacaaactcaagtgtggagaaatggtttaacctgtgcggccgtagaaccctttctcccggggccccaaggctccggagacctggggcctcactgggtcagaacagcagcttcgaaaagtgtagttcttggccccacactagccttgtcccagtgcagactccaactctgtgggccggtcccgctccccacctcctcctgcaccagcagtgctgggacactgactgtaaacagagtgaccccttcctcagtccttggaatagtacacttgatagtcccatgaagcgctgcactagagtggcctccaagtagtggacacagaagttaccacaaaaggctgtgtcttgtcttacacctaccagcggccaagggcgagcgcttccctagttagagagaggcacggagcaacaaatggcagcagctaatgtgctgtccgtccccacccccacgtgcctttcctttgtccttccgagggacaggagggtcactggaatcagctgttgcttctcaccccgctccaacacaggccaggtaataacagcctaggctggcctcgaactcctctgcttccacttcccaagtgctaaggtcattggcgtgtgctgccactcctgactcaggagttggctaactctccttaaaccagtccctcccacaacacacagagccacagatggcacttccgtgtagggactgctggctggctgcaccgaaaggcaatcttgtccactaagaataaagttcctctgtgtaagcaagcacactcactccttccttcgatgagttgtaagccaacttggttgataaagtcagtgtcagcatttattggagttggtattttgtttttaaaataaaattcctttgtggcccaaactgacctccaactccctgcgtagccagggatgatccttgacttcgaatccttccttccgagggctaggattaaaggcatgcatccgtcaccacagccaggttgacatggcactgagggtcgaccccctgcatgctagacaattactccgtcactgagctatgccactcgtcttcttgatgcccttattcgatgctacccagaaatagggaaagcaagtaatttatcaaagcctgagtactgatgtccagtttacgggaaaactagaagacccaatcaatggccaaactctacagggtggggactggggatggggaaggcataaaacaaacagcccacaagccagtcttcaacacacacacagggtcagtcacacacacagacatgctactgcataacacacctttagggactgggagggaactcagtggtaggtcacttgcctagcatgtggggctctgtatctaactctctaccctgccataaataaataacacaccttctactgagcagttccaccggtcctccagggcacagccaactgtggaggtccagatgtttttgagtcgcacactttcctcagcgttaaggatgaagcaataaaactaacagaatgcttctgagattttccttctcaaggaacaatctacatattataaactacttccttcagaagaaagccaaagccaaagatcaggaaaccatccaagaaaatgggagtctgtttaagaacaaaatgaaaggcttttgcacatctgacagggtggttctggtgaagaggccagccatctccgccaacagcatggaccacaacggcccaagtctcctacaaagacccaggcgtcagagaggacaggcaaggccctgaatcttacccctcagcctgatccagtgctatatgctcagtctcttaacacagtggcctccagcaggctcccaatcaacagcctggactctgtgttccaagcccaacaccgaggcatacccgagggttccagggttgggatactagcatccacactgggctgagctgcccaggtgactgcaaagtggccatccacggccactcactgaggacagccaaggacacgaggacgggcatggagtgagctctacagggaaggggatgtctgtaggcaggccaggctcctgtgaggatctcactctactcggtgggaactgaggttcagtaattctaggcttttccactggcttggcgatttttagagcagtatctaagcaggtggatgtcagcaaaacgagaaaagatggaaaaagaaattctcccacaggcatgatagtagtaaaatgaagaggaaagcgtctcgggtttgggtttagaaggagcacatgagaagggcgagccagggagattttattcctacaaagagtctactccaatgggagggtttcaacgtgtgctgtttagcttcttgttcctcccacataaaactgttcctgataggccatccaccgtgaaaacactctctcccttccccctgaagaaatcaagaagccaaagaggcagctgcccatttccttctaaaagccactttagtttcagttatgaatatcgacaccacatgaaacagacgatcagatgtgtcatcaggaaggtacaggcatcacaaaatgtcccaaaagaaaatcagatggtaaaagcaacaataaaaaaacaatacaacacaaaacaaaacaagagaatggcagatatttacagcctccatctgcaatggaccttgggttctactttcagcttaacacagaatcagaggtgtgtgcacttctcgatgggggcgggggtgtcacagatggagctggtgccagccagtttggggggagacattcattctaagaagggagaaatgcacagttagccacccgcagggactgggacggaggacaggtcttcccgctgttctactaatgatgacgacagcagcgaatgacccaaaaagtcttatagggaggacttgtcactacagttaggtcagactagccagtcacaggcactgggtctggggggcagaggcagatggccacagtcaggcaagggacatttgtggctgtgaggtcagaggggaagcttcacagcctggaagcttctgccagcaagtcttctaatagtc

SEQ ID NO: 692 - DNA, 1887 bp, Mus musculus
cgaaggtgccgtcagagcccgagactcggctccatggacaccttacagacgacgtccggcgctcagcggggagctgtgatggacacattccaagaatgtgaaatatgagtgacccttgtggaacgaagcctgtccaagaatccaaccccaccatgagtctgtggagtcttgaggacagacacagcagccagggtcgacctcagccagaccaggatcctgtggctaaagaggcccctacttccgagctgcagatgaaggtggactttttccgtaaactggggtactcgtcctctgagatccacagtgtcctgcagaagctgggagtccaagcagacaccaacacggtgctaggggaattggtgaagcatggctcagctactgaacgagaatgccaggccctgacggcccccagcccccagccccctctggtgccccggggtggaagcacccccaagccttccactctagaaccctcactcccagaggaggacagagagggcagcgacctgagacctgtggtcatcgacggaagcaatgtggccatgagccatgggaacaaggaagtcttctcttgccggggcattctgctggctgtgaactggtttctggagcgaggccacacagatattaccgtgtttgtgccatcttggaggaaggaacagcctcgaccagatgtgcctatcacagaccagcacatccttcgggaactagagaaaaagaagatcttggtgttcacgccatccaggcgggtcggcggcaagcgcgtggtgtgctatgatgaccgcttcattgtgaagctggccttcgaatccgacggagtggtggtctccaatgacacgtaccgagacctccaaggcgagaggcaggagtggaaacgcttcatcgaggagcggctgctcatgtactccttcgtcaatgacaagttcatgccccctgacgaccctttaggacggcatgggcctagcctggacaacttccttcgtaagaaaccactgccttctgagcacaggaagcagccatgcccctatgggaagaaatgtacgtatggaatcaagtgccgatttttccaccctgagcggccaagccgtccccagcgctctgtggccgatgagctccgtgccaacgctctcctctcacctcccaggactccagtcaaggacaaaagtagccagaggccttcccctgcctctcagtccagctctgtgtccctagaggctgaaccaggcagcctggatgggaaaaagctgggtgccaggtcatctccgggtccccaccgagaaggctcaccgcagacctgtgctccagctggcaggagcctccctgttagtgggggcagctttgggcccacagagtggcttgcacacacccaggactcactcccatacacctcccaggagtgccttgattcaggcattggttccctggagagccagatgtcagaattatggggcgtgcgaggaggcagccctggggagtcgggccccactcggggcccctatgcaggttatcacagctatggatccaaggtcccagcagcaccttccttttctccttttagaccagccatgggtgctggccacttcagtgtccccaccgactatgtgcccccgccacccacctacccatccagagagtactggtctgagccgtacccattacccccacccactcctgtccttcaggagccccagagacccagccccggggctggtgggggcccctggggcagggtgggtgacctggccaaagaaagggctggtgtatataccaagctgtgtggtgtcttccccccacacctggtagaagctgtaatgagacgcttcccacagctgctggatccgcagcagctggccgcagagatcctgtcttacaagtcccagcacctca

SEQ ID NO: 693 - protein, 596 aa, Mus musculus
  VARIANT (1)...(596): Xaa = Any Amino Acid
NMSDPCGTKPVQESNPTMSLWSLEDRHSSQGRPQPDQDPVAKEAPTSELQMKVDFFRKLGYSSSEIHSVLQKLGVQADTNTVLGELVKHGSATERECQALTAPSPQPPLVPRGGSTPKPSTLEPSLPEEDREGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAFESDGVVVSNDTYRDLQGERQEWKRFIEERLLMYSFVNDKFMPPDDPLGRHGPSLDNFLRKKPLPSEHRKQPCPYGKKCTYGIKCRFFHPERPSRPQRSVADELRANALLSPPRTPVKDKSSQRPSPASQSSSVSLEAEPGSLDGKKLGARSSPGPHREGSPQTCAPAGRSLPVSGGSFGPTEWLAHTQDSLPYTSQECLDSGIGSLESQMSELWGVRGGSPGESGPTRGPYAGYHSYGSKVPAAPSFSPFRPAMGAGHFSVPTDYVPPPPTYPSREYWSEPYPLPPPTPVLQEPQRPSPGAGGGPWGRVGDLAKERAGVYTKLCGVFPPHLVEAVMRRFPQLLDPQQLAAEILSYKSQHLX

SEQ ID NO: 694 - DNA, 29829 bp, Homo sapiens
ttcattgattgctgtgaaaatgatctgaatgtccaaacattgagaaaggcaacctaggcctgccgtgtacagttgtgcaagctgtgaactgcacaactccagaggtgccatacagatcagaatccaaaattgttcagtgcaacacctgtgcagcaaaacacatcagccctgtggctgctgaaaaggttagggagccatagaaggctttgggggcaggagagggtaggtgtcagagctggggtcacagggattgtaaggccagaaacccatgcatgcagcctcccatctctctaggttggcctcccttttggaggctctggcaatagaaatatcctattttctctgagcctcataaccttggttttcctaaggatggggggaaggacttatctctcaaggcccataatcacttctttggcctgtacaaggcaatgtcctctttaatcacttgtccactaagaagcaaggccaggaaaggtccccaccctacccctaatctttactcctgctctcatggaagcagaagtggctggcataaggggtggggtggaggggctgaaccctaaatggcattcagcacatgtggctcctaggaccagcttcaccactaccctgctgtaatctttggcaaatccttaagcctctctgggtttctacctccctgtttacaaaataaagacaaatattaacattccttctctgcctcttggaaagataggcaagacaagagagaaaacatgtagtgatgatttcactgggaatgcacagaaattcaagcattctaattaccattaaacattaagaattaggctaggcatggtggctcacgcctgtaatcccagcactttgggaggctgaggcaggtggctcacttgagtccaggagttcgagaccagcctggacaacatggtgaaactccatctctacaaaaaaatataaaatttagctgggcaggctggcacacgcttcttatcccagctacacaggaggctgaggcaagagaatcgcttgaacctgggaggcggaggttgcagtgagccaggaggcggaggttgcagtgagccaagatcacgccactgcactacggcctgggtaacagagtgagaccctgtctcaaaaaaagaaaagaaaaacaattaagaattagtggactgtggatcaggaggccctgctaagcagctgtaaaaccttgaacaagtctcatgacctctctaggtcttatatttgtcatgtgtgaggtagctgagcttgagctgattcagcattctgctgaccttttcactatgagtgttttactattgccaaacagatctcatattttctaagattttatctcctaagctgtatttaggtaattattatatacttagtaattaagtaattattattaccattaaaagggatatctttggttgtgacagaacttgtgggcttagataaccaacaagcctagaaccaggggtagctttaagtaaggcttgatccagcagctgttaccaagaacctattttctttcagtctcttggctctgtctcctatgatgtgtcacaaggtggctgccagaagctcctggcaatacttgcttttctcctttgtaattagcaagaagtagttggtttcccagttagctcaaagaaaagactcagaattgagacccattcactctggttggcctgatttgggacctatacctttttctgaccaattgctgtagcctgaaggatgaaatattctgatttggctgggtgcagcggcttatgcctgtaatcccaggcactttgagaggccgagacagctggattgcctgagctcaggagttcaagaccagcctgggcaacatggggaaaccccatctctactaaaaatacaaaaaatggccggctgtggtggcatgcacctgtgatcccagctactcaggaggctgaggtgggaggatcacttgagcctgggaggcagaggctgcagtgaggcgagatcatgctactgcactccagcctgggtgacagagtgagatcccatctcactaaaaaaaaaaaactaagaaacattctgatttgcggtccaggcacagtggctcacgcctgtaatcccagcactttgggaggctcaggcaggtgggatcatgagatcaggaattcgagaccaatctggccaggagaccagcctggctaatatggtgaaaccccatctctactaaaaatataaaaattagctgggcctggtggcaggtgcctgtaatcccagctactcgggaggctgaggcaggaaaattgcttgaacccgggaggtggaggttgcagtaagccgagatagagtcattgcactccagcctgggcaacagagtgagactccaactcaaagaaaaaaaaagaaaagaaaaagaaagaaatattctgatttgcttaaggcagttaggccccaccgctggaatagggtcccttctgaccagattacatggctgagaaatttccaataccattaggaatggggaatccagcaaaggcggcgggagagacaaccagcaccagcaagtctcctacggcatgtttattggccagtggtatctctaactgccatcagaacagatgaccaccatgtgaactgtgcattagtgatccccatatcttgtgaggtgctcactatgaccaccccatctgtgggtggccacactgaccccatgagctgacgtcagcccagccactgcaagctcctgactccggttagatctgccctggtcgcaagttcatctatgttcagcttctagttccccactcccatctgaaccttcacagatggctcagctagagaccctaggtaagccttgagctcccttccagccgagttccccgtgactgcttttttcagatgcaaggggaggtccacgagctggacatggtaaagacggtacaacagacatgtacacagcaaaacataactggaaccacttcagctcatgcgtgcattgactcagcaaacatttaccaacatccgtcccaggtcctgtgctgggaatgcagaggacagtgagactcagggccgtcctcaaggagccacagtcaggtggggagacaatggtggcacagaccatcccagttcattatggaaacacagcaagggaggcacttccccctcctaggccagaagggatgaatgtccacgtagcagcctcagcggcagggccacctcagccccatctcctactctctaggcttcaggaaaggctatgggggctctccagcagctctgagtttatcaccagagtggtgtccccagtgcacattagggagtgttcaaccccaaaactggggacccaacccctcttcacatgctaagggctttgcagaatcttctctggcccctttactgcaatagctctgggggcagaagtagggggcagagacagactcaatcttttatccactttcaggccatgcctcttcctggaccttcaaaactggtgagattcacctggtaagggcgtgcacagtgagatcaaagcagaaatttccactctaaactattctttccaactaatacttgggattcagcccttcctttgaatttagcattgccctaatcaggtccccaagtgaatcaacaatacttcagagctgtgtgggtctgacccacatctctgtggcaaatggggccagagatcccgggacagagaaagcctggctagtcccattcttggctctgtccaaattaacttggcacgtggccgggggcaagtccctttcctctttctctcccagtctcctcatctatgaaacaaaattcaaggccaggtgtggtggctcatgtttgtaatcccagcactttgggaggtggaggccagcggatcacttgaggtcaggagtttgagaccagcctgaccaacatagtgaaaccccgtctctactaaaaaaaaatacaaaaattagccaggtgtggtggcacacatctgtagtaccagctatgtgggaagctgaggcaggagaattgcttgaccccgggaggcggagcttgcagtgagctgagatcatgccactgcattccagcttgggcaacagagtgagactccatctcaaaaaaaaaaaaaaaagaaacaaaggatttaggctaatcaatctctatgagacctcctagctctagcagtctgatttgagggttcagaaacagggaggaggggtagcagcatgggggttggttgagagagaagagagacaggagctggccagggctccatagccaaaaaggctgcaagtttggacttcagatgctatctccagataggattgtactcagtcacaggatgcagaccaatagaactgaaaagagatgggtgacctatcaccaaaacacaccatctgtaaggcccataaaattatatatatggtaaatatatatatatatatcttctgaattttggaattaactttaggtttgcagaagagttgcgaagatagtacagagagttcccgaatacctgacctccagtttcagtttcccctaacgttatcttacaccaccctggtacatttctcttggtaactaaatatatatatatatatatatatatacacacacacatatatatatagttaccaaataaacttctgaatttggggtttttggggtttttttgtttgttttttgtttgtttgttttttgcttgagacggaatctcgctctgttgcccaggctggagtgcagtggtgcgatctcagctcactacaatccctgcctccctggttcaagtgattctcctgcctcagcctcccaagtagttgggattacaggtgtccactaccatgcccggctaatttgtgtatttttagtagagacggggtttcaccatgttggtcaggctggtctcctgacctcaggtgatgtgactgcctcagcctaacttctgaattttggaattaactttaggtttacagaagagttgcaaagatagtacagacagttccagaatacccaacctccagtttcagtttcccctaatgttatcttacaccaccctggtacatttctcaaaactcaaaaatcccacattggtccatcattagtaacataactgcagaccttatttggatttcaccagcctctctgttcctgctctctctgctccacgacatgacctagagtggcatcctgcatctaggcagcatgtccggtgtcctctggtccgtggctgttgctgtctttctatgcttttgattttttctttttcacaatgctttaattatttctgtgcttcttacaaccttgacagttttgaggagtcctagtcaggtattttgcagaatgacctttaatttgggtttgtctgacctttttctccagggttatggagttttagaaagaatatgacagaggtgaagtatccttctggtcatatagcatggtgtggagggggcagggttagctacatgatagccactagacttatcactggtgatgttaaccttgagcccttggttaaagtggtgtctgcaggtttctccattgtatagttactattcttctctttccctactctattatttagaagcaagtcctgagtccagtgtacaggaaagggaagggaaaggaataattaagctccacctcctagaggagaaacaatctgcattcattattggaaattcttctgtaaggaagacttgcctcttctcccccagtaggttattgattcaacaatttatttatatcagggctgggtatggtggctcatgcctttaatcccagcactttgggggaccaaggtggaggactatttccggccaggagttcaagaccagcttgggcaacatagcgagatccccatctctacaaaaaaaatttttttaatttgccaggcgtggtggtgcacaactgtagtcctagctactcaggaggctgaagcaggaggatcgtttaagcccaggagttcaaggttacagtgagctatgatcacggcactgcactcaagcctgggcgacagagcaagaccctggctctgaaaacaaaaaaattatttatatcagtataaatatttattttatactttaggttataattcaatattatcctattatttattcccttgctcagttgctccagctttggccatagggagctcttctggctcctggatccctttgacgcactcccatccttttgtgttttgagcgcttcctaaatccctggcaccacagcacactgccggctcatcctttccctgtcccagccctaaaatcagccatctctccaaggaaataatgtatttttaatacaagttctccaattatcttgtcaatagtccaaatatattgcaccgcatttgaatgcatgatttaaaaaaaaaagagttaatttgttcagttaccgtttaaaacatacattgatttttgtagccctgctgtgacatgtctttttgaaatataccaggagtctggccgggagcagtggctcatgcctgtaatcccagcactttgggaggccaaggcgggcggatcacgaggtcaagagatcgagaccatcctggctaacacggtgaaaccccgtttctactaaaaacacaaaaaaattatccaggtgtgttggcaggcacctgtagtcccagctactggtagtcccagctactcgggaggctgaggcaggagaatggcatgaacctgggaggcggagcttgcagtgagctgagatcgcgccactgcactccagcctgggcgacagagccagactccatctcgaaaataaaaaataaaaagaaatataccaggagtctcaaacatgggagggatctggtcctttcttcacttctaggaggccttgttgaatttaaacatcacctcagcagccactccgttaaggcttgagggcagcctgcccagcctttctacagaggtagcccagttcccgggtcctccccaggctgagctgcccagtgaagcaactgaaagccaaggtcattcctgggacctttccctctccaacctcatctcccaaccccccaccaccctcaggcagtgaccagtccacaagctttgcagaccccacctacgctggctgggcacaggcagatagatggtgggaggccaggcaggctccaagaaggaaattagccagcccagctgccaagacaggcatacgagaggcagaggggtttgtgtgggctcggcttcagagaactcctggggattagggccaaagtttgcaaaatccagctgtaaacggagcaggggttccccaaagaagccgtgggttctgtagaggagagtcggcttcttgggaagtagcatgagccggaagacagcgagactgtggctctctctgggagggcagggagcagcatgactcatcgcctagtcctgctggctcctactggcacagggctgggcagcagagggtctgggagcaggagcagagtctggtcttgttgcagctccagaggaggtctcaggctggcaaagacaatctaacacgttgggacataggcagggtgttgtggggacacttaggagggtacaaccagcatcaaaggagtcttggctggcctcacagaggaggtgacatcatccaaaagatgaatggaactggctaggaagcagctgggtgggagagagggaagggcactccaagccaaggaagaagcagagcagaggcccgaaagtgtctgcaaggcgctagctggtgcctgccacccagtgagcactctataaatgggaggcattatctctatgattgattagtattgtcattatcattattaacctggacacatcacttaatgtttttactatcttaaaggtagttgctatagcgaataaatgcttaacataactgagctcttctcatctgtaaaagggactgttgtgaggttaggggtgccgccggcaccgcactcagctggagtgacagcaagcatgtgaggtgcccagcatgggatgtgagctggcatgcagcagggggccttgtgtttcctctctccttgggttgccaagcccctggagctgctgtgcctggggagcagagaaggggacactttggggtcttcaaagatgaccaggcaacaaagcaggaacaccgctaggtaagagcaagcaagcccagaggaacagcctcagggtccagatagagacgtacacgcctgcctccctggggtctttggtggcctcccgaacaagcaggtgtggatggggagatggactgccttggagagagctacatgagttccagctccaccagcccccagagcctgagcaggtgacttcacctttctgaatctctgaacatccatttcctccactgtacaatttcattaagatacatacaagaatatccaaagcacagtctttgtaatagaaaaaaaatcctagaaacaacatccaacagcaggtgactgaataagtaaccagtggtatattcataaaatgggacactattcagtagtaaaataaattacaggtatgcaggcaatcaaaatggatttttaaaaatataatgctgtatgaaaaaggaagtcacataattatggaatgactccgtttacacaaagtaaaaaatagcaaaactatacaatatcccacttagggatgcatacagaggtggtaaaactacaagaaaaagcaagagaatgactagcacaattaaagttcaggaaactagttcttcaggatgtgggcaggaggctgtgatgggggcacccagagggcctcaaggtactggcactggtctattttttaagttaggtgatggatacatggcttttttattattactattattctttaagctgtacatgtacagttgtgtctatggtgtcttttacaataaacaagtatttattataacactagcacttataggatacatgcctatgatgaggtagagagaatgtaacaaaggactggcacatagtaagcactggtggcatgcggctctgtcctccagcgtgtgggctctgtgttttctctctctctctctcactcacacacacgcacgcacacacacacacacacataggaagccaggctcccctctgccctcagccactcgtggttcacaaaaatggcaaataataggagcactagaataggagctctccatcctggttcgagtctttccagctggggcagtttagcctttgcagaatttctcaagggtaacatcagcataatgacctctgtctgtaagcccgtgagtgtaagcctgtaaagtgctgtgctcatgcgagggatcaggtctgacctgggaaactaaaagcatcttcatggagcaagggtgctcctccagtgggggcgctcagtgagttctgcggtatgggtgacagtattcttgtgtggacagtattcatgtggtgattggggtaaatggccctcttttgcctggttttctgcctcggtcattgtgcatctgctgactgaacctgccttttggtcctagtaaagtacagatttcaggaaaagtgtacctggccccgggggtggccaacctctgtgtgacggctttaagcacagtgtgtcttgagggggcctgactccatctgaaaagtgcctgtctggatgtacctgtctataaccatggacctgcctccaaggtgcgtggaccaacctccgcgtacctgattcactcgatgcgcacctggccgtacgtagcttcatcaggcagggtgtacctgtcaagttcttaggtccgagtgttcgcggctttacctgtcctggtaccgccgtccgcacctcggtcagtgcgtccccggcaggtgcgtgtacctgattcagtccgtgcttatcttgcgcatacgggccgttcagtgtcccgctcggagctcgtcgccgccgcagccttgaggctccgacccccgcttgggccccgtccggcgcgcagcggccgcgggggcggggccgcgacgcgaggagcggagcaggaaggggcgaggcagccccgcccccggggcggtctcccgggacggccccgccccttgcccgcttccgcgtcagtgcctcaccaccacctgcccgcgcgccgccccatataaaggcgccgccgtccttgcccccaggactcggccccatggagacgccgccggccgccgctggcgcatggcggggtgaggcgcggcggggagggtgcgggcctcggcggggaagcggcagggagcgctccggcggggtccgagccgagccgaggggaggggacgggaggggacgggaggggtggagaggggaggggacgggagggtcggggtcctgttccccggcccgccgggcctcaggacccctccaactttgcccaagttgggagagccggggaagagaaccaggttcctgatcgggatcgcgggccgagcaagcgcgggtctcgggccgggacagcctcggcgtcaccagctcccggcagccaaccaaagttttccagcaacttttctccccacgggtcaccccagaaacttgccctccccggctccgggagtccggccatgggccttgcgctgcctgggcctgagctctgagtgccagacgggtgggcgaaagtgatggcctcagtggggaagccttgggccccgcaacgcacttccagccccaggattccatctgagagccccgtccctgccttctgggtcccctgggttggcgtgggggttcgaggctttacagctggggtagttccagtcttagttcagactaagttccgatcttcgagccaccagctaacagctggatgaccttgagcacgtttttaatgtctgtgcctcagtttctccctttatagaatgggaatgggaatgcctagctgggagagcttttgagaggacaacctgaactaataacacgatgcagtgtgtagtgccaccaatccctcatcctgctggatgtggttttgggagggaggttaggagagagcgctattcaccgtccctaaccctgttggttgttcagtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgaggtaagtgtcacttctgtggccaggacacatgaggttcgcatctctcctgtggccaggacacatggaaggatgactgtctctgcagctctggtgggctggaagaagtgacttccttcttagggactggtctagagggagggaaagccttttatgaggctagggtcgcgctactggtaagtgacagaggcagggttccagcccaggtccctctgtccgcagagcttaccttatgctgtgggtccctccctgaggccagcactgtgtctccactcctctcctgtaatgtgaggcagggctgtaaaggggaccagcccgtgggcagctgctcactcacccctcggaacctgatctcaggtgggtgttgtgaggagggagtgtgcggatcccggagaggagcaagcgttcaggaaccatagtagtggtagtaggcagtggtagtagcagttgttgttgttatttcaggggctgggcttctgaggccttcttgtctcagacctgggctcccacgaaaacaggtccagtgactgtgtccaagagtgacctcaaggctgggtccagctttacatgggttgtgggcaggtggcctgatgctctggcctcaggcgagctgcaacttggatccctactgactcagctgaagcagcctgggctggaccagtctctggaggttccccggggccagagccaggactcagcccccagtgactcccacccccatcccccagcacaggaatggggtggggaggtaggggcagagagggaagccagggctgctgctgaccttgggaaacccagacttctcccgtcaatccaggctccaccctctggccccacttttttcccagttccctccaaggcaggctgatgagtcagtgctgggtggatggctcacagggaaaagttcctgttggcatggacggggagaccccagacacagggttgagaagggatgattttctggctgccctgagggagctcctaggtgggctgcccaaggctggcatgacatcagcctctgccctccctaatttgtggcccctgtgggacaagttcactgtccagctggccctggcccagctcagcaggcatgcagctgagtgctcttccctccttctgtcaccttcaggccagtcttcctctctctgacttgggctgagcctggatgggaggctgagaaaatccagtttccatgccaagaggcagcaggtcacagcccatgcttcgagattagaaggggtccctctcagtgtccagcctcatgtagctgggctaggagctaggttggatctgtgtgactccttcctctggaggtatgggccaggagcggctgagccctgggagcagccatatgcagtatgtgtttgtatccagaaggaggagggacatgggaggaggggctgtgatgaggggtgctcagaggagcctgctcctgagaagcagagccacgcacccacctcgggggtttctgagctggggtagtggcaggaggggaattccagcctcaaacttcctgtctcagctgctactcggttcctgcccggccaccccccctccccaggggcaggcgggctagcccccccatcatatgcaaatcatggggaaattcacctctgtttccttctaagggaatttttttccactcgccaggcccagcccaggcatatcttttcacctggggaggctggcccagccctgccttctgtcctggggcaggagcagcctagctggagtcttctacacacacatcctatcagtgtctgcttagcccggctgggggaccctgaccttacaggcaaagagaactggaatgggggcagggatgtctggttttcctgtgccagcagcgcttcctccagtgcagtgaaagagactaaagctagctgtaggggggcactccaggcctcatgtgctctaccaggaggagggctctgatagcgcccactgatcagtttttccatctgctgagggaatattcaggtgctagggctgctgagaaccgacttgtcccagccaagattttcagtgcccacaggcagtgcactgccctgagagccctggcatcccattagttcccagtgctccaagatactagcctaggatcatgtgcccggagggaggcaggtgggcggatacatgcgcacactgcatacctgagacaaggagccaggcctgggatgacccagctgccatggttttgagaggcaggccagaaggcccaaggaaggggggtgatgtgatgggggaagcactgggcattgtgaagacacagaccagggacctgacctattgtggcaggtcagggaaggcttctcagaggcagtgacatctcacaagggttctgaaggaagagcaggagtttgccagcagcattgtttctcccgttcgccacctgtctctcataacacactttgttcaaactcaattttgggagctttgttctcccaaataaattctggatcttctgttagagacaggaaggcaaccgagtggcccagacctgggttcgagttctgactgtctcttaccactagccaggtgaccttcctttccttcacggtagcaagccctataagaatgaagccatatatctggccaccagcgggagctcagtgcctgcgaatccctgctcattccctgcgatcagggtctgtgcctgccttcgtacctgcctgagcattgacgtacagggtagtgataagcataggccctgggcttgcgtctctcttccaccgttaactgctgtgtgaccctggtgactaagctgccttctctggaccacagttttcatctgaaaaacagggaaggagttgatgatggtatagtgccctcctcacaagcttgctgatgattcagtgttagacacttataacagggcctggttcacagctctcagcaaatgggaacttttattataagcaggctggcagatgtggcagagggaccgggaaggatgagtgctgccctgggctggactttgtctcccctacaatttagagaccttcagaccctggtgccccagtcttgcccccaaatagcctccatggcccccagctgccccacctccctccctagcttctcttagggctccagctatcaccccttacctcccccactcccattaaagacacccacaggatgtggttggccctggacttgcctcttttgcgtaacatttattctgttttatttgccaaatacgagagtctaagctgttcactgagggggcagtgagacgtggggctgctggtcctaggagctcttccatgacacctagtgttacctgggagccccaagccccagtcccccatccctcaggaaatccagttggaacccctactttgcagggccatctttggcctgaagccaccaggaaagctgtcccactgactgacccctcttaaggaagctgcagactgctgggcccattttcagatagaggaacggagagctgcggcagcccaggagccctgccaggcttccttctgggtgcagccacctgtgggtggggcgcggcctcgtctgagaccaaggcagggcccatgccttactcagctgtccttgctaagagtcccctagcatcttcctgatggtctttctgccttggggtgaagaggcatttgggggaattgccatcttgggaggaaaagcagtatcctttcactttcagactgaaaggctcctggggaacttgcttcactccggcgctttctgtcccatgctgaaggctggagtcgccagccccttcccctttgcctttctcaggccccagtccctgaggtgtgtgtgaggactgaactttaatccggaacaatctggtttctcctcggtcagcccagccggtgcttcccccgcccccacccacgctgcaagaggcgagggaggggtggtgactcagtgtgcatgtgtacatctgtccctgtggtcccggcagctcgccgggtggggcaggaaccagaagtctcgcggcacctttcccccacccccaggtgtgttgcaagtggcctggccctcccccaccgtggggagcagtgctgccagcttcctgggcgcttcctcactttcaggagatggagcctcagggaaagtcccagcggggcctggccatcctggagctgtgggaactggcactgggaatggaggccttggccttgggccccacctgcagagggccagggcctgagccctggggaaaggggaaggggctggtgactccaaaggggaagggactgctcactaccaccaccaaagccagggcaggggtggggtgtgaccacctccctcctcctgctcaggcctagggggtggcaggctggccatcagtgtgggctaaccctgtcctctccctcccagccatgggaacaaggaggtcttctcctgccggggcatcctgctggcagtgaactggtttctggagcggggccacacagacatcacagtgtttgtgccatcctggaggaaggagcagcctcggcccgacgtgcccatcacaggtgagtggtgcctctggaggtgggatggtcttactgccccagcagccctggttctccccaagagagaccctctgggagtgacctacaacttctagaactcaagcagggaccagcatttcttttctcagttttttctgtccttagcaacctgctctgaatggtggtcattggaggtcaccttgtccagtcttctgcctcagatctggagcccctccctcatcctactggtgggcaggtcgctctttcaacatccccagtggcagaagcgcagtatcacatagtggttaagcctgtgggctctgagtcgagacagccagagttggaatcctggctctgtcccctcttggcgccctggcctggacagggacccctcttagccctgctctgagccacatgctcctcatctgaaacatggggtcggtgtcagcagggggtgttgacagcattgccttcctcgtgaggtcatataagttaacacacggtaagtgctgagaagagtacctggcacatggtagatgctcagtgtatgttagctgttaccactgttcttgcaagagcccccagcctttggaggtaaaaactgaatcagtttctctagaagtcttgagatctgggggcagcctgtctgggactgtaggctccaggaagaggggccctttccacttgcacacttctgtgtccctgtggtcccagcagctccccaggtggggcatggtgagtggcctgaccttttcccaccatgggatttagcgaccttgtcctggcaatgcaagggacagagccaagatacttctcccaccccagagcaagctgcggctcattcacggacccctcagaacaggctggatgaaagccaaagccaagaccacatctggcttgaacaggcctgatgtccagaaggagaaaaggaacaaggccagctctgtgcttggagcctctgccatgcaggccctgccgcctgtgttcagatgttcttggtcttcaggcagcaaactgtgccacgccaagggaggggctggggcatggaagaggcctcagcagagttagttcttgccccggtgaccttggcgttaaccactcctgtgtgtggccatcagcaggttagggagccctgtaggcctggctctaggtcccgctgggccctgacctgtgtgcacccgtcacctcccagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtatgttccctcccagaggccctgacagacttggggtccacaggggaagccagaggtgcccttggcaagggtggagctgggggctgggctctgcggggccctgtggccatgggaggttgcgggtcttggctccaggcagctttgagagtgagacggatagctcaccacataggagaaatcagaccgggaccaggcaggctgtggggtggagagagtggctaatttgggagatagagccgtagcacttatgaggggatgtatgtggttgatggttccaggtggcctctctacgaaccaacatggcatctctcgagcagaggccatgggccagtgggtgcgggctgccatcccccgacgacctcagagagggagttcccctaaaggtgcccatgggctgtggccctctagaccggggatccctttctcctcccttggtatgatcccacccatagagcagttttgcggggtcctggacaggccccagttttaggtgtcactctcctattcttcccagcaaggcttgccatcggccccttctcagcaattagaagtccctgcatggctcccacctccagagagttctttgcaccctctgcaggtttatgccccctgatgacccactgggccggcacgggcccagcctggacaacttcctgcgtaagaagccactcactttggagcacaggaagcagccgtgtccctatggtatggaacccagcctgccctccccggccctcctcactcctgcccttcctctcacctgtctgcctgtgccgtgttttcctcttggggacctccaccattggaccacccaaccccgtttcctgtgccaccccttccctgctctcatccctggttctgaagtgcccctgcttagagtccctcttgattcctcttccaggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctttcaagaggtgattgtctttgttatgctcagggctttgggctggcctctgggtgaggaaaggccagcaggtatgcaccccgacctccttcaccccaggaggaagcccctccacaccagctccctgacccttctctggaaggaagatttctaacaaacattcaccaggaatgcatagctccttggggatggggcatctttcccgaggccttggtctgggccttgttaggaggtgcccatggacgcacgagcgggcagggggctggagggggcagttaggcagcaaaagtgtaaaaggatttggagtccagttttatctgcaaaaagaaatcttacttacaatatacttgggcttctgtttgtttttgtgggacaggaagctaaaataccagactgtccagttcattatcagccacttggcaatgctgaatgacttgcccaaggtcccgcagaggaaggacagactggggcagggccttgagtcctggttctggtccccaaaccaggggggcaggaggggtgggcctggacactagtttgcagcaactcagggccctgcagggatgggggaggtgaaggtaccctcagccccacacctcacaactctcctaggtttcaacatccacataggaatccttccaggccaggcatgctggctcacgcctgtaatcccaacacttggaaggccaaggtgggcagattgcttgagctcaggagttcgagaccagcctggccaacatagggaaagcctatctctacaaaaaatacaaaattggctgggtgtggtggcatacacctgtacctgtagtcccagctacttgggctacggtaggaggatcacctgaacctcaggaggtggagactgcagtgagccatgattgcaccattgtgctccagcctgggtgacaaagtgagaccctgtctcaaaaaaaaaaaaaaggaatccctccagcatggcagctgaaaggaccaccctacccacctggtcagcagcagatgcccagcaaccccacctgccaagcccccgctgtctctgcacaccacagtggagccttgaggctgcctggaaaaaatagggaatgttctcacccctcttcccatcccagctgccagctggccacagccttgggagttcatacttgcttacttgcttcttgaccagagctgaactctaagccatttgctgcttctgctgtgtgtggggagggatgggcagtgggcagcaggtcctgactggctgtgccgtgtctggaggccaagtctggccctgctggttcactgataagccccggcaagggtggcagagctcatgtggcaggtgcctgaggggctgggatctagggaggactggtcagttccatgccccgctggcctgagcttgcatcctgtgctttccaggcaggcttagatgccccttcaggcctctttctcagtctgccaggcagagtgactccgaggctaccaggcccagtgccccagctgtgtttctttcccacgaattgggctttaactccaaagttctccccatcacctcctgctccactgcccattcaagcagcttaggtaggtggtatttgctcacagggcctcagtctccccacctgtaaaagggacacaatggtccttgcctctttctagatttgagagaataactcagttcctgtgaaaggaggagagggaggggtcctggattcaagcccccatcactagcgatgcagccctgggcaacccacttccctctcagagcctcagcttcctgcctcttcagaggcagcttccctccgagagggggacagggatggaatgtgactcctgcatgctggaaaagatcaaattctggggagctgccccagttgctctttcctcctcttgttttcctggttccaggagccagaagctgatgaggaaaccagtaagtatgcaaattctggcactattgggaaatgatcctggggagctcacagaggacagcctcccacctgccctcccccacccccccacaggccccccaaccttgcccttgggctctcaccagcaggggccgaaccctgagttttattgcgagttctgtctcgcacacatgggttaacccctcttggagtgaagccagggtgactatggccaatctgtcctcagaaaacctccagcctccctagcagagagcaaacgagcccacaatgggatgaaagatccctgctctggatgtctcagcccagtccccatcccacttctctagagtgggggaaactcaggagtccccaaagacctgggacctaagctaggagcagaactttagaggtccgggggagcagctctccaatccccccctccccgccagtgctgctcacacccccctcgttgtagtctcctgcagggggggacaggtggtgtctgggaaggggccagtactcctcaccgcagctgccacttccctcatcttcccccagcaaagctctcagccctcccttccccatgcctcctggaaaagccagcatttgtcttctgtacacagaagggaaagaccctagccctgagggaggtgctgggcaggcctctaccaagacaagagtgagtgagcagcagagaaagtgggacttggggggcacatatctctaggagctgcagggaaggaagtggtgcaatcagcctcagccctgggcccagctggtccctagaggacgcttccccaaaagaaggcagcccaaggaccctagcacttttgtcccagggcttctcaaacttctggctttttttttttcttggaccatagcagagtgggtggagtagagggtggcaagggcctgttctggggacctcccagttcatgggaagggtgtgggagatttgcctgaaagaggcaggaagtagggccctacaactaaggaaacccaagccatcccaggccatggcatgtaaatccttccagctagttcctgaaggggaagaggccctaggctgtcatcctgaggtgtggccttgttaagctcctctcaaggcagctgctggtgatcttcaactgctcatccatttaagagatgtcagcaaaacgaggtgggaggaaaggatcaggcgccccaccccacactaagttgggcacattgctgggaggtcaagtcactgggaatggtgcaaaggctctaattctggctgctcgtgggctgcttgtggggccgtgcctgccacctgccggtgcttcctggtactgctacccatggagcaggggcctgcccaccagctctggcctggaaatgaagggcctagacacaaagatcttccagcaggatctgaaaacaataatttaaggagaataacatgggaagtaaagtgctaagccaaaaacagggaattcttaatggcatttgcagctccgccctggaaagaaacaccagaggtcactgtcatgccttctacaaagtctaaagctctagaaactttcaactgttccaggtaacaaatatcccaagaaaaactctcaggaactgaaggaataaaaaggaaaggagaaaaaaatataaacattctttttttttcgagacagggccttactccgtcttccgggctggagtgcagtggcacaatcacagctcactgcagcctcaacttcccgggctcaggtgattcccccacctcagcctcccgagtagctggcactacaggcatgtgccactatgcctgggtaattttttggtatttttgtagagatggggtttcaccaagttactcaggctggtcttgaactcctgggttcaaagcaaatccaaccaccacagcctcccaaggtgctgggattttatagtcatgagccaacacacccagctatttttttatgtttgttgtttttttcaaggaatctttttttagagacaaagtcactctgtcacccagactggagtgcagtggcatgaccacagctaactgctgcctcgacttccagggcttaagtgatcctcccacaccacaacacctggctaatttattttttgtagaaacagggtcttactttgttgcccaggctagtcttgaactcctgggctcaagcgatcctcccatcatggcctcccaccatcctcctgccttggcctcccaaagtgctgggattacaggcatgagccagcatgcctggcctcactgctgagaatttaccctacaagtactcttacttgcaaaattatgcatctagggctatttaatctgacagtgtctgaaacagcaaaagatgggaaacaatattaatgcaatcaacagaggactgattaagtaaactttggtatacacacgcaacagaatataaagtagccaataaaaataacgaggcagttgtacacatggaatgttttctgtgctagactgctagatgaaaaaagcaaggagagaacagtatacacagtatgctaccatttctgtgaacagacacatgcatgtgtgcctactgctcatacacgtacaaaggtcctcaggaaggacataatggaactctggggttgcctctgggaaagggaactgatagctgagggacaggagcacttcctttaccctgaatatacttcagtgccatttgagcacatgctatttgcatgttgctacagtctgaatgtttatgtatccccaaaattcataggttgaaatactaacccccaaagtgatggaattaagagaagtggccttggggtgcttaaattatgaggacagaatgctcataaatgggattagtgtccttataaaagaggcctgaggagtcaggtgtggtggctcacgcctgtaatcccagcactttgggaggctgaggcagaaggatggcttgagcccaggagtttgagaccagactgggcaacaaagtgagaccctgtctctaaaaaaataaaaataaataaaagagccctgaggcctggcatgatggctcacatccagaatcccagcactttgggaggccaaggcaaggagggtcacttcagccgagttcaaaaccagacttggcaacataccaagaccctgcctacaaaacattaaaaaaaaaactagccaggtgtgagggcacatacctgtagtcccagctaattgggaggctgaggtgagagggtcacttgagcctgggaagttgaggctgcagtgacctgtgattgcaccactgcaccctagcctgggcaacaaagtgagatcacgtctcaaaaaattttttaaaaagaggcctaagggagcttgttcttccaccatgtgaggacacagctagaaggcaccatctgtgaaccagaaagcacaccttcaccagatactggatgttgctggtggcttgatcttggacttcctaatctccagaactataagaaatgtttgttgtttataagccatttagttaatatttttgttatagcagctcaaacagactaagacacatgtattcaaattaattaaatattttaaagtcctcccatccccacacccaggatacagaaataagttatcagggtgggggttgggagctgaggagggggctaggggtctccaaagtttattttctgtacacaaacagtaaaaacttgaagcatatacacctccaacatgtatatgctgttaaactatgataactgccacttttacagatcaaaaacaattatcagcagtttattgtggttcaaccttttatttataaattaatgacctacatgtactaatgaactaatattgatgtatatttgatgtatatatataaaatacatccaaagtgagaaactaaataaggctgagcctcaaaatgaatataaatcaaaggcctaatcttttcttcccacccccacccagccatcctgtgtgccctcttccccttggaggccactgccctaagtgaggatcagcatcgactccaccacagcccactttagtggtgacaacttttaatccacggaagcagtttttcaaagtgaaaactgtttcaaatcacgaagcttaccacttagacaattcagacaaggtaatgctcatttagactgacacaggtatgaaaattccaatcccttcttttcactatcattgtatctgacacacacatcaccttcctaggcactatgacactatcctgggagaagcaaatgtgtacaaagaagcacaatcctgctctctccccacacttcacataaaccagtatagtccccctgtagtcaaggcttcagatgtcaattttctgttggagacagcgtcttgctacgttactcaggctgaagtgcagtggccattcacagaaatgatcatagcatactgtagccttgaacttctggcttcaagcgatcctgctgcctctaagcctcccaagcagctgggactaaaggtgcatatcaccatgcccagcttgatgtgaatttttaagcaataatgcctcattaggccgggtgcagtggctcacgcctgtaatcctagcactttgggaggctgaggcaggtggattacgaagtcaggagtttgagtccagcctggccaatatggtgaaacccggtctctattgaaaataaaaaaaaactagctgggtgtggtagcacgcgcctgtagtctcagctactcgagaggctgaggcggaataattgcttgaaccctggaggcggaggtagcagtgagccaagattgtgccactgcactccagcctggacgacagagcaagactctgtctcaaaaaaataaataaataaaataatgcctcattaatttggagtaaggttggggggcatagaagacagaataaatgcaaaaactaagtcacagagtgtttcaagcttaggctctttaactttcaagcttagactatttatcgctcattttaattatcttctttactgcacaggtcaagatgtcaagaatactctatattgccaggtgccagggctcatgcctgtaatcccagcactttgggaggctgaggtgggtggattacctgaggtcaggagttcgagaccagcctgcccatcatggcaaaaccccatctccactaaaaatacaaaacttagatgggcatggtggtgcatgcctgtagtcccagctactggggaggctgaggcaggagaattgcttgatacctataatcccagcactttgggaggccaaggcagaaggactgcttgaggccaggaggactgcttgaggccagcctgggcaacatagcaagaagccatcattacaaaataaaaatgttttaaattagctgggaatggtggcatgcacctatagtcccaggtactagtaaggctgaagcaggaagatggcttgaccccagaagttcgaggctgcactgagctttgatcaggccgctgcactccagcctgggtgacagagcaagatcctgtcaataaataaataaataaataaataaataaataaaatatataaatacttaaataatctttttaagagcagtactattctgtctccagcaatgtcaaactatgagagtcaaaaatattttaaggtctgctgtgtgctttcctcagagggaaggaaactaggcatcccactgcagtttcataaatacgtaaataatctttttaagagcagtactattctttctttttttttttttttttgacagagtctcgctctgtcgcccaggctgctggagtgcagtggcgcaacagagcagtactattccatctctagcaatctcaaactgttaagagtcaaaaatattttttttttttgagatggagtctcgctctgtcgcccaggctggagtgcagtggcactatctcagctcactgtaagctccgcctcccaggttcatgccattctcctgcctcagcctcccgagtagctgggactaccggcacccgccaccacgctcagctaattttttgcatttttagtagagatggggtttcactgtgttcgccaggatggtctcgatctcctgacctcgtgatccgcccgcttcggcctcccaaagtgctgggattacaggtgtgagccaccgcacccagcccaagagtcaaaaatattttaaggtctgctgtgtgctttccccaaaaggaaggaaactgtaggcatcccactcctccctcccagcaaaggagaccaacagacaaaaaatacagaatgcttctaggatttttttttttaaggaataatctaaatataagaaactatttccttaaaaatcctgacactggagttctgctaccaaagacacagtcaaagatctaaatagccagagtcaaaaaaaaaaaaaaaaaaaaacccacaaaagtttatttgagaacaagagtgaaagcttttgcacatctgacaaggtagacttgttttacagtagatgccatccatattcagccctaccaatactatcacaaatgaaacatactatttcttacaaagatataggcataagtcaaggactatgactaactagagtgaaaggaaaggttagaccccaaatcttatcccttagaccaatcataacataggatgtaaattaaaccattcagtcttctaatgtagtggttctcaacctggcttcttatcagaatcccaggaactcttttaaagaaattcccaataactaggctgtaccccagtctctagggatgggatccaggcatgagtattttaaagcttctcaggtgattccaatgtgcagccagaccctgtcgcaagttcaccacagcactagaggcaggtaacgattactagcagattcctcagccccaacaagccctccaagaaagggagacctggtgggcaacactggctctcactgatgctatcctttcactccacttaagaacgacataagttatcacttttggtataattttgagactttccatatgccatggtgatttttagagcaatatttaatcaggtgaataccagcaaagagagaaaatacagaaaaagaaatttccataaggcatgatatgaataaataagtgaaaaaacaatctcgggtttaaaagtaaagcatgagaatttgaagcctgtgaaattttatttatacaaaagaataaaaagttatttaaaaagaactgatttaaacttatgtttttccatttttcctgttccttgaacatgaatctactaccaactcagaaagatttaagataggtaattactaaacactctttacctccccttgcaaaaaacagaggcaagtttcccattttacttatgataaaccagattattttcagttatgaatattggcaactgcatgaaagagatgatcagatatgtcagcaggaaagtatgagctgtacaaaggcattacaaaaaaaccccaaagaaaataagataaaaacaacaagagaaaaacaagaaaacataaaacaatataagaaaatgccagatatttacagcctccatctgaaatgtgacttgtgttctactttcagcataaaacaaaaccagagaacatttcttgaagggtatcacagatgaagctggtgccagccagttttgggggagacattcattctaagaagggagaaacgcacagttagcaacttgccgggattacaacattgtcttgatcttcctgcagttctgttactaaaaatgacataaagtaagacccaatgtcttacagaaatgacttgtttgtcaccacatttagaacaaactactcaaagtcacaggcactgggtctgggagagcagaggtggatggccacgaactcaggtgaaggatgtttatctttgtgaggtcagagaagggaagcagggctctacagcctggaagcttctgcactaatgtgtcttctaatagtcctaaagaaagaaaaacaaaagtcccaacttactctcggcagaacagttgtttgaccctaaaggaaaaaaaaaatctcataaacaactctactaggggactgctctatagctaaagattatatttcaggccaggcacagtggctcacacctgtaatcccagcactttgggaagccgaggcagggagatcacgaggtcaggagttcgagaccagcctggccagcatagtgaaaccccgtctctactaaaaatacaaaacattggccagacatggt

SEQ ID NO: 695 - DNA, 2685 bp, Homo sapiens
atataaaggcgccgccgtccttgcccccaggactcggccccatggagacgccgccggccgccgctggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctttcaagag

SEQ ID NO: 696 - protein, 599 aa, Homo sapiens
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 697 - DNA, 45020 bp, Mus musculus
  misc_feature (1)...(45020): n = A,T,C or G
atcctcctgcctccagcactattccaggttgatagtagtgctgggcatggaactcagacagttccatgcatggtagataagcccctgccaaaagaactgttctagcccacccagaaccattctttctctttcttcctaggatgtggagtaagctaacaaaagggagaaaaatatggtaaaagccgggcgtggtggcgcacgcctttaatcccagcactcgggaggcagaggcaggtggatttctgagttcgaggccagcctgttctacaaagtgagttccaggacagccagagaaaccctgtctcgaaaaacaaaacaaacaaacaaaaaatatggtaaagggtctgccatgcaaacatgaaggcctgaagtcaatcaccagagacagccaacagcagtggtgtggggcatgcttggaacccctgcattggggaggcagaggctggaggggctctagggctggctgactggctgttaggctggcttgaactggtgaactccaggtccagggagagaccttgcctcaataaataaagtgacaagtgactgtggaagacacttgtaatatcaactttgggtttccacatgcacgtgtacctgtgcattcagacatgcaagcatgtatacacacacacatgcacacacacacacacacacacacacacagaatgtcagccccacccctagcaaccagtctctcctccagtataaaagacatctgatatgaactttgggctttcacatgcatatgtacttgtgcatgcatacatgtaaacacacacacacacacacagaatgtcatccccacccctagcaaccagttcctcctctgaatggaagacatctgataccaactttgagctttcacatgcatggatacctgacatgtaaacacacacacacacacacacacacacacacacacacacactgtcatccccaccccacccctagcaaccagctcctcctcctgtacggatgcgaggaagccctgtcagtaagcagatactcttgctcagagcctggagctcccttgcaggaaatccacgctgcccttttgctttgcctctgagtgaccccccttgctgctacgcttctttatgcatacttcctctactctttgaacagataccaagaccctgcaaatgcttggtccagacaaagacctctgagaacaaggggaagcctggaactggtgacagaactgacagcggctatggtttgagtgagaaatgcccgcagaggctcatgcacttgaaaactctgtccccaccgggtggtgctaattggggaggtgatggaacctttagcaggtggagccttgctggaaaaaatgtcactgggggtgggccttgagggtttatacagtcttgtcccatttcctatatgagtgctctctctctctctctctctctctctctctctctctctctctctctcccctgacagctgataaaatgtgattggccagcttcctacttctgccgccatcaccatgccatacctccccagaatgccatggctcctccccaccccacatgccatggctccccccactccacatgccatggctcacccccacccctcatgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagcatggtgacacttgtttatagtcccaggagtcaaacttagcatttgacagcatttatttataataagcccagcacttggggcggcaaaaggagaagcagtgtttcaaagtcatcttcagccatacagcaaatctgaggcaaatttaggctgcataagaccctagtttaatttcccccacaaacaaacaacaacaaaacaattttgcttatattgcattattttatttgagaaataaagatattcccaccctgcctgcaaagccaatcgctctaaccattactagcaccctttatcacccacaaaacaatctcctaaaccattctatataatataaacgtttggacagtaattaagcaattagggcctaataaccccataatgactatgtctgtgagcagcatatggtgatgcacattctactgagtgacaattacatatttccgcaaggtatagtggcacatatctagaatcccagcatgggggaggccaaagtggcaggatcaagagttcaaggctagcctgaaagccaggtgtgctgtggtggcacaggcctttaatcccagtactcaggagacagaggcagggagatctctgtgagttcaaagccagtctggtctacagaacaagctccaggacagcacaaattctaggacagccacagctgatatacagagaaactctgtatacgtatgtgtaagctctgaagtaacaacaacaacaacaacaacaacaaaaaaaaagacaaagtaaacaatataatatataccaaagataaaactgcatatacatgatggaacacatatagtctagataccaaggaggcaacagacaatactcccactcatgattattagaaaagtagacaaagtatgcacactagctgcttaaaaatgagatagacttaataaggtagtaaaacttaccgggtcaagtcccaagaacaaacagtacttaagagagtcaactcctagctggacagtggtggtacacgcatttaatctcagcactcaggaggcagaggcaggtggatctctgagttccttgtgagtctggtctacagaataagtcccaatacagtcatagctacacaaagagaccttgtcttgaaaaaccacaaaccaaaagagagtgcacaccagccccatatgtgaaacttctttacctcacttgagataaaccttgatatttagcccaggctagtcccaaattccaggattctgagtcgctgaggccacacacagaagcagaatgccacacctggtttcctggtttcgggaagagaagagcacaaagacaagagctggagtccgggagccaccaagaatcttttaattcctaattgcttgttttagatttctctttgctggtgctgaactgaaccctgaatattacacataccaggaaaacactatatctgtgagccatgcctttgtccctcactgggggattccaggcaggtcttctgctactgagctacacctttgaacacctttgaacaaccctcttgtctcaggattgcaggcaggagccactgggtccacttcaccttcaactgtttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacgtgggggccgacacaatcccgagtagacaatccgtttactttagcctatctgtttaaatatcaatctaatttgagtcatgctcacagaacccagaaataatgtttgaccaaatatctaggtgccctgtaacctagtcaagctgacacataaactatctgtctgcggcaaaataagaagtaccacccgagcacatgcagtttgacattggaagctaagctggctaggcttggctgactcgggagaaatgcagacagaacccacctcaccatagtttaacttatgatctttcaactttacgacggtggggaaatgatacaaatttagtagacaccactcatcagttcctgaaattttacatagtcccaaggttagcaatatgaattcggtccccttgttgtgacacggtccagggcaatgagctgccgcttccagacagccacgggaccacaaaggaaagccaacaatactatatagaatagtatcctgctaagctctcaaagttggtatggtaggtgtgatggtaggtagttattgtcagttgacgaatattcaagaatcacctgagaagaaagccttagtggaagaattttctagatcgtgactgttgggggctgtcttgattgttaattgatacaggaagatacgggacccttgagggcagcactattccctaggtgggggattctgaacagtataagagagaagcaagcaaaggattcagacagtggctatgatgctttgaatttgtacttgactctccgagagtaaggaactgtaattgtaaacttaaagggagcctagagttccctctaagttgctgacctaagcctagtcccagaagcttctagcctgcgtacaattttatctgttaggtctgcccaatctcatatgatgtgcatgcatatgatgtatgtgtatacagtgcgcatgtgtgtatgcacattcctgtgtgtgagtgttggtgcacaggtactatggtatgcttttggaggtcagaggtcaacctccggtgtcagtccctgtcttataccttgtaagaggcagcgtttcctgttcatacctgtgcacaccaggctagctggcctgtgagtgtcctaggatttagctgtgtccctctcccatccagccataaacacagaaccattatagatgtggctacattggctttgtgtggggtctgaggatgtgaactcagagttgtatggtgagtgctttttaaagatatttatccatttatttattcgtttattcatttatttagtatatgtgaatacactgtgactgtcttcagacacaccagaagagggcatcagatcccattacagatggctttgagccaccatgtagttgctgggaattgaactcgggacctctggaagagcagtcagtgctcttaaccgctgagccatctctccagccctgcaagtgctttttaaactgagccatctctccagcccaaacttttccctttatacgttgataatctcaagtgttttataaaagtgatgagaagccagtgcaccatctaccctgacaactaattttttcacagacagacttctcattttggatactaaattggtgtcattgcagaagtctaacaagtaagcactggctaactcaatgcttactctctttggaattccactgattacaccaggctatgatggtctcttaggagagaccagagcaggaggccattcttgctccctacattgtattaaaaacttcaagtctcaaaatgcttttgtagtttccactgttgtagaacaaggcagcttgacttaaagaaccttgtgtaatactaaaaactcaggctggagagatgggtcagtggttaaaggcactgactgctcttccaggggtcctgagttcaattcccagcaaccacatggtggctcacaaccatctgtaatgggatctgatgccctcttctggggtgtctgaagacagctacagtgcacctatatataataaataaatctttaaaaaccaaaaaactaggaactcaattgcccccataaagcatgaaagttgtagcctttgtttagactaacatgctaaccagtgactcaaaagacagaatggaagccagctgtggtggcgcacacctttattcctggcccttggaaggcagaatccgggggatctccgtgaagtctgtgccagcttgggctaagttgcaagttccagactagccaggtatacacagtgagattctgtgagattattaaaaatcagattattactgaatggctcttattttatgggtgctgttgtgttttgccaacttgactggatttagcgtcacctagcagacacatctgggcatgtctgaatgtggcggctccatcctttagtgcagctgaggctctgaacactattttcttgttacttccttcccaagtgtgggcacatgtttgtatccagcagcctccagctcccttggccatgtcttccctgcatgaggtaccgcatcccttcaaacaaccagccaaaataactccttccttccttaagtggtttttgcatggatcttctcacaacccagataaagaaacaaaccaacatgactgcacacttctcgtcattgactgtagacagtatattttcatctatccagactaaacttcttcagagaagacactctcttttgtaaagagttggagtctaagtgaaacacagctgaggttttccttgtttgcttttggctctgggtaccaactgtatacactctggaaatggctcacttaccccacaatgcataaggaagccttgctttccaggaatgctatttttcctctgtccagttgtctctgaggtaggatatccaacttacaattatcttcccactccattcccttgcttccccatgacaggacctgtagccatggaataaattcaaattataagagctctaagtcaggaagaactctaagtctgtgaacaactgaactatttaactgtaaataataccacatgggtgtgcgattggagtattgcagatttgcctctgtagacggtgccttacaatcaagggcttctggatggaagttgcttgaagtcccgtctctatttaaggtcatgcagactgcttggccttgctcaattaggatgtagtgtgaagagatcaaatgttatagactccagaagtatctcggggcatctcaggccatttagtagttatctactagccttcatttccctttttgaatctttgatttttaatagaacacacacacatacatacatacatacatgtcactgtcttcagtcacatctgaaatgggcatcagatcccattacagatggttgtgagccaccatgtggttgctgggaattgaactcaggtcctctggaagagcagtcagtgctcttaaccactgagccatctctccagcctagtgagtcttcatttttgaggctgccctcaaacacttattgccctacactggctctgatcttcctccctctgcctttgaagtgcttgccgttacaggcacgtggcaccgcgtcaggtttgtacagggctggagctaacagaggggtttgtgactgttaggtaagcactcttgtcaactgagctacaacactagccatgatctttatttttatacttagctaaccttctcaggtttgttatgtaaagcccttgtggtgtatcagcagatctctagcttcctccaacactaaggctaagagttctctaacctaagttgaaacctaggaaagattgactcttcttgctataaccctcctatccgatgttccactaatgcaactctgctaaatgttctgatttatgactttctcttgtcctgcaactataaaagttcacccaaggccagcgagatggcttggtgggaaaaccgcttgctgaacaagtccgaccacatgagttggatctctggaatccgtgtaaaggtgaaagcagagaactgagttcacagagctgacctctgaccaccatatgagtgctacccactcacacagcacacacacacactcacactcacacacacactcacacacacactcacactcacacacacacacactcacacacacacacacacacacacacacacacacacagaccgataataattctaaagaccataacgcaactggtttcaaggtgggcaaacacttagggtaaggaatccgagcactgctaagcaatgctcatggatatttgactcgaaatagactattcccttatttctgttagggcagtgtttactgtccactgggtcaaatatatagaccaccacaagacaaggactagggtgcctacctctagtggaacctgggtacttactggttgcttcataatttctaccagagcaggggcaacagtctgattggatgtggcgttcagggcagttcttataaattgcatctacatagaatacactctttccatgtcaccattgcgccttcttgtggtgtcattgtgggtgcaggaacaagtgtctaggaacagtcaaggggactcttaggtagacttgagactttctactgagggttcatggcagggacagtcctccaggcagaaaatagtcaccagttctgagccaccctctatgaaggaacacaaacatagtttcaagggctggcaagatggctcagcttaaaagattgtattgttctcgctgaggacctgagctcagttcccagcacccacatgctgtaacttacaattccagctccaagaggatctgttgttctcttggcctccaggggcacctgaattcacatgcgtataccaacacagacatccatataataataataataattataattattattatattaataataataattattattattgttattttggagatagggtttctctgtgtagccctggctgtcctggaactcactctgtagatcgggctggcctcgaactcagaaatccacctgcctctgcctcccaagtgctgggattaaaggcgtgcgcctccaccgcccggccacataaatatttttattttattttatttattttatttattttattttattttattttatttattttgaattgttcttcagaaccacaaagcctgagagatcctagctcagtaatttgtaacagaaagcacttgagaagctcccaacgctgcacacttgggccatggttcagaaatgtgtgtgtttgtatgtgtgtgtgtgtgtgtgctaaaatcttaaagaaaggagtaggatgcccatccagttccacaagcacgccctagcgctgacgagcggctgcctcacttgagcagcagccgctcttcagacagaacacgccaacaaaggctacgttctgcgcctgcgcctgcgccaagagccagctgagagcggccgctctgcgcaggctctccggtcacttccgggatctgtcagcctctccctctaggcctccctcctccgtccgcgcccgccggagccagttcgcgtcgactgaccagagtccgcgaatcgtccgctccggacctccagacctccccaacctcaggtaaggagccgcagggcggagagtctggcccgggtcgcctccattttttttttgtatgttctatggcacgcgggggcggcgggcccagggcggttaggcgcggggtctggagctgaggggcccggaatctcagtccttcgtggttacctctgagtccctggtgcacccctcacacacagaccgagcgtttctgagcactttccagctgccctccatctcggatgagagaaggaacaactcggcttccgacacccccatagtaccatttgcacccctactgtgagcatttaccacaatctgtaaaattagtttagacgggcggatctcccccccatcccccggtggcttgtcacgagtatctgttcatctcgtcaacatctaggatgttgcctagagcagcctccgaaccgtcagttattggggaacccttcccagcaagagaaagcccatctttccagtaaccttaagattccctagctctagcccccgcccccgcaagtcagacttgtactctcctctgcacccgtattcatagggtcctttatgtagaaccctccgagttcccgtttgactctgccactttgtcaggtgtctctgggaaggttgtttcttggtgcctcagtttccccagctgcagtaagaagattcttagtctacttggttttatgggtttcgcgtggagttcgtgtgcttgagttgcttacagcaattcctaacccagagaagctgttcaaatgatctgataataaatgatagccattactggtgcttctgagactttcaaggcatatctgccttcctttactttctgctctctttcctccggagaaggacatgaggacaaggatttattcatgttcctggccccgttcagatactgaacactgttgggaacatgggaggcacttaataaattgcagcttagaatctctgagtataaagccatctgttgtcatggtgtgtttctctcctatcttctccttgcccagtttctgaaatgacctaggttggcatcctattttatcagttcccttaatcttttggtttcctagtaggccttaggatttcaggtctctataagttatcagtcccgggtgtttaccccattagatcaagtcactggctgtctcaggggtgggggttgggggaaggcttcttcaattcatatgctgttcacagctgagaggacccattggaaattgcagactcctttagaggatgggtggcagtgttttgaatctaaattatctagtgttaggtcaaaataagttctctacaggaagtgtggagatggtctgatgaagctggaatttctaatgaagcctgtcagaacattggtagggcgtggtgacctgttggagcacaggtatcgctgggctgggtaaggagagcaattagaaactagatgaaagccgggcgtagtggcgcacgcctttaatgccagcactcgggaggcagaggcaggcggatttctgagttcgaggccggcctggtctacagagtgagctccaggacagccagggctatacagagaaaccctgtctcaaaaaaccaaaaaaaaaaaaaaaaaaaagaaaaagaaaaaagaaactaggtgaatcaatgacttgaatgacttgaaattgaccctaacagggaatggaaactctaacttatgtgaatttgtcaagtcccagtggaatggggtcaagacaccaacatgtccttctaggactggttcaaagctttgtgtcagaggaagaaagaaaaccaatttactgggcttccaagatggctccaccactaaaggctaggcttacaacccaaaagatcagagaactaacttaccggaatcagttttgtgctgcttttatgtgctatctcatttaatcttcccaacggttgtcttgtaatgccatttggagatgaaatgaaaatttgcccagcatctcatgtgtgtgtcaaaatgaagattcaagctcaggtcccctcgtctcagatttccatggctaactcgacattaacatgactccacttgaaggctgggaatgtggctgagttggtgcagcccttgcctggtgtgcacagtgcataggtaggtaggctcaccagtagggcaggaagaaagaccatgctaagtgaaagctgaagagagtaggagcctcttccttcagtcctctttatccctcagtgctggacagtggcaacaggcgcctgatgcctgcgttttggttggttggttttgtttgaggcagagtctcaactgtatatagtcctggttggcctgggactcacagagatccttccgcctctgcctcacgagtgcccagaaaaaccttttaagttcatgcaatcgcctatggtgttcccttttctccttttgagtcttgttaagattttcaaacattgcttaaataccacctgcagcttagtgacttaaaattatcaccatatgaatgaaggtttattttacttggtacaaaattgtggcttaaaatagccaaatgactataaaggaaggatatgtctgaatgcgtgttcaattataggacttgactatagacaaaattagaaatgcagttgtagaagtatttctgctgttgtgtgactggtcatctcttttggaaccttaagtatgtatgtccttaagaaaaactaaataggagaatgagaaagtctctatctgcatgtgcaactttcagctcttcatgaaataggcatccctattacatgtggatatccaagttattagtttacaaaccagttttgttcagtaacaagcgagtccatcagatttggttttaagcttcattgcttgcagttaataatatttgtaacaacccgttttttaaaaggtgtgtatgtgtatgttgccatacgtgggtagttgcctgcagaggtgtcaggttctttggaactggatatacacagaagctgcttgacattgctgggaactgaattctggtcctggaagagcagcaagtgctgttgaccattgaacttccccccccccagcccccccaggtcccataagatgttattttgagtttaacagttattagaaacgagagatacggacactgtgtatgtgcatatgtgctgtggtgcatatgtgaaagtcagaagacagtttggttctcttctaccatgtaggctctaggcaacaaactcaggtcattagacttgccaccaaaccccttttgctagctgagccatcatcatattagccctcagctctttgttctgagacaaggtttcactgtgtagctctgactggcctggaatgaatagtgagtctcctgcctctgccttctgagtgctgagattacagttatgtgccatcttgaaagtttgtttatttgtttctgtttttacaatgcgagtcttgccaggtgtggtggtgcacacctttaatcccagcacttggaaggcagaggcaggcggatttctgagttcgaggccagtctggtctacaaagtgagttccaggacagccaaggctgcacagagaaaccctgtctcgaaaaaccaaaaaaaaaaaaaaaaaaaagaatgggagtcttactacataaccttggctggctcagaactcactatgtagatcaggcaaacctggaactcatagaaaaccaactgcctccacctccctagtgctaggattaaaggcttgctccaccacactaagatgagaacttaggtttaaaaaaaaattaagcagtctcatttaaatttatatttatttatttatttatttactttggtttttcaagacagggtttctctgtatagccctggctgtcctggaactcactttgtagaccaggctagcctcgaactcagaaatccgcctgcctctgtgattaaaggcatgcgccaccacgctcagcttatttatttttaaaagatttatttattatatgtaagtacattgtagctgtcttcagacactccagaagagggggtcacatctagttgtggattgttgtgagccaccatgtggttgttgggatttgaactttctgaagagcagttggtggtctgaaccactgagccatctctccaggcccccaaagatttatttattattatacataagtacactgtagctaacttcagacgcaccagaagagcgtatcagatctcattatgggtggttgtaagccaccatgtggttgtaggcatttgaacacaggaccttcagaagagcactcagtgctcttaaccgctgagccatctcgccagtccctgaatttaatttttaaaaaagttttgtgacttccaagtaatgcctggcttgtttgaagtgcccaggtctttactttgcatgccttctcccccacccccaaaaagtaaggagctagagggatgactcagcgtttaagagtatatactactgctcttgcagaagatgcagatttggttcctagcacctcatcagtcgcctcataactgtctatagctccagctccagaggatccagcaccctcttctggcttctgtaggcactgcacttgggtatatgaacacacacatacacacaattaaaattttaaaaatctttttttagagtaaattaagatgaaagtcaaattaaaggctctttatgagttggagtttgctttctagaacctataaaaggaaaaaagtactaaaatatttcactgtttttgcaggtagctcaggctggccctgtatttactgaatggctgaggacaacattgaattgctggtccttttatctgcccctccaaagtgctggttttacatatgtgcaccaccgcatccagcacaatggcttcgctcttacagcgagtctattggcggtagatagccggtgtatttagttaagggcatacttacttcttttaaccttggttcctttagcagagtgtttcttttctgagccacgggcactcatttttgtttattgggttttacccgttgtttgcctcacaactttctgatgtctcttgcattaattttctgctagtgtcagaattcctatctcgctgggcatggaggcacatgcctgcagtcaggaagctaaggcagaaggattgttaattggaaaccagcttgggctacatacaaagactatctcaaatgaaaagacattaatcacagcatttagtcggcaggggcagctggatctctattagtttgaggttaacctggtctacattgtgagttccaggcagccaaggctgtatagtgaggagaaaggacatttcatcccaaacacatcatcactttaccccttaacagctaagtcttattcctacctaaggcaataccattatcatagctaggatgaacataatttcatgctgttatataataaccaagttcaaattcaaatttgttacacaacacatgtcttttatggttatttttaaatataccaattataatcaaccatcttttgtgacatttgattttcatagctcttttgatatctggtacagattcttccctctacctcccaagtgctgggatcttggctatttgctaccatacctgtccatcctgcctttaaatagtccaggcaagctgttttctagaggtagagggtacctctgggatttttagagagacagagagtgagtgagtgtgtcagtatgtgtttatgtgtgtttgtgcatagatgggaactgtgtgtttttggtgtgcatgcatgggagtgtgccacagcatgatcagacactaaaggacagcctctggtgtcagtcctcaccttctaccttgtttgcgacagggacccttctgttgtatacaactgtgtgtcctggggccttcctgagagtttactgtctccaccttctgtctccctgaagcatcactgtgggggagtccacagaggcactcacttctgtttccagctctcttcagggtctggggaaccagagctcaggtcttctggcttgtacagcaagctttaaccgctgagcatatctgaagagctacatgagttttgacttcatttcttggtgttgcgtgactacacctttcctctttatctcctataaactgaaagtgagacccagaccttgattggatgtagagtaaatatgtttggcaggttgcttcataactgggttgatcgtcttccaaggtttatctaggatggtcctgtaacttcctgtttgactgactgactgacttgactttctgttaagggagagtctactccatagcccaggatggaaggaagctctcccagagttcctctcgcctctgcctgctgagtgctaagataagacacacttagtcaggtttacttttattctaagatgacttgtgtgtctctggggatatgtccttgtgagtgcagatgctgcggagctggagttagagtggctgtaggtgctgagactaaccctgctcctgtgtagtagctgagtgcactcctacctgctgatccatcttcagccctattcttcctcctcctcttttcagtgggggattaacccaggggcttccacatgctgggcaagcactataccattgagctatccctgggcctttctgccttgactatccattttgttcttacaagtgtcccggtgtggaggtgtggatgacaaattaaatcgttttcaagttatgatatgttggtcatgttccctcctccgggactgctggtttagattgctccgctcccctgtttgtagctacaggtttggttacttggtcaagttgatgcctccagatttctttattgtgaaagcatgtttcccttctcatactgagtaagttctgtgtggagtagtaatttgaggctgaatatcccactccatcagtctttgacctgtgattaatgaccctcgagagtagattctgtactggtggttactgtgctccagtccttgttacggaattgatttttgcattgagattgagtcttctctaatgggagatcaatgttgtatttacccccaaatagtttgggtccctctgacaacttaaactctttttttgtttttttggttttttgttgttgttgttgttttttgagacagggtttctctgtatagccctggctgtcctggaactcactctgtagaccaggctggcctcgaactcagaaatccgcctgcctctgcctcccaagtgctgggattaaaggcgtgcgccaccaccaccttcctacaacttaaactcttattgcatgacattttgagtgttttctttcctgttgcttgttacagctttctgacctgtgaaaacacttaagaatcatgtctctgcatcagtttctgctggagccaatcacctgccatgcctggaacagggatcgtacccgtaagtgtgctttgaatttcctgatgcttttgtgtgggggtggggttgtgtagagcccagagatccacgtcaagtgtcttcctttattgctccttgccaccctttttcttttgagaccaggtctctcagtgaacttggagcacttcagtttggctaggctggcctgccagtggccattgagctgcaggtatcttccatcttggccccaccatgccaccccagtgctgagcttatggacataagctgctccactagtttttacatgggtttgggggattatactcaggtcctcctatttacgtggcaagcacattaccaactgagctattgcccagcttgtgtgtgtgtgtgtgtgtgtgtgtgtgcgtgcgagaggggatctggggaagacatcattgatcccaaggtttctccaatgctagacaagtacactatcatggaactacatctttgcttcccttttctaatactttcaatacacctcacatgtaggtattttcaggattcacatatttcaattttgtggaaaaatgtaaacatcagccttttcaaacatataaatcagtagttttaatatatccactgcaccagttattttatctaactttttttttggggggggggggttgagacaaggtttctctgtgtagctccagctgtccttgaactcagaggtcacctgcctctgccacccaagtgctgggattaaaggcatgagctatactgccctgctattttgtctaattttaaatttcagattgaatttatttattttttttggctattcttgtgttcactctgtagaccagactagcctccaactcagagatctgccatcttctgcctctcaagtgctgggattaaaagcatgtgccaccactgcctggctcagattgaattttcttaatatgaaagtcataaattgaaattcttggagatccaaaactttttgagttccaacatgatggacagaagtcttgcattttggcttattgtggctcgtgcctgaagttccagcacttggaaagctgatgcaggagttctggtcttgcttggactaagtgcgactctaagaaccaaaggagagaggctgtgaccgagctcagtggtagatcctgcagtcacagttctctccagtgctgcagagaacaacaggggtggctgcagactgacagttgtgctgctttcctttccagagatcgccctgagccccaataaccatgaggtgcacatctataagaagaatgggagtcagtggacgaaagcgcacgagctgaaggaacataatgggcatatcacaggtaaggctctgcaggctcgctgtgctctttccaaacaaagcgctctcctcagtaagtaaggggcctcatcaagctaagtggaccctctaatttcaagccccgaaggatttactgagtcttttctttctttcctttctttcctttctttccttcgttcttctttctctttttttttccttcaggttttttgagacaaggtctctatgtggctctggctatcttggaacttactatatgtagactaggctggctttgaactcacagagaattgcctgctcttgcctcacaattcctagaattaaagtcatctggctgaatttttctttaatttgaggaaaaaacagtaactttgttacatgcttcttgtggcccagcagccacacaacactcctgtagtccatggagggcactgagcctgctccacaggtgggatgagccaggaaagccaaagctggaccctgtgaactggaagcaccaagcacatttgcagctcactgcctttgctatgggacacatcttcctttgtgctgtctgaggagccaggatggcttttgaatgaggccagtgaggcctctgtggtaaaagcatgtgctgctgagcttcaggtggagaagaggctccagctgtcatctgacttctgcatgtgtactgccgcatgcaaagccctcacgcgcatgctctgcattgaagctgttaaaactgaagcaggagagatacagccagcatcttgtcagattacctttcacacagttaacagagtcttctgagtcaggaaatcatcttggtttctatgccggaacacttaaaaggtgtacaggagtaagaaaggattgacgtccaccttgtctggggtctctctgcttcactagaagatctcatccaggcttgttcagtatgtatgctggtgctcagacattcatgacatgttttcagttctgacaaataagaaactgtccagaaaccgctgagccatccattgcttagagtttgctctactatttggtcattgtctctgagaggtggagggaagaggattagaatttcagtgtcatcctcagttgcataaagaagtttgaccaaaaaaaacccaaacaaacaaacaaaaacaaaacaaaacaaaaaaccaatcagccgggcatggtgggtggcgcacgcctttaatcccagcacttgggaggcagaggcaggtggatttctgagttcgaggccagcctggtctacagagtgagttccaggacagccagggctatatagagaaaccctgtctcgaaacacccccctcccccccaaaaaaagaagtttgatgccagtctgggctgtatgagactgtcatatactgattagcctaaacatattctcacccagatcagagaaacagcaaacaaaaaacaacacagcatgtttttgaccttctgtgccctttgaagttgttcggccctggggctggtgagatggctcattagataaagaacctgcctcgaaagcatgaacacatgggtttgaatcccccaaagccaggcatggctgaatgccagctagacagtctagccaaaacagtaagcttcaggtgcagggagaagtcctgtttggaaaagacaagggcagaacagtagaggaggatgcccaaggctggtctctggtttctgtgcacatgcacttgcacgcacacagaaaaattgtccagcatccaaggaggttatggttcctaaccgtgcttcctgcttttacctggtggtttgtatgcggtgcttctaagctctagagcttcctgtggcatcaaagccagcagtgttgctcttgctttccgtgaccttgttcctatagatttggcctcatgcttatgagtaaggacactcatcttaggctttttttgggcttttttttttttttttgagacagggtttccctgtgtagccctggctgtcctggaactcactctgtagaccaggctggcctcgaactcagaaatccacttgcctctgcctcccgagtgctgggattaaaggcatgcgccacaggaaatatttttaaatgagaaaagactaaaatggaaggacccttccctccttcccccaaagagccaaaactgtaaaatacttaaacttttcttcctacatctcttggggtcctttgaacttggacccattttctgatagcatttgttagatctgaagaacttagaaaagtctacatatacttttaacagacctagggtcaacagtgctctctcagactgtaaatatgaggaggcaggatctgttgaactctagaagagactatcagcatttcatagagcagagtggggcgtgggtggagttctggccactctgagttgatttcttggggttagctacttgatcatcacgccccctcctttttttttttttttttttttttgacctggtctcatgtcctggatggcctggaactctatgtagacaaagttggctttgaattcatagagacctgcctgtctctgtgtcctgtgtgtttggactaaaatcatgtaccaccacatatcatggctactatttctttttttttcctttttttttttttcttttgtctaggcagggtttctcttgccctgactgccctagaactctctctgtagatcatgctggtctagaacttagagatccacctgcctctgcttctaagtgctgagattaaaggtataaaccacttgcctgatgctctgctactttaagatattttcctgggccgagaggacaactcagtggataaagtgcttgtctgtggaagtgtgagggctggagttcagacccctggagcccacagaaatgctgggcagactgctgcccaggaccccagctctctgaaggaacagtcggggatacccagcacaagctaggtagctagaatagcaggaaatgacaagctttgagttcagtgagaccctgcctcaataagtaaaggtggagaatgatcaagaaagatacctgacgacaatttcaggcctccagaggcacgtgggaacgtgtgcagcccatatgtaaaaacaaaacaagcccaaaactattttattatagaaatcttatatgactgtgtgtgtatgtgtatgtgtgtgtgtgtctgtctgcgcgcatgcgcatatgcatgcgtgctaggcatgatggcatctgtaatcccaacactaggaggtagaagcagaaggatcaggggtttaagagtattctcagccacattgtgatttcaaggccacctgggcttcttaacaccgtgtgccaaaagaaaacacaaattcccagttctgttctacctggctttgtaaggatcctgcgtcctctggtgtccttaggagagaaacagccttggttttgtatgagataataaccatagataggagaaggaggggaagaaaccactaagcccacagttaccccatgcccagctgtcacccgccaatagcccagtcccttgccactggccaggcgtagcaagtgacctgtgcttcacttttaggtattgactgggctcctaagagcgaccgtattgtcacttgtggggcagaccgcaacgcctatgtctggagtcagaaagatggcatctggaagcccaccctggtgatcctgaggattaaccgtgcagccacttttgtgaagtggtccccacttgagaacaagtttgctgtggggagcggagcccggctcatctctgtctgttactttgagtctgagaatgactggtgagccaagttgcatgtgtcctctcactctgctttgtatactccatgctgggatgctgtgctcctgggacctgttgaggctctgtgtactgcagtgcccttcctggcctggagaggctttctccctctcaactcgtatgcgcatgactcagctcccataccttttctttgactcttcacttcccttccttactcctctacttccttttgtccattacttcctccctaccccttctttcccttccctccttcagctccttcatttcctccttccagctcccgacttatcttaattcacatgggcaacatttcctcctggctgagctctctttacagtttactgtttgtgttagatcgtccccttccaggtaaattagacctgactgtggtctcatgtagtctgaaaagaagctgtatattcagtgaagtttcccagctgtagggcagtcatcaggccaggtgtggtgcacacacatgtaatccagcactcaggagtttgagaccagcctggggtacgggtagcgagtctaaggctagcctgaactatgtataggtggcttttatccaacaaagagcaagcatatgggccacccttcatcaggagcaactgccttagaggtggcccataaaaaagcactcaggtataaatcaaaggacatcagtagaacattaaaaataattgtcaacgtgagttccaggacagccagagctatacagagaaaccctgcctcgaaacacaaaacaaaacaaaaaaataattgtacttataggacttacttcagtaatgtagctaacatttcttgtggattccagtatttgaatgatagttatgaatgtgtagttcagctgttggatttgaagtagctttattggtgtggcttgcaaagtgttaccatttttgtttatgagaacagtggcaatcagtttttctcctttcttaggtgggtgagcaagcacattaagaagccgatccgctccacagtcctcagcttggactggcatcccaacaatgttttgctggctgcaggctcctgtgacttcaaatgcaggtaaagaagttctgagagacttgagctgcctgtggttcagcttgtcggacatccatggggttcctttttttttttgcagtctataatagcactgtaggggactgatgaaggaacttatgtgtagaaaaggagctggggctagggttggcttagtggatggagtagttcccagctagtacaataccctggtttccatcccccagccctgcataagccaggcatggtggtgcatgcccataagcccagcattctagatgtaagccaggcgtggtggtgcatgcccataagcccagcattctagatgtaagccaggcatggtggtgcatgcccataagcccagcattctagatgtaagccaggcgtggtggtgcatgcccataagcccagcattctagatgtaagccaggcgtggtggtgcatacccataagcccagcattctagatgtaagccaggcatggtggtgcatgcccataagcccagcattctagatgtaagccaggcatggtggtgcatgcccataagcccagcattctagatgtaagccaggcgtggtggtgcatgcccagaagcccagcattctagatgtagaagaggaaagtcagaagttcacaatcatcctcagttacatactgagtttgaggccagtctgcttgatgtgagaccccacagagagagagagagagtgctggtgcacagtgactaaaagattaaaggaacaagtagtaaaagatgtgatggactaggtcttagggtaagtgggagctgcagcagggcagtgggcacgggagggtggcgagcacagtgagtgttctttaggcagagtatcagtagtttcaagttcaggattaactcatgctgtgtccatctgtccatctctctttcaatctttttctcagttttttttttttttaaataggtttgttatttatctgtatgcatgtgtgtatatgtgcctggctccccaagagctagagttataggtggttgggagccacctgggtgctgggaccccaactctagtcctctgcaagagcagcaagtgctcttaaccactgagccgtctcttcagtcctattctttggtttgaaacatgtagccccatttgatctagaactcaccatcttccctcagcttcctcttgtgctcaaattacaagcgtacaccttcatgcctgccagcctgtctttcttgaccacagtttgagttcctccttttgtatcccaagcctcagactgcagataacagagtgacctgacataaccaaatgtcactgaaccgtgtactgagaacagttattgcactgtcctcttcagttaaagtgttttatctgtcattagccagagggtagaggaagttggccatactgctaagagctttaagaatcataccatgggggctggagagatggctcagcggttaagaactctgactgctcttctaaaggtcctgagttcaaatcccagcaaccacatggtgactcacaaccacccgtaatgagatctgacgccctcttctggtttgtctgaagacagctacaatgtacttatgtattataataaacctttgggctgaagcgagaagggactgagagcaagcgaagttgaccggagcgagtgggcttgaccggagcaagtagaaggaggtcctaaaaattcaattcacaacaaccacatgaaggctcccaaccatctgtgcagatacagtgtactcacatatataaaataaataaataaatcttaaaaaaaaaaaaaaagaatcataccatgaaattgcttttttaaaagttgttcttcatcagggacttttccccttagaaaaagaaaaacaaattactgttttgtgttgacttttggtggcagagttgaatgaaacacacccaccttcagtacctatgtcagggtttttcagcctgtgggttgtgacccctttcacaggggtcacctaagactactggatgactcaggtatttatgttatcatttatgaaagtagtaaagttatagttatgaagtaacaacaaaaataattttatgattgaggggatgggtcaccacaacatgaggatctgtattatagggttgcagtattaggaaggttgagaatcactgacctatgtgaaaatcttccagaaaacttgaccagagatttatatgtagatttaactacaaaacaatacaaaatgcagggttgccgtggctcagtggaagagcacttgcctggcatgtaccaaagcccagagttcaatcctctacactgcaaacaaagaaaacactaaatagaaggaggaagaggaggaaagagaggagaagggagaggaagaagaggatgcatcggttggtgcctgcagccccacacacaggatagctcacaacttccacttaccaataccttaaccttccagagtctcagctgccactctcatttggagttggacttagggaaccagaggggtttgaggtttttgtttgtttgtttgtttgagacagggtttctctgtgtagccctggctgtcctggaacttgttctgtagaccaggctggcttcaaactcagagatctatttgccttggctttccaagtgctgggattgaaggtgtgagccataactgcacagcccagtgttctttcagggagacttgaggtttattttctcccactcctcctcctagctaggctaccttgacttgcggtgttcctgccttagcctctaggaggttggagttatgggtgagcaccacataggtttgggtgttttctaaagagaagaggagtgagaggacactggaaggcagaggagtccagcagttctttgtccctccccttcctcagtctgggtgcattatagctgtgggaactagatagaaacagggacttagctaaagactgaggacatgggctgtgaaagatcctcctcatcacagattgtccccaccataaaagtgacagtgggcctgaggtgggaagccagtccccctggcagggctagggagctgtctgccttttctcagtgccctctcttagctttttcttgagtgtgttcacctctagctttatctatctctgtgttatatatgtgtgcgtgcgtgcgtgcgtgtgtgtgtgtgtgtgagagagagttggcttcagatactgtcctcttctctctccaccttattttttgagacatagtctctcacaaacctagtgtttgctattttagctagactgcctggccagtgagctccagggtctgtctgcaccctgctcagtacctggttacaggtgctgccacaccccgatttctctgtgggtgataaggatctgaacttaggttcttatgcttggtcagcaagcacttcactgaatggccatctccttggctccccaacactctcccttttttgggaaacattgtctcactgtgtatccctgcctgacttgccttgtactcacagagacactcttgcctctgcttcctgagccagcactgagattaaaggtgtgcactgctcagctttccagctcatttgcctgagtgagttggtaccgggcttgtttggggtatgggccgtttcttgcctgccgctgccgtggctcttggcgtgctgtgctgaggacggtgctttagtaggaagaaaaggctaccccttctgtcagtgcattctgacgcggggtgacagcagccctcttcacatgcggctaggagaccctcagcgcctctgtgtctgcagctgctgcagattgattggccttgcccgtcgtgttttgttcgcacgctgacccctttgttctgcaggtgccttattctatattcatatcttcatattgcttttttcttcttttccatgtttcgaacaacagagtgttctctgcctatatcaaagaggtggatgagaagccagccagcacgccctggggcagcaagatgccttttggtcagctgatgtctgagtttggtggcagtggcaccggcggctgggtgcatggggtcagtttctctgccagtgggaaccgcctggcctgggtcagccacgacagcacagtgtctgttgctgatgcctcaaaaagtgtgcagtgagtatttccttgcaggtggaagatgtgatatgggtggaaggtttcactgaggctgccctgccctggtatcattcgaacaccccaacaactgcagctgcctttaaagtgacagacaggtactagatacctgttaacaactttaaagagttgggacttccttccagaaacacttcttggatgcagtactggtagtgtccctttgagtgccctcctggtgtgttgctaacaagggtcccttcagaactgccaggttattctgtgtctgtgagcctttccctggggagatgtgagcaagcacccgttcacctgacgcagtgtgcacatgacgaccaaaggataattccaccaaggtccgccttcccagccagtgagcccattgggttcacgcacagagcacaggtcagaggccgctcacaggagcgtgggtgaccccaaagcagacacaccaccacaataatctcacctggcatggacgatgacttgtctagggaggcatagacggcatccccttacttcagctaggcatctacactctatacatggtagcctctccatagagcaccagcgttagcgcagaactctatacagctgggatcccaggtgagggtccagtgaccctaccccacctatgaggcagtgccagtagacaacaggcccgctctgagagtctcgggaaagcagtcacagctgctcagatgaagatgatgtctgtcacgcttggaggatagcactgcatacgtctgtggctgtttccttatgccagtgttacccactaactttaagggatatatgatggaggcatggtggctcatacttctagcactcaggaggtagaggcaggaagattatgagttcaacgtcagcatgggctatgtacctgtcttagggttttactgctgtgaacagacaccatgaccaatgcaagtcttataaaaaaaacaacatttaattggggctgccttacaggttcagaggttcagtccattatcatcaaggtgggagcatggcagtatccaggcaggcatggcacaggcaaagctgagagttctatgtcttcatccaaaggctgctagtggaagactgacttccaggcaactagggtgaggatcttatgcccacacccacagtgacacacttactccaaccaggtcacacctattctaacaaggccatacctccaaatggtaccactccctggtccaagaatatacaaaccatcatagtaccaaaactctgtctcagaaaaccgggacttgagactcttgtaccttcctagcatgcacacaccttcagttccttttcctaacaccaccccaaaagaaggaaggaaggaagaaatgtttttactccatgctatcacagaacaaagaaagaaagaaagaaagaaagaaagaaagaaagaaagaaagaaagaaagagagagagagagagagagagagagagagaaagaaagagggaagccaagggaaggaaggaaaagaaagaggaaggaagaaagagaaagaagtgttcttactccgtgctatcacagaacaaagctgccttcatgctacttggagaacccgaattatgatgactcatttgtgagggtgtcgccagctcagcctggaagaactttatcagacatgggagtaaagtttgctcagtagcaaaggaagaaacctggagtccttctcttagggatctttgtactttgccgggagcccttcccaatgggcagctaagagaagcttgttgtaatgatctctagattaggcactctatggaaacagtcatagtgagaggcacaaaacaggacatgtcagaggtaatctctctctcttctctcccctcctccccctccccctcccccccctctatttattcatttgccaggcggtggtggcgcacgcctttaatcccagcacttgggaggcagaggcaggcggatttctgagtttaaggccagcctggtctacagagtgagttccaggacagccagggctacacagagaaaccctgtctcagaaaaaaaaaattattatttcatgtatgtgggtacattgtagctgtcttgagacacaccagaagagggcatcagatcccattacagatggttgtgagccaccatgtggttgctgggaattgaactcagggcttctggaagaacagccagagctcttaaccattgagccatctctccagctcaatattttctctcttaagttgaacttactataggaattcttttgtcaaaggccactcatgttaaaaataaggtctggaacttggatataagctgggctggtgtcaagcctatgaccctcctgcctcagcctcccagataaatgttttataagccaggcatggtggtgcaaacctgcacttccaatattcaggaagcctaggtaggggagggcatgagtttgaagctgcttgggttacatagtaggacccttaaaacaccaaacacatgaaactgaggggatggctcagtgggtaaaggtgtctgatccctggagtccacacacgctgtgatacacactctctctctctctctctctctctctctctctcacacacacacacacacacacacacattcacactcacacgcacagacatgcacggggcctatttgagtgtgagctggctgagactaaaattcatttcatagtggtggcttacacagggcatgactgccagcaagtatctctgtgtgccagcaccagtactctctcaccagcaggagtgacaggaagagctgtggcaggtgaaggaggaaaagccatgcaggccatggcagaggggcagagccagtgcactgggacgaaggcagaaaggaaggactcctttggtccatgaatggagacctttaccaaggggcagggcccaggctagagagagctagtcttttatttgactgagtaatagagggtgctaggggtccaaccagggccttgcacatattatgaccccaacttgaaggcttcagtttctgaaggtcactttggggtcgccttattcttgagattcctgtaaggagaggtcaaggaactctttttagagaagtgttggctaaccctgcagaagccactctgagaatggggcctttgttgtcctctgtctgtgaaggagcgtgggctgtggttcccctagtgtaacaagtgttcttgtgttcagggtttcaactctgagaacagagttcctgccgctgctcagtgtgtcatttgtctcagagaacagcgtggtggctgccgtaagtatctgccatcctcagtgtgccacgtgcaactctaagccagaaacaatgcgtgctctgtgacaggcacagcagcacatcccttctcagaaacagactgagaggccacggctgtgagcactgtgctggggtggaaggtgccagggagccctctgcctgactgatctcccgtttcagggccatgactgctgcccgatgctctttaactacgatgaccgtggctgtttgacctttgtgtccaaactggatgtcccaaaacagagcatccagcgcaacatgtctgctatggaacgtttccgtaacatggacaagagggccactactgaggaccgcaacacagccttggaaacactgcaccagaacagcatcacgtaggtaccttcagccgcctcagcctggaggccaggcactgggcttctgtagaaaattggctggccaaggtgctcactccatgtctttcttttagaaaagtcgcctgtgctgcaggccccagtgttgctgagggaatgagagcagtagtaagcctgtgtcttcccagctgctaaggccttactttcagtttgtgacagagagggagttggcccggtttggtggcacaggcctctaatcccaccgttcaggaggcagagataggtgtggatctctgtgaattgaaggccagtctgatctacgtagcctacatagtgaattctaggccagccaaggctgcacagtatagctagtctttgctactttgtgagttctttttcccatcctttatcccccatttcaccccctttcactagataggagagaaagaaggatggaggggagggagagagagtttagattcaaggatctctatctttcttcttgttccttctttgagcacaactattaagccacaatcaacaccctgaaagaccaccaaccccacccacccatcaaggctctagcatttatacactctgaaatgttcccagaattccaaatgtcatacagtcgcagaaactatctgcagttgacaaaaccatatctgctagagaacgaggcaaatcaccgtcagctgctgtgatcgggctgaagcagccctgtatctgtactgagattaaaaggaaaagacattgtgtgtttttaaagaaaccaaaattccagagttctcattacagcacggtgaaccctgcctcaaaacaagagctgagctgccgcctctttatccttatgccctgcaaggtgcgtttgcacccagaactcagaagtgtggttcttgtcagagaagtcctggctggctgagtctaccagtgtgtgtaggaggtagcttcatgctgggcatggtggcacaggcctggagtcccagtacctgggaggctgaggcaagagtgttggtaatgtgccagcaggtaggctcagtggacagaggctcttgctgccaaagctaaccaactgagcaagctctccagaacctccacggtgaaaggagaaaacagtcccagacgttgtcctctgccctctacacacacagcatagactagatgagaaagagtaacagtgggccgttcttagctcacgggctgtacagtagtctgtgtgctgtaatctgcagccaatcttgggagctgtccagatgattagctcatgcaggtggtttcgtctctctgcgcagctctggaggatctggaggagtgactgcctgcccttgacgttgtaatgagtcatctcatttattttgtctttggtgtttggacttgggattgaacccagaacctaggacttgctaggcaagtactctaccactgagccacagcagcagccccgtgaagacaaatttcaagtgcaaggcgctgggcctcctgttgtggctgtcctagcaggctgatttgagagggtgtgttggggaccaggtagcctccgtcatgctctaaccatgtctatttgaaactccaaaacgatgcttatatctgcatcggtactgagcccctgagcccttctcctcctactacccattacgtgttgaggccagcgtccctccctctccacccctcccccatttttgtcataggatttcatacagtttagattggcctcagactcactagatggctggggtagggttgggatcggagaatgatggggataggattgctgttattggggatgaccgtgaatttctgatcggctgcctccacttttgaattggtagggtactggcatgtacaaacacacccaaatatgtggtactggggatccggtctcatgtgtgctaggtagccacatacgggtacgctacatcccaagctattgagcccactcctgttttgagacaaggtctagctatgtaaccctgatagatctggaacttaatatatcaccagctatctgtgggatattttctgactcttgattgttacagcctaagactgatggatgtgttgatattcaagagtgaagagagttcatttatctagtgcaccttactgttggtggggagagttgggctcacttctaccgcagacctcacaatcttttgattttgcttttcttttagtcaagtgtctatttatgaagtggacaagcaagattgtcgcaaattttgcactactggcattgatggagccatgacaatttgggatttcaaggtaaatcttcttggtggttttgctgtgttggggacagaacatgttaggcaaggactcttacactagctaccctagcccttgatttccagatatttccaccaaacatcttttccttcttgaaatacagtgtcagttgcagtgtatggcagaggagctggcccagaatctaagcatgcggggccacattctcagtggtggtggtggggggggggggttgatgtctcctagatgctatttgttctcaaaaagaaccttgatgccattgttgaagtaaacccagtgttagccaccagccaacatttctgtttatagacatttttatagcttacatcaatttatttaataaatacaactggggctcatttctgtaatacctacacttgggaagctgaggcagaggattgctttgagcttaatgccagtctatgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacaaaccatatacacacacatacatatatacacaatgcatgcacacacgcgtaggtgtctggagtgatggctcagcaatttagaccatttgcttaagattcaggatttggttcccaacatctacatagctgctcacaaccaaatgtaactccagttccagggcatctgtcctccacagacaccaggcacacaagggtgcatctatatacatgcagacaaacattatacactttaaaataaataaatcttaaaagtccaagcatagtgatgcatgtctttaatcccaggagttagaggatagcagatctctgaattcctggtctgtgtagagttcaatgctggcctggactgtgcagtgaaaccctgtctaaagaaggggggaaggaggcagggagggagaagcagggtgttggtgatgcagggcttaatcccagtacacttggggaaaaaaaaaaagaaaacgaaggaagggagaatatacagggttgggtgaggtggtgtgagccttctggggacagacatccggaggcctgcagggtgcggggtgaggaaggtgggcctgtgccccaccagtgtggcctgcagggaagacaggcagtcagtcctcgggctgatcagtgttgtgcttttcccaagaccctagagtcttccatccagggtctccggataatgtgaagccgagcgagcctctggcatccagcatgaggaacaggactgagcgcctctgctgttcacgtgctggtgaggatcgctggcccagggaaacactgtcacactgaagcaactagcgtgtgttcctgtggatgtcgtgggtgacgtgtggcatttagagacggcagtggttcgttttgatttttctttcattttgttttgttttgattttgctatctcattccatttttgaccaaagcttctctttaagtagtttattatggaagattgtcacactaacttaaaggggaagggaagtatgtacattgtgtgctaaaaaaaattaaagaaaaatcccaagtgtgcaaaagtgttttttctttatactctttctgttctcagcagagaaacaaatacatctttatttgtttaggttgtttttaggatcaggccctagatcttagtccttaactgcgccatcctctgcagcctttagccagagaggaccatggattgagccgggcatgtagaaagcactacaattcagcaccctaaaggctgagacaggaggattgcaagttcaaggcacaaaaacattaatgtgcctcatggggaacaggggcatctgttgatgggtcctgggacactgcattccatcggtaaagttggtgcagaagccctgtactggagagctgaggagccatggagaatccctcctgtactggtgagcaaagccagttagcgcatgctctgggaggccatggtctagccagtctctttcctgagccccatccataagcagagaaaagggggctgctgctagcttggcttagagattcctgtgcctggcctgagatattcccaccctaactcagtatcacatatgggcaggactaaggaccattctaggtgtagatctaaatgggtggaggattcacttagggggctgaggcaggaggattgctgtaactttgaggctactctggtctacatagtaggttctaggccagccaaaactatcaagatcctgtctaccaacaccagcatcaaaaatgagtctagaatagtgtgaggccatctccattccactgcacaggacaagccagataggcagtctttgtttatctttctgaagcagtgtcttacgtgtcccaggctggcctggaacttgctatataagtaaggatgaccttgaacgactgatcttctggcttgcaccttgtgtgttaggattacatgcatggcttacatgatgctgaggatagaatccaggcccctgtgcataccaggctggcactcttccaactgggccctggccccaggtcctggacagtagtttgcattccactaggggctggttagcaagggtctcagaggatgtcatgatctttacaaagacagtggcccttctgatgactcatggcaaacctaactgtctccacgagagagttgtagcagcggcacctgagtgctggcctgctggccctgccttctcagctcccatgctacagcctcctttctgtgcccctgaagacgggagcttctctgtaaacacagacttgtggacgtgaatatgccagaacaggggctgactgcacacaagacctctgtagagctgccttcagccccactacacttgcgggctgacaaactcacgtccccacagaagggagtgactagccagagccccagcagtaaccactgggctaggcatgctccctactgggcaaggatagagatcttcttgcctcggcctcctgagtgctgggattacctaccaggatctggaaccttgtaaggaacacaccaaagggtatccactctaggcttgaatttcacagttgtccgtggaatatcctgactgggaagatgggctgtgcagctgagggcccttgagaactgtgccgggatgccatgagctgctggtggacatccctgctctggacctttgcccactttacacagaggtgtggtcttgggtggctggaagtttctcttctgtctggctaacagttttcaggctgtgtgtcttggtgtcagggtccttgtttatgcccttgcaacaaagaggacattatatctggagctgctgaggaaggtctcccactatcttgaccggtccagtcagctgtgcctgggaggcagcaaggctgatgcagggggtgggggagggagagctgagaatcagcagcacatgctaatggaagatgctgtgctggccccacccgactccctcctcctaagtgacctgcatgaggctacatttctgggaaaccagagatgcagcagagataggagagtggctcatcttcgtttacaaggcactatgtgcgcacattcccggaagagacagacagctctccaaggtggcgtcccccaagccctcttctccaaagatttgcttcacttgaggtcataaagctccctctcgatggtgcaccctgtactgacaagcaagcggggagcccaaggcaggaggagtttgaattctgggccagcctgggctatagacccagaggtggaaggtggagtgatgggggtgtgggggagagctttgcagtctgaggtttcctttctgtgttagtttttattgtatatttatttatattgtatcagggatgtgcacagcacagtgcacatgtggaggtcatatgacaactggcagaagtcattgaaccttctgaaccttctgtttttaatggccatggcaactgacacaaacaaggggcttggagagatggctcagcagttaagagcactggctgctcttccagaggacctgggttcaattcccagcacccacacggccgctcacaactgtctgtaactccaagatctggcaccctcacacagacatacatgcaggcaaaacaccaatgcacataaaatcaaaataagctttaaaaaagggaagaaagggctggagaaatggcagagtgcttgttttgcaaggagccaagttccagccctgaacccactttaaagaaaaaaaaaaaaaagccagatgttgtggcacatacctttaatcctacgaggcagaggcagaggcagagaggcagaggcaggctaagaaagtctacacgatgagttccaggacaacccgggctagagagggaccctatctggggaggagggggtgctcattggttaagatcatttgctgctcttgcagaggacctgaatttaattcccaacacccatacagtggctctcaacaacagcgacttgagttgcagggtacctgatgcctgcttccaacccctgagggtactgcatacacttggagcacagacatgcaagcaacacatccacgcacataaaataaaagtagattttctttaaagaaaaagaaaagctatctggccatggtggcacacacttttaatcctagtactcaggaggcaggggcaggctggtcattgtgaattcaggccagctagggctacactgagagaacctgcctcaaaaatgaacaaaaagtggcatagtgacatgtacctatgatcctagcactgagggtgaaatcaggaggatccctggggtgcaaagttctgtcaacctaacacactctgtgagaaaaactcaaaacacaagctgcctgaggaagactgacctttggcaaacacacacacacacacacacacgcatagaagcacacttgcatgatctgtgtttcctcatggcttcaaagttttcagtctatagtcacttggctccacagcttgtggcagcacagaagggtgaggtggaggccagctactcacctcagagcagcacctcacaccagacagagtgagcaagtcaacactacctacagtgactttcttctcaagaggtgcaagctcctaccatcgcattcagagaagaactgaatagactcaccctctgtgaggggctagggtctgtgtggctcagtgcatgtgtaaggtcttgggttatacccaccatcataaagcaaaacaaaacaaaacacctggtccatgaatcttaaccctcttgaaagacgcttgagcttaagctgaccagagctgaccagtgagtgctctggttttctctgcaggattgtcttgtcctatgctctgctctgaggactcccctccgcttgagggttactgccctccaggcatacagctcacccagaggggcttctctgtagtgggccacttcctagagtcctgggcttggttttgctttgtccatcctctgaagacactgggtcactttaggttactaccccgggacagagaactgtaggacaccacaggcgtatggagtcagatcactcaaggcctcctggggccattgctgggcttttatggagctgagcgagcacggacagattgccagccagggatgcccttgacccacagggctacagatacaaacctacaggaacagcaaagcagggggcgcaggatcatggctcctctgtgtctgtggcaggaggatgactcgtggaaacctgagctaaatcttactgagctgggtgggtctggtggcacggggaactgaggcaggagaatcacaagctcaaggcctacgtaacttcaagtccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtcacttccccctcggtccgcagccttccgggttgttgcgaccgggaaatgagctagcacccctgccccgcctcatcccccagtgaccatacccggcaggggtccaggttcctggttccacccagcttgggcgagcggaccctggcggctcgaggggcacccagccaggccaccccggacagggcaggtcccggtggggcccgcaaataggctggaatcctgaactgggagccagcccaggtgctggccatgaagcttgttcccgcgaggcagctccagcctggggcggtgtggctgctgacgcagtcgagccacctcgcctctctagagctcaacttgccttgcctggaaaatggggaccttccagatttggaggcttagctgccaaatgtggctagtacacttggcagagtgcctgcttgtctgctgctgcagaccttatttctgcactcctttgaacctggccttatgaggtgggagggtggggtggggtccgaagctgcagccctgcggggcgacttggagggaacaacttcttcacgtggacaataaaaaaggaatagatttaccacgtgggcttctactgtaagagaatgtgcggggctgggagatggagcattgaataaaagcactgacaggggtggagttggggagggggaatcctgagggtctgagttcgaataccccgacacccatgggcactcaaagacacacaatgaagcgtgcaaggcaaaggtctgtgtgaatgaaaatttatttatttattttggtttttcgagacagggtttctctgtatagctctggctgtcctggaactcactctgtagaccaggctggcctcgaactcagaaatcctcctgcctctgcctcccgagtgctgggattaaaggtgtacgctggtgattctttttcactctgggttgttttgttcttttaggcagggtctcctcctttcccctggactcgggttctctctctctctctctctctctctctctctctctctctctctctctctctctctttccccctcccttccctcctccttccctccccccaggctagccttgaactcatagagctctgtctcctcagtgctgagattaaaggtgagcacacttcgggatctttcaaataacaaataaccccaactagaattaaagtattttgttctgtcttggtcccagggccttggaacttactaggcaagtgctctaccagtgatccagcctcctcagtggtatgtgggtttttccaatctgtcacccactgatataaaaagggttttctgtagtaaggcaaccctaagaaagagggctttaaaagtttgctttttcaagttactaaggtcatcagtgttgttctctttttaaagatgtatttttatgggttgggtgcgcgcgcgcccacacacttgagccctggggtggtggaaaatgctgtcccctggagctagagtatttatttggtggttgagggctactggagttctctgcaaagagccttctctccagccccacattctgtctgctctcatacaagctgttggaattagaagttagcacgcggcccttcaaaggcatggaacagatgagggtctccccacagccctgctagcaccgagtcttctgtgttttggagaagtttttgttttggttctttaaactggtgttttacgatattttagaatttatttaatctgttgctggatttgactttccctcattcagtaagtcttcaaggacagtttagaggagggggaagaagaggaactgagggtttggagggttgctcacaccacccaggctcctacccacaacaggaagttgagtaaggcttagcaccataaaaaagaaaaaaaaaaactgctgctggctgtacttagctgagctcccaagctaggcggggacttcctggattgcctgtggagccaaggttctcgctgcaggcaactcccggcttggcttaagtctcaaatccagccagactgagtgtgtgattcaaggaaacacagccaagaaaagccaaggggccagggcgaaggatatttatttatgtgtgtgtgtgtggggggggggtagggtagaggacaagttagaagccttaattggttccttcgctcctgggtcctggggatcaaactcaggtcatcaggcttggctgcaagcgcttttacccggtgagccatctcaccagccccttacctgtctatctgcctgcctacctacctatctaatctgtctgtctgtctgtctgtccgtccgtccgtccatccatccatccatccgtccatccatttctatcaatcacaggttctccctatgaagcccaagctggcttcaaactcctgatcccacagccttagcccgctctgtctccgatgttcagcagcgcaccctgctggagagttttaacccagcactcttggaaggaactctgggacccaggcactggaagaatgtccttggcagcaaaggggcctgaggctctggctggcaggcttaggaagggagctgcgtaggtcctccccagccgagggtgtcctgaggtagaagcgtctggcttttctgaccacttgttccattaggaacacagagggcctctcccagttgttgatacatcactgtgatgcaaccaggcattttcctcgacacaacattccttgatacagatagcaggagtgtggaagtcatttagcaatggtcaggaagtatccccaagggctgggggtgtggctcagtggtagagcctctgcctagaatcccccagtgaggggctgggggtgtggctcagtggtagagcccctgcctagaatcccccagtgaggggctggggtgtagctcagtggtagagcccctccttagaatgtacaaggtttggggtaccatccccaacagtgtaaaagaaaacaaacaaaccaaaaacccctccgtttctcttgtatatgaagctggcctcaaattcatgaccctcctgccttagtctgtagagtgcaaggggttactgaccggcctgtgctaccaggcacagtttaagaattcacgtctatggggctgtcagatggctcagcggctgagagcttcttccaaaagacctgagttcaagtcccagcaaccacctggtggctcacaaccatctgtaatgggatctcatgctcttttctggcacatgggtgtatgtgcagatagagtactcatacataaaataaataaaccttaaaaaaaattcctgtctaaaaaaacttagcatcatgccaaaaatcctagtcttttatgttttggagcattctcaggataaaaactccaagtcgctttggagacccaaagcaccattcagtgccccttctaggaatttcagagaagcagtccattcctcagcatgacagctccgttccacactccttcccttgcccctcccagccctgggtcgactggcagggagtgaccccgtgtgggccatgctcctgggagaacagagacccagcgctgtgctggcaggagatggtttggagccagacaggaagtttgattcaggctcccccaggatctctgtgtcccaggcaataatagaacaggagcaggttttgcagtccccctgggccacctctttgacagatgaatgagagagaggtcttagggtgtggctcagcaatagtgtacaggtcctgggtcagatcccagcagtaccaaaataagtaagtaaaaattctcctcggcttcctgcgtgccagggttacaggtttgtatcgacacccacacacctctccctgtctctctccctctgccttctgcctccccctccccctgagagagacagacaggatctcactgtgtagccctggctgtccaggaactctgtgtagcccaggctggccttgtactctctgagatccacctacctctgctgtgagttctgagttttaaaggtgtgcccactctgcaccgctgcagtgtacacgaaggtggatgacaggcagtgggtgtcatccctgctcctcccctttgggtggtcgggagcactgctagttgggttgcgtttcagacatgatgagaagatgattcccctacccatctgcctcccttgtgctgtcaaccctcctgctaaagtgtgat

SEQ ID NO: 698 - DNA, 1593 bp, Mus musculus
tctaggcctccctcctccgtccgcgcccgccggagccagttcgcgtcgactgaccagagtccgcgaatcgtccgctccggacctccagacctccccaacctcagctttctgacctgtgaaaacacttaagaatcatgtctctgcatcagtttctgctggagccaatcacctgccatgcctggaacagggatcgtacccagatcgccctgagccccaataaccatgaggtgcacatctataagaagaatgggagtcagtggacgaaagcgcacgagctgaaggaacataatgggcatatcacaggtattgactgggctcctaagagcgaccgtattgtcacttgtggggcagaccgcaacgcctatgtctggagtcagaaagatggcatctggaagcccaccctggtgatcctgaggattaaccgtgcagccacttttgtgaagtggtccccacttgagaacaagtttgctgtggggagcggagcccggctcatctctgtctgttactttgagtctgagaatgactggtgggtgagcaagcacattaagaagccgatccgctccacagtcctcagcttggactggcatcccaacaatgttttgctggctgcaggctcctgtgacttcaaatgcagagtgttctctgcctatatcaaagaggtggatgagaagccagccagcacgccctggggcagcaagatgccttttggtcagctgatgtctgagtttggtggcagtggcaccggcggctgggtgcatggggtcagtttctctgccagtgggaaccgcctggcctgggtcagccacgacagcacagtgtctgttgctgatgcctcaaaaagtgtgcaggtttcaactctgagaacagagttcctgccgctgctcagtgtgtcatttgtctcagagaacagcgtggtggctgccggccatgactgctgcccgatgctctttaactacgatgaccgtggctgtttgacctttgtgtccaaactggatgtcccaaaacagagcatccagcgcaacatgtctgctatggaacgtttccgtaacatggacaagagggccactactgaggaccgcaacacagccttggaaacactgcaccagaacagcatcactcaagtgtctatttatgaagtggacaagcaagattgtcgcaaattttgcactactggcattgatggagccatgacaatttgggatttcaagaccctagagtcttccatccagggtctccggataatgtgaagccgagcgagcctctggcatccagcatgaggaacaggactgagcgcctctgctgttcacgtgctggtgaggatcgctggcccagggaaacactgtcacactgaagcaactagcgtgtgttcctgtggatgtcgtgggtgacgtgtggcatttagagacggcagtggttcgttttgatttttctttcattttgttttgttttgattttgctatctcattccatttttgaccaaagcttctctttaagtagtttattatggaagattgtcacactaacttaaaggggaagggaagtatgtacattgtgtgctaaaaaaaattaaagaaaaatcccaagtgtgcaaaa

SEQ ID NO: 699 - protein, 375 aa, Mus musculus
KHLRIMSLHQFLLEPITCHAWNRDRTQIALSPNNHEVHIYKKNGSQWTKAHELKEHNGHITGIDWAPKSDRIVTCGADRNAYVWSQKDGIWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGNRLAWVSHDSTVSVADASKSVQVSTLRTEFLPLLSVSFVSENSVVAAGHDCCPMLFNYDDRGCLTFVSKLDVPKQSIQRNMSAMERFRNMDKRATTEDRNTALETLHQNSITQVSIYEVDKQDCRKFCTTGIDGAMTIWDFKTLESSIQGLRIM

SEQ ID NO: 700 - DNA, 60057 bp, Homo sapiens
agttgtatctcacctactgcagcacactggaagatacatgatgtcaacctaaactctgttcgtgatgtcaactttgatcacttgattaaggtgtccacctccatcaaggaacattctagaaaataactggtgtgggctgtttaagactcccaactccaacattctagaaaacaactggtgtgggctgtttaagtctcccaactccaactccccaggtgccgtggctcatgcctgtaatcccagcactttggaaagctgaggcgggcagatcacgaggtcaggagttcaagaccagcctgaccaacatggtgaaacccctgtctctattaaaaatacaaaaattagccaggtgtggtggcacacgcctataatcctagctactcagaaggcttgaatcgcttgaacccaggaggcggaggttgtagtgagccgagattgcaccactgcactccagcctgggtgacggagcaagactttgtttcaaaaaaaaaaaaagactcccaatttcacaaaagccaaaaacaaaaaaaaaggctgaggaccttgtctctagtcccagctacttgggatacttgggaggctgaggcagggtcacttgggcccaggagttcaaggctgtggtagctatgactgcacctgtgaatagccactgcactctaccctgagcaacacagcaagaccccatctcaaaaaaaaaaaaaaagactgaggtgaagaactgttccagattagactaaagaaagataagaactaagtgcaacaactgatctcagattggctccaggattgcggggaaaaaaaaaaaaaagctagaaaggacattattgaccaggcacagtggcttacacctgtgatcccagcactttgggtgcctgatgcaggcagatcacttgagtccaggagtttgagaccagcctgggcaacatggtgaagttccatctctactaaaaatacaaaaattaaccaggcatagtggcctgcaactgtaatcccagttactcaggtggttgaggcacgagaatcgcttgaaccctggaggcagaggttgcagtgagctgagattgcaccactgcactccagcctgggcaacagagcaagactgtccgaaaaatgaaaaaaaaaattttttttaaagtaaaaaaaggcattattggcacaagtgaaatttgaatataaacttataactaacatattaatttgttatattaagatttgtaactaacatatttattattatagtaaataacattgaattaatgttaaatgtcctaaatttaattgtattacagttgtaaaagagaacttccgtgttctccagagatacatactgaagtatgaggagtgaagagtctcatgtctgtgacttacaaaatgactcaacaaataattatatcactattactattacacagatacacatattttatatatatatatatatgagagagagagaaagcaaatgtgacaaaatgttcacaagtggtaaatttaaggaaacaggtatattgatattcattattctcacatattttgcaacttttctgtaggtttgaaagtttttaaggaaaaaaagaaatacataggaggtggaggtgctatgacttggtaactaacttcctgggggccattaatcaatctgtggtggatgatgataccttggtctgagaggtagaggagagcagaatctgaggtggggagcagaggcaaacatcaggtttgacatcaattgaactgaggtgggaggtgatgagacaccaggtggagactgtcatgagggagcagtatgaattaacaggggtcaggaacaaactgagatgcagatctgcaggttggcagtctatgggtggtggctgaagccaagagcttgtgagatcacctagagggcaggtgtggatgggcccatattcttgggctcacttgcacttaagatctgggtgcagaagtaagaatcaagcaagaatggttacgctcatgagcaaaccagctatttcattcagggttcctataaaaataaccattagacttgcgattttctaccactttaaatctcctcctagagacactcttgtattggttaacttctctccaggtgggggattacgaggcttttgtcaacatcttccttgggagcgtgatatggtaagaagcctacaaatacatttgtgatataagcatgcaaaacagaggtacactatatgctacaattagaactacgatcctcccaggttaattcattcctgaaaacaattctcagatcaaataagcccatatgaagttattttaaatgagaaaataggaatgtattcctagcctgtgcagaaactccagtttctccaaatatcactaaaaccctctcaaacatctataaaacaatcctccaaacatttctgcataatataaacatttaaacatgaattatctaattatttaacacttaatgaactccatggtgattacgtttgcaatagtacacaatgatatgcactctattgaatgagaattagatatcctccccaacctgcaactaacatgtacagtaaagcaaacaacaacataatagtgagttaaagatagataattaaatgcaacaagatttagcaaactgaaatggacaaatgggattttttttttaatggctacttgccgaatgattctgataatggagcactggggcaacagacaaccctcccattagtgataattagaaaagtgggcaaaatatacaaaatatctactcaaagataagagagcactaatgaggtagtaaatacctaccaggtcaatgtccaagagaacagagtatgtaagagagtgagcccatcagcaggactgttttaccccaagggctacttggtgattccagaacaggtggctgagagcctaagcagtacttgttttgtttttttttgtttttttttgagaaggagtctcactctgtcgcccaggctggagtgcaatggtgccatctcagctcactgcaacctccacttcccaggttcaagagattctcctgcctcagcctctggagtagctggaattacaggtgtgcgccaccacgcccagctaatttttgtattttcagtagatacagggtttcaccatgttggccaggctggtcttgaactcctgatctcaggtgatccgcccacctcgacctcccaaagtgctgggatgacaggtgtgagccaccacatccagccctaagcagtacttttgacagcctttcaggagtctggggccctccaaggttggggagtcttaggaaatacctgttatactagtcaggattcttcagagaaacagaacaaataggagatattagatagagatataaagagatggaaaattgactcacacaattatgaaggctggcaagtccaaaatctgcagagccagtgtcccagttcaaatctgaaggctggaagcttctgcagaaccagaaaaggccaatgttctagttcaaaggactcacttgaacccagggtttgaggctatagtagctatgatcacacctgtgaatagccactgcactccaccctgggcaacacagcaagaccccatctctaaaaaaaaaaaaaagaaacactgaggtgaagatctgttccagatcagactaaagaaacaaaaattaagtgcaacaattgatcttggattggctccaggattgagaaaaaaaaaagccatcaggaaggagaatattctcttactcaggagagggtcagccttttgttctattcaagtcttcaactgattggatgaggcccacccacattagggaggccaatctgctttattcaatctactgatctaaaagtcaacctcacccaaaagtatcctcacagaaacacccagaatcctgtttgaccaaatatctgggcaccctgtggcctagtcaagttgacacataaaatgatccaagtgtgacataataagaaatataggccgggcacagtggctcacacctgtaatcccagcactttgggaggccaaggtggatcacttgaggtcaggcgttcgagaccatcctggccgacatggagaaatcccatctctactaaaaatacaaaaaattagctgggcatgatgacacatgcctatagtcccacctactcgggaggctaaggcaagagaatcgcttgaacctgggaggcggacgttgcaatgagccgagatcacgccactgcactccagcctgggcgacagagcgagactccatctcaaaaaacaaaaaaagaaatatctattttgtttctgacacagagcttttaaaattgttatactaccctgtataacaggggtgagaggaacatcttttttttttttttgagacagtctcattgtatcccccaggctggagtgcagtggggtgatctcggctcactgcaacctctgcatctccagttcaagcgattctcctgcctcagcttcccgagtagctgggattacaggtgcctgccaccacgccaggctaatctttgtatttttagcagagacagggttttgccgggtgagccaggctagtctcgaatgcctgacctcaggtgatccacccacctcagcctcccaaagtgcctggattacaggctgtgaaccaccgtgcccagcctaacctcttttgttataatatttggtcttagctcccagttcctcacgtaggagcttttaagccccttggaatctctggagtggtaagtgtctttttgtatgctaatgagatgtctggtggatgagggtgctagatggttccagaaagaaactaattgccagaggaaccaactctgtgattagagggtaggaattttcagtcccacccctccacctccagggatgagaggagctggagatttatttcaattaccaatggccagtgatttaatcaatcatgcctacattatagaacatccataaaaaccttaaatgatgaggtttggagagcatctgggttagagaacacgtggtggtgctgggagggtggtgtgcccagaggatatggaagctctgtgtcccttcccacacaccttgtacttgtccatcagtaactgaaacatcttttgttataatatttggtcttagctcccagttcctcacacaggagcttttaagacctttgcaatctctggagtgataagtgtgtctctctatgctaatgaaatgactggtggatgagggtgctagatggctccagaatgattttattaaaataatctaagcttgcataacatggaaaaatgtgtcggtaacaaaatgtctaagtggctctggccttgaggagatttacaggttcatgggttacagatttcacttattaaattaggtaagtaacacagggaattcccaagtctgcttgtatgattgtcttacaagtatggtatttgcgataatatgctatttatacacaccacctgagactaccctgtgcccctagacatcccgtgactggtcccatctctgtcctatggaaatgaactgagtgagcagtggaaaaatccacatgcacttttcagttcacctgtattgaactctacaaaatcctttccataggaagttttcctcactgggaacatacccagcaattaggacaatatctaaagcataaggattattgttaactaataacacacaatatgcattaatagttttgtccttttgtttgtttatagcttttattggcattgattcagtatttccaacagtttttttggtgactagatggcaggcattattggaagatctgcagtaattgttcaccatttcagctgttggcacaacaagcaagaaacaatcttcttactctccaactccacattccagttattaaatcaagctctcctgagaaggaaatccttacgcctttacaaacatgtaaccttcctaaactatgatggattatgttcctgatgtgtctatataagccccaccttccattctcaactagcagtaacctctgtgtcctttgacatccaaattgttttctttcattcatttgcactttcattcaacgaatgttaaccaggaccttccagattcaaggtattgtgcatttccttttatttaaaattattttagcagcatccctggtctaaaaataagataaaatattttgtggactggtcatatcctaatctctaagttacttgagaacagaaggatcttactctactcttattaacacaatagttggcacttggtgagtatttattaaatatttgatgccttgaatcttgaccaaattctaattcaactcaattccaattccaatccaatcagcaaagcaaacaaaatcagcccacggtagtgtccaacccctccctctcttccattgcccacttctaagtaccaccttccctggcactaattgttaagtctaattagggaaaaggagtcaggatggtgggagcagggggaagcaaaaagaagcaggtaaactacaagtctgccattctttatggtccagacacacagccctcctctgcaaataactcacaatcttcctgcgcccaacaattacagcataaacactattccataaaatccccagcaagcctttctttgcagttggctgctcttctgctgattctgcctgttgccttctcgtaccttcctactttctctaacaaatctgcctttatctacaactgtcttggtaaatccttttacccacgtaccaccagcccagacagctgcccctcacccatgatactaatcttttaaaaggttgagtctgcattttggatactacatcacacatgccttaaaaacaaacattaaaagtaactcaccctccttagaaccctgatggttggcttttatagcagggcacgatggtataaccagtaaggccagagcaggtggccagccccccaaccctccctgccttgtatcaaaaccctcaggtttcaggccaggcttggtggctcatgcctgtaatcccagcactttaggaggccaaggtgtgtggatcacttgaggccaagagttcaaaaccagcctggccaacatggcaaaatcccatctttactaaaaatacaataattagctaggtgtggtggcacgcgcctgtaatcccagctactcaggaggctgaggcatgagaaacggttgaaccagggaggtggaggttgcagtgagctgagatcacgccactgcactccagcctcggtgacagagccagacactgtcgcataacaaaacaaaacaaaaaaattcctcaagtgtcaaaatttttctttttcttcaattacagaagagccccgcttagagctaagattctaccatctggaatgactcataaaatatgaagtgggccgggtgtggtggctcacgcctgtaatcccagcactttgggaggccgaggcgggaggatcatgaggtcaggagttcgagacgagcctgaccaacatggtgaaaccttgtctctactaaaaatacaaaaatcagctgtgcatggtggcgtgtgcctgtaatcccagctactcaggagcctgaggcaggagaatcgcttgaacctgggaggcagaggttgcagtgagccaagatcgcactattgcactccagcctgggtgacagagtgagactccatctcaaaaaaaaaaaaaaaaagtgaaatgcatcaaatggtaagctttggttaggctaaattgcaaaatactatttcaaatcagaaccagagattaataatagtaaatatctgttatttttttctggggctaacatttcttgtcacttatcataaagtctggtattaatttgcatgtgttactctcatctacccagattataaattccatcaaagcagtaagtgttccttgtaaagaggtgggatcttcataaactcctctacatacttgggaattggttcaagtaacttgcagacacacaaggaatccctgctttccacacctgctgtcctccctttcccaagctgtctcttggagggggtaatgaatttacaatgatctttctacactatctgctcgattaccctatgaccaaagactttgtaaccacaggtcagagttaaaatcagaatttcagtgaagcgatgttccatgaacagctggattcactaactcagtggtccccaatctttttggcagcagtgaccggtttcatggaagacaatttttccacggaaaagggggcaggggctaggggagaggggtggggtggttttagatcatcaggcattagattctcataatgagcatgcaacctagatccctcgcatatgcagttcacaatagggttcactttcctatgagactctaatgcccccactgattggacaggaggcagagctcaggccgtaatgccagagatggggagcggctgtaaatacagatgacacttcgttggctcgccctgctcacctcatgtgccaatgggttcctaacaggcaacagaccaacacccgtcagcagccaaggagttggggaactctgcactaactccaaagaacatagcgggtctggcagggcatggtggctcacgcctgtaaccctagcactttgggaggctgaggcaggcgggatcacctgaagtcaggagttcgacaccagcgtcgccaacattgcaaaaccccgtctatactaaaaatacaaaaattagccgggcatggtggcgcgcagctgtagtcccagctactcgggaggctgaggcaggagaatcgcttgaacccgggaggcggaggttacagtgagccgagatcgcgccactgcactccagcttgggcgacagagaaaggctccgtctcaaaaagatcacagcgggtctgaaattgagagtttgacaagtatacctacataaacctcaccttacaataccaaagggaaggagacaagcccttggttggcctggcatggcgctgggcggcggcgggggggagctcacatcgctttgggaagcagaggctagaggattgcttgagcccaggggttcaagaccagcctggacaacataggaaaacctcatctttacaaaaaatataaaaattagccaggcacagtggctcacacctgtaatctgagggctttgagaggccaaagagggacgatcgcttgagcccaggagttcaagaccagcctaagcaacacagcaagaccctgtctctaccaaaaaataaaaattagccaggcgtggtggtgtgcacttgtagtcccagctccacggggggctgaggcgggaggatcgcttgagcccaggggttccaggctgcagttagctatgatcgcgccactgcactccagcctgggctacaggttgagaacctgtctaaaaaaaaagaaaaaagaaaagctctcgattagccccatctgtgggggctggggatgctccagaatttctagggttcaagggcagcagcctgattgcaggtggggatcagggcatttcttggaggctgcatctgcggggcaggctctgtcctctgtgaattgggggccttgccaagttcccccaacccttttatccctgctgcgccatcttgggagcagggaactgcttgggagcaggggattctgtcccaggaagggtcgagaaagttcctggggggcttcaggggctttccacagagggagcacggcgggggcggaggctccctgcagggagcagcgctgaggtagactggctctgaccttggctctctgaagggagaaaaacttaatcgttcttcaggtccaagagctccaaagacccccaatcctcagtaactcatctcctgacaaaagaccttgcgaaactgccaaagcgccacacttcggctcgcgattgtgaggaaattggttgaggaacggagtgggacgcccatgccgcttcgccagcacttgccaggcgttccgtggggcagcatctcctctgaagggccgccgacagtaccacgccaatggaacggcgtaccctcctccactgcagcctgcctaaccccggactgcgcgcccgagctgtgcgcatgcgcggaccgtccgcgcggtcgcaacgcgcaggcgccgtgtccacttccgggatctgtcagccgctccctctgggcttccgtcctccgcccgcgcccgacggagcctgttcgcgtcgactgcccagagtccgcgaatcctccgctccgagcccgtccggactcccccgatcccaggtaacggccagcaggggcgagcgtctcaccctgtcggcctctcttgtccaggcctggcgccggacttgccgcgggggcagtgagacgggggctcaggccgcggggccccgaggctgaggcgcggccgggtctccctgccggggcctcctgagggggcggggatcccctttctccgtggatcccctgcagcttttctcaggatgttcgagctcctagccgcctccgatgcccgaattaacggccccttctgcgcccccagggtcctacttgcacctctgctgggggcatttgtcaccgtctctaaaattgtgtcaagtaggaggatctcccgtaatcgagcgacccgcgggactattcatctctttagtgtctagagtcgatccctgcatacagtaggcgcccataggatgtttgcctgctctctagggcagccctcaatccttcggttaatggggaaccttctcgatctcgagaaaaaccttctcccgagttcttttaagatttccctgcatgagtaccgccttcccccaagtcaaaattgcacccttctcggcgctcttattcatttagtggaatcttttatgccagtcctggcaccaccactttgttgagtgatcctgggaagatgcttctctgcgcctgtttcctcatctgcaataaaaagattcttaccgttttgctaagaatcaagtgagcttatttgcataaattgcttagaatagttcctggccgagagtaggtgatcaataaatattagctattattactgcttctgggcattctatgcatatccgtcttcctttccttttctatctcctccactctccccaaacaccaaccctccagacttgaagaccagaatggtgtcagccttatttatgtttctagccccatcccggtatttacaacactgctgggaacatgataggcacttaatcagttatagcttagaatctttgattataaagccatctgttctcctgcagctttggaaccttctgtctatgtcaactcgtagcttaaattgccgagattatcttagttctgccctctctcctcaattttatctagtcttgtggtttcacatagggcctgggttttcaggtatctaaaaacagaggaggggcatcagtcaggaaggtgtttttgtcctgttagggagtgggtaactgtggttgttgtcttccttttttttttttttcctgcagcctcgacctcctgggcttaacagatcctcccacctcagcctcctgagtagctgggactacaggcgtgtgccaccacactgggctaattttcatttatttttatttacttatttttggagatagagtctcactctgtcacccagactggagtgcagtggtgtgatcttggctcactgcaacctccacctcctgggttcaagcgattctcctgcctcagcctcccgagtagctgtgactacaggcatgagccactgcgcctggctaattttttttttttttttgtattttttgtaaagacagggtctccatatgtggcccaagctggtctggagctcctaagctcaagctatcctcccacctcgacctcccaaagtgctgggattttgggtgtgagacaccacacccagcttatatggctattttctcccacaaagtattcagagatcttctggagttcatctgttaatcacagttaaaggaagggaccatttcggaaaactcctattttggacgcggagtggtgatactttgatctagttgtctcatccaatgctgaaacaaatcctatataaagaagtttaaaatggtctgctggtgaggctggtgcctggactggagcctgtctgaatgttgaggagggtgtggtgaccttgttggagtacttgatgttgctagattggctaatgagagtgattaggaactaggtgaatcacggtcttgaaaactgaccctaaacaggggacagaaatgcccacttttgtgggcattttcaagctccaaaggagtagggccaagaatttatagcatatgtcaacgtttccaagctcagaggaaactaactggtgggttctatggttggtttaaaagccttgagttggccaggtgcagtggctcacgcctgtaatcccaacactttgagaggctgaggcgggtggatcaccaaggtcaggagtttgagaccagcctgaccaacatggagaaaccccgtctctactaaaaatacaaaattagccaggcatggtggcacgtgcctgtaatcccagctactcaggaggctgaggctggagaatcgcttgaacccgggagacggaggttgcggtgagctgagatcacaccatttcactccagcctaggcaacaagagcaaaactccatttaaaaaatagaaaagccttgggtcaaagggagaaagggaacctgctggcatgtatttcaggctaggctctgtactacttgctttcacatgtctcatttaattctccttgtgatctcagtggtatatccactttacagaagaaaaaaatgagatttagagatatcaagtgacttgcccagggtttcatagctagtgtgtgtcaaaagccagggttcaaacccagcctcggcttcagagcccatggctagccatacatcagaatgactctgtactcagtgatagataaagaaaaggggtgggggccgggcatggtggctcatgcttgcaatcttaacactttgggaggctgaagtgggcagatcacttgagcccaggagtttgagaccagcctggacaacatagggagacccctgtctttacaaaaaactaaaaaattagcagggcatagtgatgcatgcctgtggtcccagctactcaggaggctaaagtgggaggatggcttgaccctgggaagccgaggttgcagtgaactgagatcacaccactgcagtccagcctgggtgacagagcaagaccttgtctgagaaaaaaactcagagagagagaaaagggatgaggggggagggagggaggaaaagaaaagggatgaggggcagggcgcggtggctcacgcctgtaatcccagcactttgggaggccgaggcaggcggatcacgaggtcaggatatcgagaccatcctggctaacacggtgaaaccccatctctactaaaaatacaaaaaaattggccgggtgtggtggcgggcccctgtagtcccagctactcgggaggctgaggcaggagaatggcgtgaacccgggaggcagagtttgcagtgagccgagatcgtgccactgtactccagcctgggcgacagagcgagactccgtctcaaaaaaaaaaaaaagaaaataaagaaaagggatgaggagttcctggcatttttatttgtccccttttctccctctctagctctattaagacaaagcttttcagatttcacttaaacattaaccatagtttagaaattataattatcaccctatgacagaaggtaccctttcttggtacataattcaagctattaggaatttcttctgcattcactgggtttcatgaatgcaagtggtgtttgctaggtgcattctaaatttgacaaacatgagtgttgtcttggcctgcagacttaaaatagccacctgattataaaagaagtacaggtcttaagtgtatgtccaaatatggaacttgaatgatatggcaaaattagaaatgcaattttagaagtaattacactgttgtgtaaatggccacctcttttgaagtctttgctacattgcttataaaacactgagttgaacatgagaaagccttttgtctgcagctgtacttttcaactggacatgaaccatgtacttttatggcacgtagatattcacatcaaatttctgatttgcagaccgattttatttttagttaacaaataagcttatcaaatgtggcttttgaactaaagcgcttttaattaaggagttataacagcatgttattttgagtagctgttactaaaatctgttgtgatggaacaatttggagtgagcatctgatatcagagataaagagagaagcatgcagtgagcatctggaagttcttgtaaaaaaaaaaaacaaattaaacattctcatttgaatgcatttaaaatttttttaaattgccaattcctaagctttttctttgttagttgtagtttgctttctcgactgtataaaagaaaaaagtaatgacttaactatcttcactcttagaatagaatatgaaatgctagcatttctctgccagttcaaggtatcagatgttttttatttaaagttgcacttacctttgggttccccccccctttttgtttgtttgtttgttttgttttgatacagagtctcactctgtcacctaggctgcagtgcagtggcaccatcttggctcactgcaacctccgcctcccatgttcaagagattcttgtgcctcagcctcctgagtagctggaattacaggtgcctgccaccatgcccgtctgatttttgtatttttagtagagatagggtttcgccatgttggccaggctggtctcgaactcccgacctcaggtgatccgcccacctcggcctcccaaagtgctgggattacaggcttgagccaccatgcctggcctgggttcctttacaattagcagaggtgctgcttctgctttctgagactgatttctgctttgtcagctgaactttcattgttcactttacaaccttctagtggcccttccattcatttcctgcttgcatcagaattcatatctcacatttcagcctccacccaaggttaacatgacacatacttacgtgtgttgaaacttgagtttattgtgagggtgcctcctggaaatgataaagttgggggtagaggaaggctggctgctttttgaaaaatgttcccatttcagttaatggttgcttcttcaagtgtatctagatttgggtacctataaaatagagaatttttaatttaatgttttgcagattcctgcttttcatttagttacaattaaaagtttaaaaagtattatcacaaacgcctacatactctttgcctagattcaccagttagcattttgccacattcacattctatatattttctgtcctgaactattgaaaataagttacagtggctgggcatggtgactcatgcctgtaatcccagcactttgggaggctgaggcaggtggatcacttgagcccagtcagagcagcctgggcaacatggtgaaaccccatctctacaaaaattacctgggcttggtggtgcatgcttgtagccacagctactcaggaggctgaggtgggaggatcacttgaggccagaagacggaggctgcagtgagcatagattgcaccactgccctccaaacctgggtgagagagcaagaccctatctcccctgccccccacccaaaaaaagaaaagaagttacagaagacatcatgatacttcatccctgaacacttcatcattatctttgtctcctaagagctaggacattctcctatctaatggcaataccgttatcacacctaagaaaatgaaaataattccatatgtaatatctagtttaaattgtaattttccctgttatacaaaatacatcttttctgcccattttttaaaatgtggattatgggccaggcacagtggctcacacctgtaatctcagcactttgggaggctgaggagggcgggtcacttgaggccaggtgttcaagaccagcctggccaacatggtgaaagtccatctctactaaaaatacaaaaattagctgggcctggtggtgcacacttgtaatcccagctactcaggaggctgaggcaggaggatcacctgagtccaggaagtggaggttgcagtgagctgagatggtgccactgtactccagtctgggcaacagagtgagactctgtctcaaaaaaaagaaattatattataatcaactttcacttatcaaatttggttttcatagctctctagaacagttctcatcctgcctccatattgcctttttggaatagtccaggccagttcttctatagaatggcacacaccctggctttaactgtttatttcctccttgtgttgcttgactagttcctttatcctttatttcttgtaaactgaaaattagatctgaatcttgattggatttagagtaaatatgtttggcatagagacttcattggtaggttgaccatattcccaggtttctccaggatagccctgtgacctgttgtgttggcataattattatttatttttgctctcagaagtgttctggtttggatggtacgttaagtcactatttataagtgacgatgtgtacttcatgtggactgccatcaggaggcccatccagttagattgatccactatttataacatggtgattacgtggtgattgccagatttcttcaacgtaaaggcatctttttctctttgtagttaataagcaatctgtgggatgataatttgagactaggaatatcctgtacccatggtttaagagtccattgacgaccctgaacagaataaattccacattagttgttacaatgctagatttattcagatggttaagttttgacaatgagatagatttttttttttttttttgagacagaatctcactgtgtcgcccaggctggagtgcagtagcgcgatgtcggctcactgcaagctccacctcccaggttcgccattctcctgtctcggcctcccaagtagctgggactacaggcgcccgctaccatgcccggctaattttttgtatttttagtagagacggggtttcaccgtgttagccaggatggtctggatctcctgacctcgtgacctgcctgccttggcctcccaaagaaagttctgggattagaggtgtgaccaccatgcccggcctttttttttttgagacagagtctcgctctgtcgcccaggctggagtgcagtggcatgatcttgattcactgcaacctctgcctcctggatgcaagcaattctcctgcctcagcctcccgagtagctggaactagaggcgtgtgccaccacgcccagctaatttttgtatttttagtagaaactgggtttcaccaggttggccaggctggtcttgaactcctgaccttgtgatccacctgccttggcctcccaaagtgctagtattacaagcgtgagccaccgtgcctggccagattattttttaatgggaggacaatgttttatttatttccgaacatcttaagatcctcaggcaacttaaacattggttacttgccttttccctattgtataaaatgctttttgttattgttcattgcagctttctctcctttgaaaacactaagaataatgtcactgcatcagtttttactagagccaatcacctgtcatgcctggaacagggatcgtactcgtaagtattttattaactttgcttttgtattttggtacctttggtacatttcatctttagacacatttagggctcacatatctcagtatcacatgtgcaaagaacatacatctattatatacattcagaagggaactaagtcagtcctttggtttacagatagataaactgaggcccagagtgaaggaagggctttgcagaggttacataccaagttcacatttagtcagagcactaggacctagaataagctgtttcagagacaagtggtttgctcctgagctactcagagcattattaactagtatttactatgttattcttagtcagcttgagtttctagttttctagctccagcaaactagaaagggatggagaatgctcttagaagtaggcacagttcagcaagcaaagtgacagataatatgacaagatgaggctgggtgcagtggctcctgcctgtaatcccagcactttgggaggccaaggcaggcaaatatcttgagctcaagagttcaagaccaacctgagcaacatggggaaaccctgtctctacgaaaaaaaatagaaaaactgtgtgtgtgtgtacacacacacacacacacacacacacatatatatgtattttttttttttgagacagagtctcgctttgtcacaaggctgagcatggaggctcatgtctgtaatcccagcactttgggagaccgaggcgggcagatcatttgaggtcaggagttcgagatcagcctggccaacatggtgaaaccccatctctactaaaaataaaaaaaattaaccaggtgtggtggtacctgcctgtaatcccagctactcaggaggctgtggcaggaaaatcgcttgaatccgggaggcagaggttgcagtgatctgagattgtgccactgtactccagcctgggtgacagggcaagactctctttctcaaaaaaaaaaataataacaataataattaaataataaaaacacagaaagagcaggattggggagaaaaagtccaatttcgcttatttttcttttgttgcttgtacttctgctgttgtatcaaagaaaccattgcataatccaggatcacaacaatgtgtgcctatgcctgtgtttccttctaagagtcttaaagctttagtccttttatgtaggactttggtccattttgagttaatttttgtgtatcctgtaagatagggttccttttgtatgtagatatccagttttcatttttttcttctttttttctgtgtttatttatttatttatttattgagacagagtcttgctctgtcatccaagctggagtgcagtggtgcaatctcggcttactgcaacctccgcctcccaggttcaagtgattatcatgtctgagcctcccaagaagctgtgattacatgcatgcgccaccacacctggctaatatttttttttttgagacgcagtctcgctctgtcgcccaggctggagtgcagtggcacaatcttggcccactgcaagctccgcctccggggttcacaccattctcctgcctcagcctcctgagtagctgggactacaggcaccagccaccatgctcggctaattttttttgtatttttagtagagacagggtttcacctgttagccaggatggtctcaatctcctgacctcgtgatctgcccgccttggcctcccaaagtgctgggattacaggtgtaagccactgcgcccggcccacacctggctaatttttgtattttcagtagagacagggatgcgctatgtcacccagactggcctcgaactcctggcctccagcaatccacctgccttggcctcccgaagtgctgggatatacttagtgggcatgagccaccacaccggccaagataatcgagtttttcctgcaccttttgttgaaaactatcctctctgttttattgccttggccccctttttgaaaatcaactgactgtaaagatgagagtttatttctggactctcaattctattccattgttctttatgtttatcctaatttcaggaccagtctgtcttgattactatagcttggtggtaagttttgaaatcaagaagtgtaagttccaactttgttcttttcaagattattttggttattgtgtcgcttgcatttccatatgaattttaggatcagtttgttaatttcttttaagacgtcagctgagattttgacagaaattactttgaatctgtagattcaccatctttttaaagcatttcagggctgggcgtggtggctcatacctgtaatcccagcactttgggaggccaaggcaggcagatcacgaggtcaggagatcaagaccatcctgactaacacagtgaaactccatctctattaaaaatacaaaaaattagcccggtgtggtggcgggcgcctgtagtcccagttactcgggaggctgaggcaggagaatggcgtgaacctgggaggcggagcttgcagtgagccgagattgtgccaccgcactccagccttggcaacagagtgagactcagtctcaaaaaagaaaaaaaaaaaagcctctgtattgggtaattgaaaatgtataacctagcaggacagtgaatttagagcatgtgttttgtgatcatctcacagagcttcatagccaactttcctatatcttctgtttccactttcccatctaataataggcttttggagtatttccaattatttttaatacagatgcaagctatcattgtcctcatttaaactacttgataaattcagcatattaagtcaacattttttgtgacattgtaatttgaaatttataacattttccaggtttaaatttggacttggcttttgaaatctctatatacatgtgagaaagtgagagaaatatataactatttaccagaaagcactcttaagtccttaggattttatagctagatatttacctagttccacagttttatctgtaaagcagatagatgtagctttcctaaggagggtaggaaagtgagtgtaggtggggactattaatgactggcctaaagtttggatcataggtcttaattttttttttttttttttttttttttttgagacagggtctcactctgtcacccaggctggagtgcagtgacgtgatctcggcccaaaatgcagcctctgcctcctacgatcaagcgattctcctgcctcagcctcccaagtagctgggactacaggcgcgtgccaccaggcctggctaatttttgtatttttagcagagacggggtttccccgtgttggccaggctggtctcgaactcctgatcacaggtgatctgcctgcctcaacctcccaaagtgctgggattacaggcgtgagccaccacgcctggcccatagatcctaattttaattttaagaaaccaataaaaagaaagaggggctgggcatcgtggctcatgcctgtaatcctagtgctttgggaggccaaggcaggagaattgcttgaggccaggagttaaagaccagcctaggcaacatagtgagaccctgtctctactaaaaataaaaattaaattcaattaaaaaaaaaacagatgaactagatggggtaaaaaaagatacatgaatacaggtctagtatcccttatctgaaatgcctgggaccagaattttctggacttacgatttggggatatttgcataatatatacgatttgagcactgaaaatttgaaatccagctgagcctggtggctcatgctggtaatcccagcaccttgggaggccaaggcaggcagattacctgaggtcgggagtttgaaaccagcctgaccaacatggagaaaccctgtctctactaaaaatacaaaattagctgggcgtggtggcgcatgcctgtaatcccagctacttcggaggctaaggcaggagaatcgcttgaacctgggaggcggaggttgcagtaagccaagatcgcgccattgcactccagcctgggcaacgagagcaaaacactatctcaaaaaagaaaaaaatgaaaatctgaaatccaaaatgttccagagagcattgcgtttgagcatgaccttttgagtgtcatgttgatactcaaaaagttttggatttgggagcatgtcagatttcagcttttcagattagggatgctcaacctgtatgagtttttaaaaagtccgttttgtgtattatattttggattagttcaggaaattactcttgaaaacaaagtattgtgatttatattggctttattgtaaaggagaatttcagtatagtttatcagcagaatcaatttttttaatataaactagtggttccagcctgggtccatgatagcagtaatggaagtccataacctattttcagtgtttcaaaaagacaaacagaaatttagatttagctctaataatattgcacaggtgaatgaaactgtcaaacatttttaccctgatctaaagttattttagctaagtacactaacattgtttatttttcgctggttagaatcattaattgacagttgtacgtgtctctgggaaaatgaattttaatcttagttttcctgtaaagcattataaaatacagggtccaagtaaaggttaaaaaaaaaatggaattattcagaggtgaatttgggaactactttttcaaaagtttttcttttccttactatagtctgcttttaaaacaactgtgacatgtcccctttttggtgacaattgcaagttcaggtgttaactgttgtttgacttgtgtctccagagattgccctcagtcccaataatcacgaagtgcacatctataagaagaacgggagccagtgggtgaaagctcatgaactcaaggagcacaacggacacatcacaggtaaaggaagatagccgtgagcttagtgtgatatttccaaatcaggcactcttccttttagataaagagcctaataaacccaggtggccataatttttttttttttttttttttttttgagaaggagtatcactctttcgcccaggctggactgcaatggcgcaatctcggctcactgcaacctccacctcccgggttcaagtaattttcctgcctcagcttcctgagtagctgggattacaggcacgcgccactatgcctggctaattttttttatttttagtagagataggtttcaccatgttggtcaagctggtctcgaacccctgacctcgtgatcctcctgcctcggcctcccaatgtgctgggattacaggagtgagctaccgcacctggcccgtaatatttaaagtcatgcagcacttactgaatttccttaaaattttaaagaaaatactataatgatcttagttgttaagtgcttcttgtggccccagctggtacccagcactctaccgttgctatggaaagcactgaacctaccctgaggactaaagagctaaaattaggagatgagacgtgaaattgaaagctagataacatgaaaatgtagacaacacgaaaacgtgcgccaaactatttccaagtgtcttccaaaagtttcctttgtgtttttagggtaaggaagactttccagaatattgagaagaacaaagtaatataataaacacccatatcagataatcgccaccagaattaccaactttttccctgtgccaggaagtaatttcttttcctgtatcaggaaacttaaggaaaaaggatgtaataataaggaatattattcttgatgatggtaaagtcacctctcaccagcagtcctattcctctcccctggaaggcagactataatttgctatgacaccattccagtccatttttaatacatttacatacatacatattcataaacaagcttaggccaagcacagtggcttacacctgtaatcccagcactttgggaggctgaggcgggaggatcgcttgaacccaggaatccaagactagcctgggcaacataatgagaccccccgttagcacggtgtggtggcatgcacctgtggtcccagctacttgtgaggctgaagtgggaggaccacttgagacaagatcaaggctgcagtgagctgtgatcacaccactgcactccagcctgggtgacacagcaagaccctcatctcaaaaaaaagaaaaaagagaaaacaatctttaggactattgactagtatttttttgaagctacataaatggcatgatactatgcatctccggcagcctgcttttgcattcatgattgtttctgagatccatctatgttgctgtctagatcaagtttattccttttaaccactctttagcattttatacctcatttatttactccttcctccactgaagaacatttaggttgtttcaatttttccatattacatgaaagtgctgaataggcatcccttgatttctgtacgtatgtgtgaatgtttgtagatggtagatgtgttaataccacagggtatgcatatctgcagtgcagtgttgccaggcctcatcagattgccatcattcccacctgtcctgtatgagagtgctcattttcccacaccccgccacatacttgagatgggaagactgaagaatgcatgaaaggttcatccattgcttctgtaagttgtattttcctgattcatggaaaagttgagatactttcagacgtgtattagccatgagagtttttcttccttgtgactgtcctgttcataaatcctgatcattttttcattgagtttttgtcttttttctgtttttgtttgtttgtttgtttgtttgtttgttttgagatggagtgtcattctgtcgtctaggctgaaatggagtggtacagtcttggctgactgcagcctctgccttccaggttcaagcaattctcccgcctcagcctcccgagttgctgggattacaggtgcctgccacaatgcccagctaatttttgtatttttagtagatgtgggatttcaccacattggacaggctggtctcaagctcctgacatcaagtgatctgcctgccttggcctcccaaagtgttgagattacaggtgtgacccttttttttcttttagacagggtcttgctctgttgcccagtcacccaggctagaaggatcatggctcactacagcctcaacctcttgggctcaagtgatcctcccatctcagcctccccaggagctggtactaaaggtgtgcgccagcacacccggctaatttttttgtaaagatagatttcaccatgtcgcccaggctgattttttattcttttagttggactctgcaattttacctctaatcacctaaaatactgataagcttagagatatccttacccaaatgagagaacttagcatgttttgctattctacatcctttacagaagttgtcctgcattcttcagcaataactcatggccacccttgctttgaccagtgatttataaataatgctcttgagcaccagtagctgagtatatttccaaagcagcaccaaagacagcgtttctatttttgttgctgttcctttcccacaatcttatttctattaggtttggcctattttcttaagttcctttgccagtggcctcatagcctaagaataagaatactcatattttaaattggaattttaggccgggtgcggtggctcacacctgtaatcccaacactttaggaggctgaggcgggtggatcacctgaggtcgggagtttgagaccaacctggccaacatggtgaaaccctgtctctactaaaaatacaaaaattagccgggtgtggtggcaagcacctgtaatcccagctactcaggaggctgagacatgagaatcgcttgaacccaggaggcagaggttgcggtgagctgagatggcgccactgcactccagcctggggtatacagcaagactctgtctccaaaaaataaaaaattaggctgggtgcagtggctcaagcctgtaatcccagccctttgggaggctgaggcgggctgatcacctgaggtcgggagttcgagaccagcgtgaccaacatggagaaaccccatttctactaaaaatacacaaaattagctgggcgtggtggcacatgcctgtaatcccagctactcaggaggctgaggcaggagaattgcttgaacctgggaggcggaggttacggtgagccgagattgtgccattgcacgccagcctggacaataagagcaaaactctgtctcaaaaaaaaaaaaaaaaaaaattaattggaattttagaatttaaaaggaaatacttttaaatgagaaaaggcaaagatgaaagaccaaagaaatcgccaaaaatgtgaaatatttagttatgtgtttttttccctctacttctcttttggggtcctttgaacttgggcctgttttctgtctagctgctcacatggcattttttagatctgaaataacttgttggaaaaatctaaatataactctggggcaggagatcaaggatcagacatattttctcagaaagatagtaattttaggggaaaaaaatattttctgaagcattctagaagaaaaaactagtccatactacaaagaaaagaagtgtggcaaacatcagggatatcagagttctgaggttttattcttttgtattaaatatttttaagaaacatgttttgttaccatggaaaattttaaacagatttttaaaaaagtggaatagtataatgagccttttatacccatcacctgcattccacgattatcgagtaacagccaatcttgttcttctcaattcactttctcctttcctgtactaatttgaagcacatcccagacattatattgtttcatatttcagtttgcatctctaaaagataatgatttttctttttaataataataaatattgatcaggcttacacctgtaatcccagtgctttgggaggctgaggcaggcagatcacttgagccctggagttcaagaccagcctgggcaacatggtgaaaccccatctctacaaaaaattagccaggcatggtggcttgcacctgtagtctcagctactcaggaggctgaggtaggaggatttcatgagcctgggaggttgaggctgcagtgagctatgatcacgccactgcactccagtctaggtgataaagtgagaccctgtctcaaaaaaaaaaatctaataaagaggacagcaagcaaaattatcttgtaatgaataaataaaataaacatcacttagaacacattctcatattttcttcccttcagtggtacaaaaaattgagctgatatttcatgtgggtaaatgaatgaataaactaaactcttcatactacttttttttttttttttttttttttgagacacagtctcgctgtgtcacccaggctggagtgcagtggtgcgatctcggctcactgtaagctccgcctcccgggttcacaccattctcctgcctcagcctcctaagtagctgggactacacgcgcctgtcaccacgcccggctaattttttccatttttaatagggacagggtttcaccgtgttagccaggatagtctcgatctcctaacctcgtgatccgcctgcctcggcctcccaaagagccaccgcgcccggcctaactcttcagtcactatgacttatgggtaattgaggctcagaggtatatttgtcttttttccatataaatgtcaagaatgctaattattaatttttagagagagatctgtaataaatatttattagtaatatttctgtactttttaatgtgaaattatatttatagaaaatacctcatcaaggccaggcactgtggctcatgcctataatcccagcactttggaggctgagacaggcagatcgcctgaagtcaggagttcgagaccagcctggtcaacatggtgaaaccccgtctctactaaaaatacaaaaattagccgggcatggtggcatctgcctgtaatcccagctactcgggaggctgaggcaggagaatcgcttgaacccgggaggcggaggttgcagtgagctgagatcgtgccattgtactccaccctgggctgcaagagtgaaactccatctcaaaaaaaaaaaagaaagaaaagaaaagaaaatacctcatcaataagtgttaaatgagtcatggtgaattttgctcttggtatataagaaactgaccttgagtcttggtatatgaaaaactgaccttgactttgggattcttcacagaggtaccagataagtaaagtctcatcaaataagaaaaataaaccttacattcagatacatatttaggtatcttcctggtttagatgcaaagaaacaaggattctttcacaggacctgcatcatgtagaaaaggttttcagtatggttcaactggcagtgactttcagaagaatatatgatgaatcacaatatatagttccccctctttacactaaagattatttttatttaccctgtatgctgttttagttgaatgccatgtagcagactgttggttaatatcatagaatgaggtgtgttaatgaatacagttattttcacacacacaaaaatctaataaagaggaaagaaagaagtaatgaatcttcagatctttagaagtcttagaaatgtgtgaatgggtggaaagaatggccccgtttagttttgtaaagtctgtaattataaaacagctcttctacatgacctcatagacaatcccgagtcccagacgctttgcagagaagcatccttgcctttccttgaggcggtgatcaggacatagatagtgggaaggatgtgcctgggaggaaggtcccaagaccacgtctcatcctggcatgccagtgccacccacctgcctgtgccgcagttgtttgtcattgactgggcaaagcagatgacccatgtctcacttgcaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgagtgacatctgaattttttctatccctctctatagaatttacatttgcactgctgtgtgagggctcaccataactccagtttttctcatccggagttgtgtggttttttctctgaaattctcgattctgtctgagcattttcccttctcatgtgcatgttaagttaaatcgcacgttttttatattaacatagagctattgtgtccatgttctgatcgcctaacttgtttcttctgcaagatgctattactgttctcactctatactgcgcaaattgctgttttcttactctcatttacaaataataacattgaaagagtctccgttccctgaggaatattttttctttttttttttttttcacaggatatctatgtaggattcctacagataacaatgttctttttttttttttttttttttttttttttgagacagagtcttactctgttgcccaggctggatggagcgcagtgacacgatcatggctcactgcaacgtccgccccctggttcaagcaattctcctgcctcagcctcctgagtagctgggattacagtcacctgccatcgtgcccggctaatttttgtagttttagtagagacaaggtttcaccatcttggccaggctggtcatgaactcctgacctcatgatccaccgcctcggcctcccaaagtgctgggattacaggcgtgagccaccacgcctggtcaatgttccttctttaaagcttatttgccaaccaaatctgtgtcttggtgtaatattttacttgtttaaactgttgaagtcaaaactcaccagaatcttagaagtctaatcagctattgcacattttttaaattacttcttgctgacccagtcaaaacacaggtttattttatggccaaaacttattttaactactccttcctgtttgttttgataaggaaacaattattctccagcctggccaagatggtgaaaccccatctctactaaaaatacaaaaattagccaggcacagtggcaggtacctgtaatcccacctacttgggaggaagcaggagaattacttgaactcggagggcagaggttgcagtgagccaagatcgtgccactgcactccagcctgggcggcaaagtgagattctatctcaaaaaaaaaaaaaattatttttctgtgtggcatgtgttcagcatgactggtaaatatccttcaacgtaaagttgtcatttactactaaactggcagtgtttgtgtttctactaaaaatagcagagtatacatgactctttgtagctgttttgttatttgtattctgctgaaattgaaagaaggggattatcatgttacctttgtaatttagtaaaacttcagaaattttattcttcaaaaagagattgggaatttgcggtaaaattgagttatgggccaggtacagtggctcatgcctgtaaccccagcactttgggaggccgaggcaggtggatcacctgaggtcaggagttcgagaccagcctgaccaacacggataaaccctgtctctactaaaaatacaaaaaaattaacggggtgtggtggtgcatgcctgtaatcccagctacctgggaggctgaggcaggagaatctcttgaacccagtaggcagaggttgcggtgagccgagatcacgccattgcactccagcctgggcatcaagagtgaaactccgtctcaaaaaaaaaaaaaaaaattgagttacgaatttgaaacatacatttttctttcaaatgtgaaatcaaggctaacaaaatgttacctgctagaaactatttggaagtttcattgtaatgagataggaaactaacttcattaatattctctcaaggctaaactttatgtcagctggtactccttgcaatcttacaaatttctacaggaaacttttcttccaagttaagcttcaacctcagtaattgtttacatttttattcgttgagaattagtgtcaagtataggtaaattggactttattatggtacaaggtattgtctttgaacaagctgtatgtttagggcagtttctcagctgtagaacaattatttcatatttcataggagtactttaaaacaacttctcagaagtttataattcagccatatgaactaattattttgcttgccatcttttccttaattaaaaaaattacattataaaggccaggcacggtagctcacgcctgcaatcccagcactttgcgaggccaaggcaggcggatcacgaagtcaagagttcgaaaccatcctggccaacatggagaaaccccatctctactaaaaatacaaaatattagccaggtgtggtggtgcatgcctataatcccagctacttgggagtctgaggcaggagaatcgcttgaaccagggaggtagaggttgcaatgagccgagaccatgccactgcactccagcctgggcaacagagcaagactctgtctcaaaaaatatgtatacattatgaaacaattcgaaatactgtctttttctccttttttagagactttgtgggggattttggttttttattttatttatttatttattttttgagacagggtttctctctgtcacccagtctggagtacagtggtacaaacacggctcactgcagtctccaactcctgggatccagcagtcttgccacttcagcctcccaagtagttgggactacaggtttgcaccaccacacctggctaattttttgattacttgtggagacaggttctcacttttcttgcccaggctgatctcaaattcctgtactcaagcaatccttctgctttggtcttccaaagtgctgggagtatagttgcaagcctctgcacctggctgtctttttcagaatgaacttcttcagacaggatactaagaaagtgattctgtagccaggcgtggtggctcatgcctgtaatcctagcactttgggaggctaaggcaggcagatcacctgagaccaggagtttgagaccagcctggccaacatggtgaaagctaatctcctctaaaattacaaaaattagccgggcgtggtggcgtgagcctataatcccagctatcgggaggctgaggcacaagaattgcttgaacacaggaggcagaggttgcagtgagctgacattgcgccactgcactccagcctggatgacagagtaagactctgtctcaaaaaaataaaaaataaataaataaaagaaagtgattcttgcttgaccccgggaggtggaggttgcggtgagctgagatcacgccattgcactccagcctggacaacaagagcgaaactccatctcaaaaaaaaaaaaaaaagaaagaaagtgattctatagaaaggtaatttagcattgaaggaaaggcattggctcaatatttagtctcccaactgttgagcaaccagacgtgattggtttttaaacagcagtttgggggcagaaatgaattagttaagccaaaatactgactggtcctagacataaatcatcttttttggatggtgctagcgaattagaggctaatccccaacatgaggttcttctaatttcttggttgtgatttttcagtgaaagaaattaaaaagaatttgcagattcgtggagacttgggaaggatattaagctgtcttacaaccccaaattcaccaaaaattcagcaaatcactgaatattcataataaaaattgaagtattttcaaacttcagtttttatctcagaggttaacgtcctatgtaatccgaaatctcacgaaaacataactgagttaatcaatatctatgcttactaatgaggactgctgaaaaccagctgttgtgctgagaacatcagggccaggagtggagaaggcctgttcatggttcttttcctttctgtcctttagcaatgcaccttgtcagctgggcgtagtggctcatgcctgtaatcccagcactttgggaggctgaggccggtagatcacttgagccccagagtttgagaccagcctgggcaacatggagaaatctcatctctacaaaaaatacaaaaattagccagtctcagatcataacctggtatcaaaaaaccttgtctctggcagaaggcctggtgaccgacagaagaacgttgaatgctctgttacttttctatagaatctttttttatagaaacctatctgaaaaagtttattctgaaaaaaataatattctgaattgttttataatttttttttaaattaaggaaaagtgtggcctacttaggtattttcacctgacatacatttgtaggtcatttggggatgctggttgagtggataaactgaaacagttttcccctctcataggtgggtgagcaagcacattaaaaagccgattcgctccacagtcctcagcttggattggcatcccaacaacgttttgctggcagcaggatcatgtgacttcaaatgcaggtgggaaccagtgagaactgataaacttgagccgtgcattcttcatccttcaacaaataattttaggttctctttctttgttttttgttttgttgtggttgttgttgttttgagacagggtctcactctcacccaggctggagtgcagtggcaccatcatagctcactgcagcctccaattcctgggctcaagcgatcctccagcctcagcctccagagtagttgggactacaggtatatgccaccacacctggctaatttttttaaaattgtctttattctttgtagagacggggtcttgctacattgcccaaggttggtcttgaactcctggcctcaagtgatcctccctccttggcctcctgaagtgctgggattacaggcatgagccagtgtgcctggcctgtaagtttccttttctttgcaaggtactgcgctaggcactgtgagggactcaaaaatgaggcctggtgctgtggctcacacctgtaatcccagcactttgggaggctgaggtgggcggatcacctgaggttggaagttcaagaccaacttggccaacatggtgaaaccccgtgtctactaaaaatacaaaagaggccgggcgcagtagctcacgcccgtaatcccagcactttgggaggctgaggtgggcggatcacaaggtcaggagatcgagaccatcctggctaacacagtgaaaccccgtctctactaaaaaaatacaaaaaattagccgggcgtggtggcgggtgcctgtagtcccagctactcgggaggctgaggcaggagaatggtgtgaactcgggaggcggagcttgcagtgagccgagatcacaccactgcactccagcctgggcgacagagcgagactctgtctcaaaataaataaataaataaaagttagcctggtgtggtcacaaatgcctgtaatcccagctacttgggaggctagggcatgagaatcatttgaaccggggaggtggaggttgcagtgagctgaaatcacaccactgcactccagcctgggcgacagagtaagactccatctcaaaaaacaaacaaaaacaaaacaaaaaaatggaagcagtttgtgatccagaaaaggagctcaagcatggtgattaaaagaacaagttcataagtcactgaggtaaaaagaaatccacttggaagtggggtaggagggagaggcaagggtggggccagcgaagatttccttaagtgtaagaatatctatggtttagaggggaggattagcatgtactctctctgtctctgtctctgtctctttcttaccatctctttctgtgtctccctttctccctgtctttcttgacaacagtatttttctcatttcatattccaggcagcagtctctgcaaattccaaagtgaaacaattaataaaacatagctaaacagtgcgctgctaagctgttattgtgctgttctttcagttaaagctttttattttgtcattagcttgaagctagaagaaatgcagccactttgctaagaactttaaggatcataccatggaattccatgtaattgctttttaaagttgttctttctcaagaatatgcttttttccctttagctgaaaggaaagcaaagcaaataaatgttgctttgtgttgactatatggtaggttgggagatgaggtgcacttttttttttttttttttttttttttttttttgagacaaggtcttgctctgtcacccaggctggagtgtggtggtgcgatcatagctccctgcagcttcgacctcccggactcaagcaatcctcccacctcagtctcctgagtagctgggaccacaggcatgagccaccatgcctggctgattttgtttattttttgtagagatggggtctcactatgttgcccaggctggtctcaaactcctgggctcaaagaatccttctgccttggcctcccaaagtgctgggcttacagggatgagccactacactcagctgggatacactttcttcagtaactgtggagaattcccagaaaaccaggctagtggtttatatccaggaatactcaaagcttaaaaaaaaaagagagagagatgtgtttgagtttggcggagaggatggaggtcatgggagtgtcaaggcactttatattctggacctgtgttacttgtgatttcttaaccagagtcattggaaaatagaactaggtggcactaacccacaccacctggattctttgatggttgtgaaaataggttgcagttattttgttaatattaatttcccctagtttctctgtcacaaaagctggagtgcagtggtgtgatcctggctcactgcaacctctgcctcccaggttcaagtgattctcatgcctcagcctcccaagcagctgggattgcaggcgtacaccaccatgcctggctaatttttttttttgtattttagtagagacagggtttcaccatattggccaggctggtctcaaactcctggcctcgagctatccacctgcctcggcctcccaaagtgctggggttacaggcatgagccactgcgcctggcccagtcctgtgggtatgggtctgtcccatttgtgttcctgagttggtggctgagagccactggttctttcttggccttctaagactaaagcagccgctgtcatgatgcagatttaaagcacagtgtttctactgtctcgtcatataacctcacataactcacagtcctctgccaggcatcttccagagcctctgtactgccattgtcatttggggtggtaggggggatacctcggttcttttagggagcctttaggttcagcagttttttggagagaagaaggtgtacaaagtagaaatcacattggagggcgaaagggccctaaagggtagatttccagccgttcccctttgcccttaactctgggccagaacatcctcaaacacagctgtgtggaattagataaaagagtgagttagtggaaacgggcgacaccacctataaaggacctgcctccatcttaagctattcctgccacagagactggacagtgggcctgagggtccagggagcctgcccaccccttgtcaccagcctcccttggctttctcttggggtatgtctttaaaagggtcaacaccattagtttgttgcagggtggcaaatagtttctgctctcccaccattgactgcgcaggcttcctggagtactgtgttgagaatgatggtaaggtagacaggaaagaatgctgtggccatttagcaaggtctcatgtgggcaagggagggatgggacagcaagatctccccagaatgtgcagtccatgaggacaggtcttttgtgatcactacttcagaacctggcacccacagcctgacacacagtaggtgctttgatagtatctagagtatggattagctaggcgcagtggcacacatctgtaatcccagcactttgggaggctgaggcaggagtattacctgatcccaggagttcgagaccagcctgggcaacacagcaagaccccatctctacaaaaaattttaaaatattagctgggcataatacgaacttgtagtcccagctactcgagaggctgaggcaggaggatcacttgagcccagaagttggctgcagtgagctttgatcacaccactacactccatcccgggcaacagagccagacccccgtctcttaaaaaaaaaaaaaaagttggagcgggggatcaggtgtggtggctcatgcctgtaatcccagcactttgggaggccaaggcaggtggatcacctgaggtcaggagttcaagaccagcctggtcaacatggtgaaaccccatctctactaaaaatacaaaattagccaggcatggtggcacatgcctgtaatcccagctacttgggaggctgaggcaggagaatctcttgaacccaggaggcggaggttgtggtgagccaggatcatgccattgcactccagcctgggcaacaagagcaagactctgtcccccaaaaatatatatatatatactagaatatggatttgccaaacttgggttggcctgtagatagctctaacaataattctgttacttgagaggtttgaatatctggacttacctatcatgatttattattttagtttagtttagtttagtttatgttatgttatgttatgttatgttatgttatgttatgttatgttatgttatgttattttagagacggtgtctcgctctgttgcccagcctggagtgcagtggcgcaatctcagctcactgcaagctgtgcctcctgggttcacgccattctcttgcctcagcctccggagtagctgggactacaggcgcctgccaccacacccggctaattttctgtatttttcgtagagatggggtttcaccgtattagccaggatggtctcgatctcctgacctcatgatcctcccgccttggcctcccaaagtgctgggattacaggcatgagccaccgcacccagccttatttatttatttatttatttatttatttatttattgagaaggagtttctctcttgttgcccaggctggagtgcagtggcgtgatctcggctcactgcaacctctacctcctgggtttacgcgattctcctgactcagcctcctgagtagttgggattacaggcatgcgcccccacgcttggctaattttgtgtatttttagtagagacggggtttctccatgttggtcaggctggtctcgaactcccgacctcaggtgatccacccacctaggcctcccaaagtgctaggattacaggcttgagccaccgtgcccagctcatgttttatttttttttaatgagtcaacctctttgcattctgagattccttgtggcagctgcctatggcctgtttctatatacatatattttcatttgctttttccttttctctctgccctttaaacagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcagtgagtatttgcctttcatttggaaggtggggaacaaggggtgggatctctcaccagctgaaccaggactgcccttcctggggtgttagcacagggcacaaacataaaaaccttaatcaggccaggcgtggtggctcacgcctgtaatcccagcactttgggaggccgaggtgggtggatcacaaggtcagcagttcaagaccagcctggccaagatggtgaaaccctgtctctactaaaaataaaaaaaattatccaggtgtggtggtaggcgcctgtactcccagctactcggaaggctgaggcagagaattgcttgaacctgggaggcagaggttgtagtgagccaagatcatgccactgtactccagcctgggcgacagagtaagactccgtctcaaaaaaaaaaaaaaaaaaaaaacacctcaatgaaaactgcaggcaggcaggcctcagtggctcacgcctataatcctagcactttgagaggctgtgggcagatcacctgaggtcaagagttcaagaccagcctggccaacatggtgaaaccccgtctctactaaaaacacaaaaattagccctgctgggcacagtggctcacacctgtaatcccagtactttggtaggccatgggtggatcacctgaggtcaggagttcaaggccagcctggccaacatggtgaaaccctgtctctaataaaaatacaaaaattagccgcagtggctcacacctgtaatcccagcactttgggaggctgaggcgggcggatcacttgaggtcgggagtttgagaccagcctgactaacatggagaaaccccatctctactaaaaatacagaaaattagctggacgtggtggcacatgcctgtaatcccagctactcaggaggctgagtcaggagaattgcttgaacctgggaggcggaggttgcagtgagccaagattgcaccactgtactccagcctgggcaacaaatgcagaactccgtctcaaaaaaaaaaaaaaaaaatcagcccggcatagtggcatatgcctgtaatcccagctactcgggaggctgaggctagagaatctctggaacccaagaaacagaggttgcggtgagccgagattgtgccattgcactccagcctgggcaacaagagcaaaactatgtctcaaaaaaaaaactgcaagtcagcttttaccgtgacaggcacagacacaaattctccggttggaaaattttaaagacctaggtcttccagaaatacttcttaatggaagtactgataatgattcctttcaagaaccctcctggttggctactgataagggtcacttaaaaagggccagtttaagctgggcacagtggctcacacctataatcccagcactttgggaggccaaggtgggtggatcacttgaggtcaggagttcgagagcagcctggccaacatggtgaaaccctgtctctacaaaaatacaaaaattagcccagcatggtggcgggtgcctatagtcccagctactcgggaggctgaggaaggagaatcacttgaacccaggaggtgaaggttgcagtgaaccgagatcatgccattgcactccagcctgggcaacagagcaagactccatctcaaaaaaaaaaaggctagtttagtctgttactctgaattccttacaaaatgtaagtgccgttcaccggccttaaattaaataggagatatattcttactgggggaagtcagcgaacgatgacttcattaatttgagccttccattcagtaaggcttaaaaagcattgatgccacttctctgctgtggctggaaggactcgaattacggtggcttctttgtgagtggcgtgtctgttcagccataaagtacttggccagacatcagagttcattttgttcagtatatgttggaggaagagagaagattggaatccttcttcttttataaatctttgttcttccctggtgttccttttccattgatagctaaagggaactcaccattaaaggttttgtgatggacatggccacttgggtatcaaaaatcaatcacactgggtgacctttactccctgtcaggtcagtaagagtcacccagtgtaaacagcatgatatttcagacatgatatgtttttcctaacaggattaaatgtgcattttttagctagttttacatatttttttaaagattatcccctcaggccgggtgcagtggctcacgcctgtaatcccagcactttgggaggccgaggcgggtggatcacctcaggtaaggagttcgagaccagcatggccaacatggagaaaccccgcctctactaaaagtataaaaattagccaggtgtggtggcatgcacctgtaatcccagctactcaggaggctgaggcaggagaattgcttgaacccagcaggcagaggttgcaatgagccaagatcgcaccactgcactccagcctgggcaacaagaggaagactctgtctcaaaaaaaaaaaaaagactgggcacagtggctcacacctgtaatcccagcactttgggaggccgaggcgggcggatcacaaggtcaggagatcgagaccatcctggctaacacggtgaaaccctgtctctacaaaaaatacaaaaattagccaggcgtggtggcgggcgcttgtagtcccagctactcgggaggctgaggcaggagaatggcgtgaacctgggaggcaaagcttgcagtgagccgagattgcgccactgcactctaggctgggcgacagagcgagactccatctcaaaaaaaagaaagaaaaaaagaaagattgtcccttccattataaaatgtagtctttcagaagatttccctacataaacaggcacttatatatcttttcatttttaacagaaataagattattttatacatttttatatacatttggtaatttgccttttaatacttgataatacttttgtattttgatgccagtgttacttgatttttatatggtttattgtgacacagtaagttcttagcatacacttattacaagtccctgtctaccctcgtactgacttctttcccttttccagtcctgcaagtcagattacatgctccacctttccactcctccaacataaatatctcatgtagtaaaagtcaggtataccgcactaagggcttaagatgacacattagttcttcaattcaatgccaactttatgaagggtgtcctgagacatatacagttagcttttttttattttttaatttagagagacactctctgtcgcccaggctggaactcctgagctcaagttctcctcccacctcagcctctcaagcagctggagccacagacgtgcaccaccactctaggctaatttttttttttttttaatttttcgtagagactgggtctcactatgttgtccaggctgatctcaaactcctgcctccagcaatccttccacctcagcccctcaaagtgctgagattacaggtgtgagccaccatgcccagccacagtcagcttttgaatgcatcgtttcttgcatgaagtgaggtgctcctaactcatcagccagtgtgtctgcctgccatatctgtgtaatctctttgccacattcaagagcaaataactacatgcacacacatgtccctgcaggcacacatacacacacatggcccattcgagtgtgagctcctggctaagaccgtttggttcatcttggtagctctagctcctaacacagtgcctggccgtcagcacagatctgtgtggtcacagccctctcggagctccggtgagcacaggcaaggagaaggtcctagcacaggtgtctgctgccaagtcatagtaacaggaagagctctaggagctaagagcagggagaagccactttaggcggaagtggcccgggaaagtggaccgtgggatcatgggggtgatccctttagagctgtgctgggggtggaagggcgtgatgcaaagactgggctttgggaaccagtttgtcgtcagtgggcagggcctcagaaggaggcagagccggaacccagggctgcccctgtcttgagaggcctgcaagttgaggtcaggggctccttttcaacataagtgcccattgatactgcagaagcccctgtgagaatgggtcctttgtgatcatctgtgtctgtaaagaagctaatagtctgttgcatcttgggataacacatgttcttgtgttcagggtctcgactctgaagacagagttcctgccgctcctaagtgtgtcatttgtctcagagaacagcgtcgtggctgctgtgagtatttttcttcattctccctcggggtgcactgtatgtgatgctcagacagggaacaatgtgtgctctgtcaccctagcacaaagcagaacagttttttagaagaaacagagctcacttttttttttttttttttttttgagatggagttttgctcttgttgcccaggctggagtgcaatgggtgatcttgactcaccgcaacctctgcctcccgggttcaagcgattctcccgcctcagcctctcgaggaactgggaatataggcatgcgccaccatacctggctaattttgtatttttagaagagacggggtttctccatgttggtcaggccggtctcgaactcccatcctcaggtgatccacccaccttggcctcccaaagtgcgggcatgagccaccgtgcccggcctcagaggtcactttttttttggagactgtcttgctctgtcgcccaggctggagggcagtggcgcaattttggctcactgcaagctccgcctcccgggttcacgccattctcctgcctcagcgtcctgagtagctgggactacaggcgcccgccacctcgccgggctaattttttttatttttagtagagatggggtttcaccatgttagccaggatggtctcaatctcctgacctcgtgatccgcccaccttggcctcctaaagtgctgggattacaggtgtgagccaccgtgcccggccgctcacttttaagagtaagagggggtggggcacgatggctcacgcctgtagtcccagcactttgggaggccaaggcgggtggttcacttgaggtcaggagttcaagaccagcctggccaacatggtgaaaccccgtctctactaaaaacacaaaaattagccaggcatggtggcagacgcctgtaatcccagctacttgggaggctgaggcaggagaattacttgaacccgggaagcagaggttgtggtgacctgagattgtgccactgcactctagccagggcaacagagcaagactcggtctcaaaaaaaaaaaaaaaaagagtaagagaggcctgtcgtggtgaacactctgccaaggaggtgggcggtgggcagtgcatcctccagggactgactgagtcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtaggtgccgtctgtagagaggtggtcaggtgacaaggtgccttcctgcccctcgctgtttccttactgggttcctacaaaagctctatgcccctcaggcccagacattctttcagggacaagtgcagcaagaagtctgtatcttcccgaccgccaggctctcatttccagctcgtggtagggagggagtcgccaccacctggtcattctgtccttcaaggtgcagattacaaggcagcagccagcaggagcagtgcagaccttgttgcaatctgaggtggtggggcctcagggcagctgcttcctagggtaccctttctcagctactcgagaacaaaaggagacattcctgaatgctgcgttcccacagtagtgcacacataacagaaagcgaagttacagcctgttggaaaaggtaactgtagctgtcgtttcaagtaatggatacaaataagaagattatttaattaaaggaacagaatttcttatcatcatgatgacaaagctgaggagtgtctcgactgggttttcatcaggtatatgtaattatgtaagacaacagaattgtgttttgtccagaaagtttaatttttttttttttttttgagacagagtctcactctgttgcccaggctggagtgcaatgccacaatctcggctcactgcaacctctgcctcccgggttcaagcaattctcctgcctcagcttcccaagaagctgggattacaggcgtgtgccaccacacctggctaattttttgtatttttagtagagacggagtttcaccctgttggccatcctggtttcaaactcctgacctcaggtgatccaaccacctcagcctcccaaattgctggaattacaggcgtaagctaccgtgcctggcctgaaagtttgatttttaaggtctagaggagaggctgggcatgatggcttacacctttaatcccagcactttgggaggctgaggcaggcagatcacttgaggtcaggagttcgagaccagccttgccaacatggcaaaaccccatctctactaaaaaatacaaaaattagcttggcatggtggtacacacctgtaatcccagctactcggcaggctgaggcaggagaattgcttgaaccgggcaggtggaggttgcagtgagccaagattgagctactgcactcccgcctgggtgacagagtgagactccgtctcaaaaaaaaaaaaaaaaaaaggcacctggaggagaaatatatgcttgatattctaaattactgtgttcagagttgggtcccatgggattttcccttactgagaagccttttatgtttagaatcttattgtggtattgatggtgggagaagtaatggaaacctctagacttcctgtttgagagaattacaatgaaatgcaggttgtgcttcatcttcagcggagaaggggcagctgtatataaaataggctgcaaatgctgtattgaaaaatgagaaccagagacctggcaccatgtctcacacctgtaatgctagcgttttgggaagccaaggcaggaggatcacttgaggccagcagttcaataccatcctgggcaacacagcaagaccccatctctacaaaaaaatttttaagttagctggctgtgttggcacgcacctgtagtcccagctacttgggaggagtgagctgtgattgtgccactgtacttcagcctgggctacattgtgagatcctatctcaaaaaaaaaaaaaaaaaagaacctgaaggcatagcaaaacttaccttttctccacattcttcaggtttctccttctatagcaaaactcaccttttctccattctttaggtttctctgtcttgaatggctccgagttacttcttgtgagtttctcttacgtttctatacagaccaagtgttaaggaaagaaaaagctctcattgcctctctgacacttctagatgaaaaatgaaaagaacaaacccttgctgattagtctacttttatttgcagaaattaggtgctctttgcactagaactgtgtcagctaactttttctgtaaaggaccagatagtaaatattttagactcctagaggccataggtctctgttgcaactactgaactctggttgtggcaggaaagcaggcacagatgatgtaaacagatgaggtggctgtgttcccgtcaaactttatggacactcaaatttgaatttcatgtaattttcacttcatgaaataatagtctccttttaatttttttccagctatttaaaaacgtaaaagccgggtcaggtgcagaggctcacgcctgtaatcccagcactttgggaggctggggtgggcggatcacttgaggtcaggtggtcaagaccagcctgaccaacatggcaaaaccccgtctctattaaaaatacaaaaattcgccagcctggtggcaggtgcttgtaatcccagctactcgggagtctgaggcaggagaatcgcttgaacctgggaggtagaggttgcagtgagccgagatcgcaccactgcactccagcctgagtgacagagtgagactccatctcaataaataaataaataaaataaaaatgtaaaaccccgcccccctttttttttttttttttgagatggagtctctgtcacccaggctggagtgcagtggcacgatcttggcttactgcaagctctgcctcctgggttcacgcccttctcctgcctcagcctcccaagtagctgggactacaggcgcccgccaccatgcctggctaattttttttttttttttgtatcttttagtagagacagagtttcactgtgttagtcaggatggtctcgatctcctgacctcgtgatctgcccacctcggcctcccagagtgctgggattacaggcgtgagccactgcacctggcctttgttgttttttttttttatttaagctcacaggctgtacgggcataggcagtgtgtgccatagtttgccatccccttcccagcgtcggggaagaggcgggtaagttctagacatctcaaaggagaaagaaaaatattgtctgagcaatggatgattgtcttgaaagcttccagataattaggctaagacaagttgtttcatttatctgttcccctgcttagcttggtcggaatctagtggtgtgtctgctgctaacatttatgatgattcacttcagactcaaggagggctgttggcttatctgcactggctgtcttggaggctgatttgagaggttttgtttggagctatggaattcagtcatgcttcatcatgcctctggtttatttaaaaacaaacaaaaatactgttttcgccatggctgtggtcctacccacaacctgctcccagcatttgagtgctgtgtgggctgggtcattcctgcttccccaggtcacgctaaccaaggcaagttcttaacttctccccttgccagttttgtctttcctggacatctggtaataatatgctttggggtattttctgagccagattgttgcagcctaatgttcatggataagttcataatcaggagttaaaagataattcatttcctggtggagcgtggtggcttatgcctgtaatcccagcattttgggagactgaggcaggaggatcacttgagcccaggagttcaagaccagcttgggcaacataatgagacccgcatcccagctctatttaaaaaataaagaagaagataattcatttccttaagctgcccttacactattagtcaggaatgtttgtgttcacttccactacataccttacgatctcttttgctttgctttttttcagtcaagtctctatttatgaggtggacaagcaagattgtcgcaaattttgcactactggcatcgatggagccatgacaatttgggatttcaaggtattttctacctaacagaacaaattttgtttgtgttaaaacttttttttttttttttaagagataggctccttctctgtcacccaggttggagtaagtggcacaatcatggctcactgcagccaccaactccttgcctccagcagccctcccacctcagcctcccaagctgctgggacagcaggcatgcaccaccatgctccgtgaatatttttacaaaactcttatgagaagaatgtttctcatttcttgaaacaaaatgttaaatctagtatacagtttaatgtcctaatgtaagacattaaactggaaatctctcatttttttttctttctttttgagatggagtcttgttctgtcacccaggctgcagtgcagcggtgcaatattggctcactgcaacctccgcctcccgggttggagcgattctcctgcctcagtctcccaagtagttgggattacaggagcacactacaacacccggctatgttttgtatttttagtacagacggggtttcaccatgttggccaagctggtcttgaactcctggcctcatgtgatctgcccaccttggcctcccaaagtggtgggattacaggcgtgagccaccatgccagccttggagatctctctctttttttttttttttttttttgagacagagtttcgctcttgttgcccaggctggagtgcaatggcagaatctcggctcaccacaacctccgcctctggggttcaagcgattctcctgcctcagcctcccaagtagctgggattacagacatgtgccaccacgcccagctaattttgtgtttttagtagagatggggtttctccacgttggacatgctggtctcgaactcccaacctcaggtgatccacccgcctcagcctccccaagtgccaggattacaggcgtgagccactgcgcccagccagagatctctttaaaacctaaaagtcatccgcagaagaacggcacattctcagtgaactggaatttttacttctagatgtccatttattcattgaggaaaaatggagtgctgttttggaaacaggccctattggacaccagcccaggtttaactatatagatatatatttatagctgacactaattaatttaataaacatttagtacatatctcctgggtgccatgcatgatgctgagcactgagaatatccaatctgaatgagcctgtctggtagaagagagaggtggatacgggggctgggtaggggattcggcagagctcagaagagaagccagtgcctctgttttcacacagaggaatctagggggatgcgtggactgcagggaacaggttgcacctgagcggcatcctgagttgcgatgggttttggagggagggactgtgagttgagaagacacaggcgagcatcctcggctgcaagtgcagcacacccagggcagccctgggcttcagagagcgcacactgcctctgaggcgctgcccgtgctgtggtcctccggaagcacagatggagctagaaaaaagagctctaggtagccaggcgcagtggctcatgcctgtcttcccagcactttgggaggccgaggtgggagaatcgcttgaggccaggagttttgagaccagtttgggcaacatagcgtgaccccatctctataaaaaagccaggtgcagccaggcgcactgacccactcctgtaatcccagcactttgggaagctgaggctcgtttctcctcactgctttcctgtcttgagcacaggagttcgagaccagcctgggcaacacagtgagatcctgtctctatttaaaaatatacatatatatatttttaaaaaccaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaagaggagtgaggagtgtgcccagagcctgtgtgtgtggcagtggggaaaaggcacacctggcctggaggagccagcagggggagccccggcctggagtgtctctgcggggtgagtcctgggagatcctgtttcaggtggggcagggccaggttcagggtggggacaggcagaaccttccctgaggaagagggagtggtgtcatacctacctcggggtagacactcctcagtgacatcagtgctcttcccaccttttccaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtggttttggttttgtttccttgtagtatttcaatttttagtagaaaaatatgagcgaattcttcattcgattcagttttttttaggcaaaatcttagatccttggtttcttaaattgtaccattctatacaaccttgaaccaaaaagcaccatttagtgaggggtgagagagaaccgtttctgaacattgcaatacttctgcaaagtaggttgtgtcggtctgttttgtgttgcaataaaggaatacctgaggctgggtaatttgtttaagaaaaaagatttatttggcacacggttctgccggttggacaagaagcatggtgcctgcgtctgcttttggggaagcctcaggaaggttttactcatggcagaaggcgaaggggaagcaggcgtgtcccatggcgggagaggatgcaagagagagtggggaggaccaggctccttgaaacaaccaggtcatagagtgagaacacactcattcctgccagggggcaccaagccattcatgagggatccgccccatgacccaaacaccgcccaccaggccccaccccaacactgaggatcgcatttcagcgtgagatttggaagggacacacagccaagccctgtcagaggtacaccgttcccgtcttgcatgtgagcaacagagaagcccacctccactgagcagccaagcccgaatgggagcctgccctgggaggccctggggcccggtgcccacagcatggcagcccactgttagcagtgcacctgccaagggtacgctgtggggggtgtgcaagggggcgggaaaggggaaagtcagcatcttggcttagagttgattgtgcctacactgagctactttcatcatgatgagacgtaaagtttgacattccatggcagagaatcttaagaggtacaagtataaatgaaaagcaaaataagtaaagagtagccggagcctggccacatccttgatctcacggctcccttctagaatgctggtaacagtgcttcccaaggcacatcatgatgtgctcgagagaaggtaatttggccctcttgtgactcatgggaagagccctcactccaagagggaatcctacctagcaccaggggtgctggcctcatggccctgcctggtccctatagtgtcgtctctgggcccccagtggcaggagctcctttgtgtacacgtttgtatgcatagtgcattggcaaggctccgtgagggtagacaaaaactggccataaagcaggaattagctgaagatttctcttttagccggacgcggtggctcacgcctgtaatcccaacactttgggaggccgaggcgggcagatcacctgaggtccagagtttgagaccagcctgaccaacatggggaaaccccatccctattaaaaatacaaaattagccaggcatggtggtgcgtgcctgtaatcccagctacttgggaggctgaggcagcagaatcacttgaacccaggaggcagaggttgtggtgagccgagatcatgtcattgcactccagcctgggcaacaagagtggaattccgtctcaaaaaaaacaaacaaaaaattagccaggtgtagtggtgggtgcctgtaatcccagctactcaggaggctaaggcaggagaattgcttgaacccaggttgcagtgagctgaaatcatgccactgcactccagcctgggggatagagcaagacactgtctcaaaaaaaaaaaaagttcaggtgcggtggctcatgcctgtaatcccagcactttcggaggccgaggcaggtggatcacgaggtcaggagattgagaccatcctggctaacacagtgaaacccggtctctactaaaaatacaaaaaattagccaggcgtggtggcgggtgcctgtagtcccagctactcgggaggctgaggcaggagaatggcgtgaactcgggaggcggagcttgtagtgagccaagatcgcaccattgcactccagcctgggcaacagagcgagactacgtctcaaaaaaaaaaaaaaaaaaacctacaaaattgacttacttttgcctctaagaacttaatagccccagagttattttgctgtttttttttcttttttaaataaaaacattttgaaattataatagagacagggtctccctgtgttgcccaggctggtctcaaactgggcttaagcagtcctcttgcctcagcctcccaaagtgctgggatcataggcgtgatccactgtacccggcctattttgccttttttttttttttttttaagatggagcgtctttctctgtcaaccaggctagagtgcagtggcatgatctcgactgactgcagcctctaccttccaggttcaagtgattctcatatttcagcctcctgagtagctgggatcacaggtgaccccagtctccgagtagctgggattacaggcgtataccaccacgcctggctaatttattttgccattttttaacacaggccatttctcatgtggggaggaaggcccactccagtcaccgcagccagaagccctcagtgctttatttcaacgctggggccttttgagtttgtgacgctccgtccttctctcactctacctttgagactcagaccaggcctctgtcaacaatgactacagtctgggatgttctgagagggttcttcaggaaaggtgtgtgagccacgccctgaatgcaatactttagctaactatgcaggcaccaagaaaagcatttggaagccattaactacccctcataacaaacctgtagggttggaactgttattagcacatttttcagatggcaaaattccagagaggggaatgagcagtctctccaaagccctggtagtaaccactaagcatgtgctccccactgggcgagggaaataccttagtggcagccccttttcagctcacccacgctcaggggcagggccctgtcactggaactgatgagaagttatttgaggccgggcgcggtggctcatgcctgtaatcccagcactttaggagaccaagacgggtggatcccttgaggtcaggagttcaagcccagcctagccaacatggtgaaacccccttctctactacaaatacaaaaattagccaggcatttggtggcacgcgcctgtaatcccagctacttgggaggctgaagcacgagaattgcttgaacaattgctgggaggcacaggttacagtgagccaagatcgccactgcactccagcctgggcaacagcgagactccatctcgaaaaaagaaaaaaaaaaagagagagagcaagaaggtatttgacaatagcttgtgggtttcattgtagacctcggtttgtcaaactgacacatcaggccatgtggcttggaagggggctgtgatgggatgtggaatgctgagcgagtgttatgggggccccagctgtggggtacatctgccttgcaggcctttagccaccttaccagatatgtggccttggggctttggccccaaggttttatcctctcccctcctgctgtcagttgggatggatcccttgatcccagggaaagtgacccacattctggggtggaccagtgggacaaaggggagattatactggatactgggagctcttagaaaaggtccctgccaccgccccccctccatctcccatctccctggtctgccttggcccacccactgcttgtctgcagtcaacctagctgccattttgtgaccaggaggcaataaaactggtgcttgaagctgggaggcagaggttgtagtgagccgagattgtgccactgcactccagcgagactccatctcaaaaaaaaaaaaaaaaaaatagcgacaggcaaggggcagaaagccagcaagaacctgggagactgcaccagccctggcctgcctcccccacgtcggccagccctggagagtcacagcctgggtttgtggctgcatttcttggaaacatgagaaggcaataaaggaagcaggagtgtgtagcatcttcgtcccagggccctgcacaaagccaattctaggaagaaacagaaagctctccaagttgttctgggagctccagatgaaatccttccatcaccaagttccctaacccaaagtgtttctccacgtacggcttagaaaactttctcccccaaaggagccatttcaaataatgccttccattgctttccaatctgaggtctgctttctcccatccactgggtcttccctccacgactgaaggcctgtgggacgggtgggcaggtggacagtgcttgtcagcttcactttacagatgtggaaactaaggcacggttacactacaggttaagtggcagcaccagaactggacccactttctttcttatttttccttttttgagatgaagtctcgctccatcacccaggctggaatgtagcctggttacagtgatctcgactcactgcaacctctgcctcccgagttcaagtgattctcctgcctcagcctccagaggaggtgggattacaggtgtgcgccaccatgcccagctaattttttttgtatttttagtagagacggggtttcaccatgttggccaggctggtctggaactcctgacctcaagtgatctgcctgcctcagcctcctaaactgctgggattacaagcgtgagccactgcgcccaacctttttttgggggggatggagtcttgctctgttatcggctcactgcaacctccaccaccctcattcaagagattctcctgcctcagcctcctgagtagcaagtagctgggactacaggcatgtgccaccacacccaactaatttttgtatttttgttttgttttgttttgttttgttcttcgagacggtctcactctgtcacccagactggagggcaatggcgtggtctcggctcactgcaacctccacctcccaggttcaagcgattttcctgcctcagcctcccaagtagctaggattacaggcatgtgccaccacacccagctaatttttgtatttttagtagagagagggtttcactatgttggcctgacctcgaactcctgacctcgtgatccgcccgcctcggcctcccaaagtgctgggattacaggcgtgagccactgcacccaggctttttttttttttattagaaatgggttttcaccatgttagtcaggctggtctcaccctcctgaccttttgtgatcagcctgcctccgcttcccatagtgctgggattacaggcgtgagccaccatacccggcctggactcagttttctaccactggatcattcattaacacatctgttaagatgtgtgttgagtgactcaggcaccgggctctgtcatgggcccaggggagagaagagggaacagtacagccatggctgcggctcgcataggcttttagagcctttacatcaactcaggtgaccttagtttacattttcgcagataggaaaaaggagtcttgaggtatgcatatttgttaggatgctttgatgattcgcagcagaaaaactcaaagcagcctaaaaataaagtggaggctgcacaccgtggctcacgtctgtaaccccagcactttgggaggctgaggcaggaggatttcttgaggcaaggagttcgagaccagcctgggtcacacagggagagccctgtccatacaaaaattttaaaaattagctgggtgtagtggcgcatgcctgtggtccctcccagctacgagagaggctgaggtgggagaatcacttgaggccaggagtttgataccaacctgcacaacatagcaaaaacactatccttataaaaatttttttttttttttgagaaggagtctcgctctttcatccaggctggagtgcagtggcgtgatcttgactcactgcaatctccgcctcctgggttcaagtgattttcctgccttagcctctggagtagctgagattacaggcgcgcgccaccacgcccggctaagttttgtatttttagtagagacagggtttcaccatgttggtcaggctggtctcgaactcctgacctcaaacgatccgcctgccttggcttcccaaagtgttaggattacaggcatgagccaccgcacccagcctataaaaattttaaaaattagccaggtgtgatggtgcacacctgtagtcccaagtgctcgagaagctaaggcgggaggatcacttgagcccaggagctggaggcttcagtgagctgtgattgcgtcactacattccagcctgggtaaaagagggagaccctgtctctaaaacatattaattaattaagcggataacttggctcacatatctgaatctttggaggcaggttgggctcagaccttccagtcagaggtgaccagagctccggttacttctctgaccttctctcggctctgcactctccctgcagcttcccttgttgctgttccacttccgcgttccacttacgagtccagattcctgcagctcgctcagaaggggctttgtgcgctggatcatcagctgaagtcctgggctttgctttgattgggtcatcttaggtcacaagtgcagcaggacagggaacaccgtgagctgatttagaccactcagggccacttggggtcattccctgggcatctacaaagcggcagaagagtaggatggaagccagggaagcagcaacagggtcacctcagttaccctacacttgtccctgtgggaagagggctgccggtacagaccccttgaagctttgtatctgcttgaactaaaaccaccgcctgtgtttgctgaggttgccgacatctgtctgagaaaatacgcaggagcagcaaggttgggggggctcagaaaagttcgagcacttccgtgtgcacactgtatgacccgattcacacacctggacacatttaatcctcccaactaccctagggggtcgaattcagtggaaaagagagcggcggctaagggcacctccaatggggagggtgtcggggcaaagcgacctgagacccccagccacatactgcaggacaaaccaatgtcggcaggtgaggacagggtgggaatagtgttccaggcagaaggaacagcgagtgtcaaagcctctaagcctgacagggtgggagtctggcctcggatctccagagatccaggaagaccctgcacaaatactagagagaggggtctgaaggagagaagaggagggaaggtttttgttgttgtttgagaggaagtctcgctctgtcgcccaggctggagtgtaatggcgcgatctcggctcactgcagcctctgcccccggggttcaagcgattcttctacctcagcctcccgagtagctgggattacaggcatgcgccaccacgcctggctaatttttgtattgtttagtagagacgaggtttcaccgtgatagccaggatggtctcgatctgagctcgtgatcctcccgcctcggcctcccaaagtgctgagattacaggcgtgagccaccgcgaccgtgccgaggtaaggttttcactggggtctcttccatctgcctggccgccaggccacgtatccactgaagaggcagagggtcaggatgggaagactccggggaccacctagcccaagacccgcaatcaggcggctgcaaggctaaccgggtaacttaaagaagtgaagccgattgacgtaaaacagaaaggaaagaagttaactggccggccagcgtcagcaggggcggccagtgtcagccctgcccggggacagcacccctgtttcgtggcgaggacacggagggccaagggggcggggccgggctgccctggccacgcccggaccgcctgctccccgcccagggcctgcacagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggtaaagcattgacggtggttgcggacggcttctgcggacagagccttgggctccgacgtctgcgcgggtaccggcagcacccccaccccgaagggagggcgggacctggatctcgcgaccgctgccccaggtccccgcccccgggccctaccgggctgaggtcggcaggccccgccccccgcccacgaggaagtggctgctgctccggcgcggagcccagagccggttcggcgcgtcgactgcccagagtccgcggccggggcgcgggaggtgagggccgtgggggcgcccggaggtgggggtcaggggagccacctggaggtgggggggcgcgtagatgtggggcgccgcctgggagtgagcgggactggagggatgagagggggtgcaaggaggggaccggggggcgcctggaagtgaggacgcatagatgtggggcgccgcccaataggggcacggggatgagtgggggcacatggagaggagggggcgcggggacgaggggctcacggaaaggagagggagccctgggattggagggggcgcgggggtggccgcagggccagactgtggaaacgcgggctcccagcgcaccgggcgccctcggggcgtccccagcccccggccccaagcttccgcctcgtgccttccgcccctgctccccggcccccatccccagccttgccccgcggtcggtcggtgtagccccgttacttcgggccggcggggccccacacccagtcacttcccctccatccccggagccttccgggttgcagccgccgggaaatgagctggcgtctcctgccgccccgcccctgccctcctggccgctcccgctgctcccacccgcctcccccgggccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggctcacacatagaatcctagcattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccgacatggtgaaaccctgtctctactaaaaatacaaaaattacccaggcatggtggcacgcacctgtaatcccagctactcaggaggctgaggcaggagaattgcttgaacccgggaggcagaggttgcagtgagccgagatcacgccattgcactccagcctgggcaacagagcaagactccgtctcaaaaaaaaaaaaaaaagccacgtaacatgcctgtaatcccagctacttaggagg

SEQ ID NO: 701 - DNA, 1278 bp, Homo sapiens
atctgtcagccgctccctctgggcttccgtcctccgcccgcgcccgacggagcctgttcgcgtcgactgcccagagtccgcgaatcctccgctccgagcccgtccggactcccccgatcccagcagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtga

SEQ ID NO: 702 - protein, 370 aa, Homo sapiens
MSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 703 - DNA, 23871 bp, Mus musculus
  misc_feature (1)...(23871): n = A,T,C or G
gaaaagtacccaatgaggatggagagtttcagtgcagggctcgtcctctgggagttttcacaaagcaggtccctggatcttggatatgcacatgccactgccacacagacttttcttttataatgtcccccccagagtactttacattcaggggatgagacacaaaaagatgtcagcagttaccaagtgtatgaacgtgaaatgctagagatccagagggtgcttacagactgacttaaatgaccttttatataactacataaaggccactttcttgtttaaaagatctatttgatgtgtgtgtgnnnnnnnnnnnnnnnnnnnncactgataccagaagagggactctgattccctttagttacagatagttgagcacacaatacaggtgctgggagccgaattctctccttctggaattatatagcaagtgtgtccttaattactgagccatttctccaaccctgccccaaggctttctaggtttttttttttaagtccaaactataatccacaaacatagaacaaccttgctggagtgtgtggggggatcctggaaggtcctttgaggatgagtctcaagactggaaacagaacaaaagctccaggtgtctttcctgcctgagactcctgtgcctgccccactggggtcttggaagctttcctcgagttatcaccaaatcagtatctcaccctgggcaccagcagcagcagcagcgtctaaaaatcaaccagacacaaagggcaagagagttcctaacccttgatttagcatgaagtgacatttacagacttcacttacagtctcctttttctgcgagatggtcagctcctaacttgagaaacaggtattgcctcaaaggacctgagtttggctgcactcattgtgaaatgggcactcttggttttcatactaagtgtgttaactctcacaattctgtttgaaactgcaatccaccagggcttaagagaaaggggttcatctcctgtgatagccacacaagggcttgcagacctcaattcagatgggaagagcaaacttatttcagacgtaaagaagtaaatgatcagggaggctgatggcagtgaattagttttgttgaagaaacatctgggcaggaagggcagggaatgtaatgccagttacgcacatagggccgaccctctgatctgaacatacaatataatactttactcttcagctgttccacactagcttctgtatgagttggaagcgtcctcacagtatgggctgatagttagacaccactttgaaaccacatcactgaagatagatccagccggcttccaaaccaatttaaacagtacgtgctcaaagtctgatacttatgtgataaagggaaaaaaagatgcatgtaaaacaagatttgtcttcaaagttgccacaatttttcttcccacttggttgcattttttcctattgttacatacacatttcttcaaaaggcaaatctatttaactaggatgtaggttagcctccctccttccttcttttccctgtctctcccttccttccttccttccctccctcccttcctccctcccttccgtccttccttcctttttctctctcgttttgttttgtgtgttggtttgtgttctgagactgaatcacaccgtgtagcccagaaaagtttcaaagttgcagaatctcctgccatggctggtggagtgctggggcctcaggctcaccctgtcataccccacatttgtttcatcattgtaacttgtatcatcattatatcgtcttttcctggaatctttgtggattctaatatgaatgctgacaatgaaactctccacgcttaaggattagaaccacatcaaatcattctattatgtttttaatagatatacataaagtatggccttaagaaaaaaaatggaaaagaaagatagaaaccatttactctgaaaggatgggctaaaactacagtatcaggaattaaaactacagttgagaaaagaccagacgatgttgcaataacatgtgacaatttctattttcaaattctatgtcacaactaaagatgcttataaaaacagaagtctttagccccataaaccttatggaggcagaagagttcagaggcaaagacatgcattctggatcattgtaaacaatgaggcttcacagatacccacggcatgcttaggtgcttagtgttggctgatttttatgatctgagttgaagatacactaatagcttgtccatcaatcccttctaacacacatacttcaggacatggctgtcatcctgaacccccaccatgctgcgcggctgcgctcacccagataaaggtcaaacaagtcacagtacatctcaggtgtttgtttgtttgtttgtttgttgttttgttttgtttttaattacagtgaggcttcataatagggtttccaaatgttcaaattcagaacctaccggataggcactattccactccatagtgaagaacacgttaagataggatcaacgtgtaattctctttttagcccagcagcattggtgtggcctctaaaaccccaagaaggaagttgccaatgttggaaggtctgctgctactggtccacagtactacctcttagactttgtctgtataaagggcagtactgatccccagtactacctcttaggctgtgtctgcataaagggcagtactgatccccagtactacctcttagactgtgtctgcataaagggcagtattgatccccagtactacctcttagactgtgtttgtataaagggcagtactgatccccagtactacctcttaggctgtgtctgcataaagggcagtactgatccccagtaccacctcttagactgtgtctgtataaagggcagtactgatccccagtactacctcttagactgtgtctgtataaagggcagtttccagcctctggatgagcagtttcaggggatactgcctgcatttcacaagctgatttggttactttgttttggggaaattgagaatgtgtgtacttttcagttacttagtttagttactatcatttgtgttagaaatgttttaaataaggcaaaagtataagacatgcgtgaagagctaaatggctttgttttctttttggttgcagcctagggttccatccatgttggtcaacatttcactactgagctatatccccagcccaaattctcttgtttactcttttatgaatatgtggagtcataggacatacagatgggaattctgtatccaggaattaaaagacaccagttgagttccctcttgaccaagaatcatatacttataacatctacatttcagaggatggaattttaaatttcctctgaatacgctaagggccatgtgtcagggtgagcacaacaatgtgacactttttttgttttttgttttagagctttattgaagagagggggggggggggctggccacggccacgtggcaaagaaggggagaagggagagggaaaaggagagctagagatgagagtaagaaaggtgagagcttaagagaatgtgacactcttatgagtttactgtttctgatgcatttttaagatttatttttatatgcatgtgtgaacgtcctctgcacatatctacgtgcactacatgcctgtctgatgctttgaggtcagaaggtgttatatccctaggaacttgagttacaggtagttgtaaacctcctgtagttgctgagaactgaactcaagtcctctgcaagagcagaaagtgcccttaaccactgagtagtctctccacgcctggtattttattttttaatatttagtttatctctgtgtgtgtgtgtgtgtgtgtgtgtgtgtgtgtgtgtgtctgtctgagtgaatgtcacgtgtatttgagtgccttcagaggttagaagaggcattggattccccagagctgtgtagacagttgtgaaccatctgtcatggccctttggaaaagcagaaggtgctattaaccactgaaccatctctccagacccaactactgttactgatactgtatgccagcttttgttgtaaaggcagaatcccaaggatgtgattggcaggacacacatcaatcaagcctttgggatccttccttctaggcaaataatagctctctctaaacagaccactgatcttcctattgccattatattgcagcataaaatagaatccaacatggtctaaactgagaccaagtaatcaaaagaaaaaaaaaaaggttgcatattcagaatgagctaagaagtcattagcacacaattctaactattttactcagaaacaccgatacacacttgtgactgacacttgtcattcatattattttctttcccactcatatttttttatttcattttgaaatttttctatgtgacactggcttattctacaaagcatctgaagttgaatagccagtgtagaggaaggttagctttggtgttatctagcaaggcatagcataatcctgagtttaagttcttgatttcttgtgctggtttgttttccgaaactttaaattgttgttagtagatattttgcaccctatggtgttgaatgtgctcatattcgttccacagttgctggtctgctcccaggccttgatcacgtccctcctcacctgttactctgtcctctgcaccgatgcgtctctcttacatcttaaatcacatttaactgccatccttcaggatctcagcaaagccgatgtacggtaggtgggaagtaatttcatgaaacaacccttcaggcaccagcagaggggcagctgtgctcactggacgccttagaaaaagacgtcgccagtgggtggcagtgtgggtaagagccagtcacatttcccgaggtagaaatccttaaggctgggttttaaaaacaaccttacaatacagactcgagaagcagcccgctaatggttgtaaggacatggcaggttttggagtgagaaacaatttcagcaaacattgggccacctggcaggaggcagctggctgtgtcagttacttctggagcccaggccaactgcttgctcctgatccacagcacagagcaaagagcataatttgaccttgctctccagaggctcagggacttgcagaaggtcactcccagctgtccctatttctccttcagaaaacatagctgtgtcacttcagagacattctttttttatttatttttatttttattttttcagagacattcttaatgtccctggcatccactgtgtggacccagaagcaggcagttcttactttatacgttatggtggttgtagcattcagtaagcctttattttagaaaaccatccttgagttagtgcctaggattatcaagactgttgaatcaacatttttttttttttgagacagggtttctctgtatatccctggctgtcctggaactcactctgtggaccaggctggcctcgaactcagaaatccacctgcctctgcctcccgagtgctgggattaaaggcgtgcgccaccacgcccggcgaatcaacatttttaatggacagaatgaatactaaggtggaaagctattacagtgtctaatgaaataatacaatcaatgtatacacattcacataagctctttttcttccttccttccttcctttcttccttccttccttcctttctttctttcctttttttccttccttccttccttccttccttccttccttccttcctttctttctttctttctttctttctttctttctttctttctttctttnnnnnnnnnnnnnnnnnnnnnnnnnnnnnnnnnnnnnnctcctcctccttcttctcctcttttgtttgtttcatttttgagacaaggtctcactaagagacatgactgggctgtgagtagactaggctgaccttgaacttaatagagcttcacctgtttttgcctgctgagtttttacacgttctgattgttgagctgttggcacttccaagcacagatactgagtgaggtagacaacagttacattcttgccgagaagttatcctgttgcaaacacagagttcacatattacaaaattcttgtgtaatttcagttgaaacatactagcaaagagatgcgagggggggctcattaaatgcagcaagtctccctattaatcctagatgggcaaaagtctgctcaaggttcattcatcagaaatgcaaatgttttgaatatacttgtgaactaagttactgaggtcagtgtaacagggccaactatgccatcctttctaaaggggaaacagacttgccaacataaactattgttaggcttcctggaacacattttaagtgagggctgttcacactggccatgtagcagtccacttgacaatttgcttagtcagctttcaaagttgacttagacataaaattctgtcagacacattatgcatgaagaattaaagaaaaactttaaaactatatacttttctcctatactagcctttctacatgaaaaaaaatctatgattcattttggtaatagtatttatatcatgaattttaaatgcattttacctatttatacaattaagaacttaatgaaaatacttaacttattcctgaaaggctatctttaataaaagaagcaaaattacatgaatttttattaaaaataaaatcccatatcttccttggtaaacagccgtggcacacacctttaatcctagcattcaggaggcagaggcaggcagatctcagacctagaggctactctagtccacagagtgagttccaggacaggcagggctattcagagaaactctgtctcaaaacaatcaaaaaataaccaaacaaaaccttatggtcatttgtcagctgtgaaaggaaaagaaggattctaaggaaaagatcaaaaggcaggaggaaaagctgcagccaggctgtttattggcaacaggccaggtacatggcacccagtccccgtgagcacagcacgtggacagatgttaggagctgactagtactgaaaaagtatgagagaacagttggaaaatcccaagatacacaaccggcttccagtaaataagcagcttatctggcagcaggaaggagagaaagcaggttgctccgagggtgggcgctcgctctctaatagagtgggagcctctctgactttgcccttggagcttccagggcagaagaataacaagcaccttgttgtaaagagagaggcccgtcacctcgtcgagagcagatacgactgacagagctggtacctcccctgacccctcctgtgctgctagcttggtgactggggcagcacacaacaggtcacctgcttctgatccctggtaggcaacattaacacagccccaaggaaaacaaagctgctactggccaggctccactggacacagaacgtcagcactcaatgcattcctaaaaatctaattttgtattgagagtcagaataaaaaaagaaagcaaaaatggtgctttttttttttttttcaaagaaaagcatagggtactgacgctgtggcctcttgtcctgcgctatttcaggttacagaacacacaggctcatttatgtgtctcataaagtgggatgtaaattatcacaatcaataaaaatcgagccacattttcttcgagctccaagataaaaatcctgtcgtgttgttacgtttcttctggttagcgataatgcttggtgatagaggcggcataaaagccaacgaccacaagaccgtgnnnnnnnnnnnnnnnnnnnnacgtagagacgctaacagtggcatctactggtcctttatttttaaagagtataatttaaaatggaagacccaattcaacacacccttttgaggttaattttatgatgatatttactaatggatggttttccccaggcttttgctattcatcaataatcataatcatagccgcatacaagctaaaaacagagcaggtccaatatcggcttgggttatcttggcacaaattcatcattagggtgtttaaggcacagtttacacaaagggtaaagcatctatggtcttcagaatcacactgtgcaattatttttcttaaacatgtcattgtaattgctacaatgatttgtaaattatgcagggcattccaccgcgaacttccaggactcagaacaaaataaccaaggttaaattgtaagataaactctggtcctgaattgtttcatttagatactttctccctagatgggcaagggtttgttttgtttacgcatccagagcagggttccaagcccgccttccgtgagcgcggaccattgcccttcctagcggccctcacgctgtcagttaggagagaagacatgcaggtgcttatttgccctcgactttgaaagtcacaaaggccacgtagatagagaaattcaaagcagcagttcaagggcatctttggcttggcgctgtgcccgcggccgcgctcctaggttcggcgacgcccgcccatagcccgggtgctgggtgaacacggtttggggcgcgggccgggagcggtgagggcgcggggcgtggggaggacgcccgccagcactcgctcccagctccccgctcccgcccaggcccgccctttcccggcactatggaaaccgcattttcctacgccagcacgccctcctcctctctcctattacatccagaacaggcgacttccacttcccgggaacctgacaagtgaatggatctgatgacgccccggaaagagcccacggccgggggcggacgcctgcggagggtggggcgggttccggggcgcccctcgatcggctcgccgccgggaaaaggcaccgagctgccatcgacccggagctcgcgggcaacgatgctcgtaaacaagccgggccgcgcgcctgccacccacagcgggcaccgccctgcgccgcgcgcccaccccggctgctggggtccgaccgccgccccgcaccagatccgacctcccgcccccgttccccctccgcggcggaagcctggggccagttagtgggacgcgaggcgggagcacaaaccccgcacccgccttctccacggcgggcttcccgccttgggtggcatcgcccccgcccgcatccacaacgagcccctgattaatgagcccggcccggcccccgccgagccccggcccggcctcggagagggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcaagcagaagcacggccacaagcgctttttcgtgttgcgcggccccggcacgggcggcgacgaggcatccgcggctggggggtcgccgccgcagcctccgcggctggagtactacgagagcgagaagaagtggaggagcaaggcgggcgcgccgaagcgagtgatcgcgctcgactgctgtctgaacatcaacaagcgcgcggacgccaagcacaagtacctgatcgccctctacaccaaggacgagtacttcgctgtagcggcggagaacgagcaggagcaggagggctggtaccgcgcactcaccgacttggtcagcgaaggccgctctggcgaggggggctcgggcaccaccggaggctcttgcagcgcctctctcccgggcgtcctgggcggctcagcgggcgccgctggctgcgatgacaactacgggctcgtgacacccgccacggccgtctaccgcgaggtgtggcaggtgaacctgaaacctaagggactgggccagagcaagaacctgactggtgtataccgcctatgcctgtctgcgcgcaccatcggcttcgtgaagctcaattgcgaacagccgtcggtgacgctgcagcttatgaacattcgccgctgcggccactcggacagcttcttcttcatcgaggtgggccgttcggccgtcaccggtcccggggagctgtggatgcaagccgacgactcggtggtggcgcagaacatccatgagaccatcctagaagctatgaaggcactcaaagagctctttcgagttccggcctcgcagcaagagtcagtcgtccgggtcgtcagccacgcatcccattcagcgtgccgggcgcgcgccgccaccaccacctagtcaacctaccccctagccagaccggcctggtgcgccgctcgcgcactgacagcctggcggccacccccccagcagccaagtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtcctccagcagtgggcacggctcgggctcctacccgctgccacctggctcccacccgcacctgcctcatccactgcatcacccccaaggccagcgtccgtccagcggtagtgcctccgcctcgggctcccccagcgacccgggtttcatgtcccttgacgagtatggctccagccctggcgacctgagagccttcagtagccacaggagcaacacacccgagtcaatagcggagaccccgccagccagagatggcagtgggggcgaactctatgggtacatgagcatggatagacccctgagccactgtggccgcccttaccgtagggtctcaggggatggggcccaggacctggatagaggactgaggaagaggacttattccctaaccacgcctgccaggcagcggcaggtacctcagccttcctctgcctctctagatgaatacactctcatgagggccaccttctctggtagttcaggtcgcctctgcccatccttccctgcgtcctctcccaaagtggcctacaacccttacccagaggactatggagacattgagattggttctcacaagagttccagcagtaacctgggggcagatgatggctacatgcccatgacccctggggcagcccttaggagtggtggtcccaatagctgcaagagcgatgactacatgcccatgagccccacaagcgtgtctgctcccaagcagatcctgcagccacgcttggcagcggccttgcccccttccggagcagccgtgccagcacccccttcaggggtgggcaggaccttcccagtaaacggaggtggctacaaagccagctccccagcggagagctccccagaagacagtgggtacatgcgaatgtggtgtggctccaagctgtctatggagaacccagaccctaagctactccccaacggggactacctcaacatgtcccccagcgaggcaggcactgcagggaccccacctgacttctcagcagctttgcgtggaggcagtgaaggcctcaaaggcatcccgggccactgctacagctctttgccccgctcttataaggctccctgttcctgcagcggagacaatgaccagtatgtgctcatgagctcccctgtgggccggatcttggaagaggagagactggagccccaggccaccccaggggctggcacctttggggcagctggtggtagtcatacccagcctcatcactcagcagtgccttcctccatgaggccgagtgccatcggtggccgccctgagggcttcctgggccagcgatgtcgggcagtgcggcctacacgcctatcgctagagggactgcagacccttcccagcatgcaagagtaccctctacccacagagcccaagagccctggcgagtacatcaacattgactttggtgaggcaggtacccgtctgtctccgcctgcccccccactactggcatccgcggcctcatcttcttcactgctctcagctagtagtcctgcttcatccctgggttcaggaaccccaggcaccagcagcgacagccggcagcgctctccactctctgactatatgaacctggacttcagttctcccaagtcccccaagcctagcacccgcagtggggacacagtaggctccatggatggccttctctctccagaggcttcatccccatacccaccactgcccccacgtccttccacttccccttcctccttacagcagcctctgccacctgccccgggagacctataccgcctgcctccagcatcagctgccacttcccagggtcccactgctggctcctcaatgtcctccgagcctggggataatggtgactataccgagatggcctttggtgtggctgcaaccccgccacaacctatcgtggcacctccaaagccagaaggtgcccgagtggccagtcccacatcgggcttgaagcggctaagtctcatggatcaggtatctggggtggaggctttccttcaagtcagccagccccctgacccccaccggggtgctaaggtcatccgtgcagacccacaggggggacgtcgtcgccacagttcagagaccttttcctctaccaccaccgtcaccccagtgtccccatcctttgcccacaattccaagcgccacaattcggcctctgtggaaaatgtctcactcaggaaaagcagtgaaggcagcagtaccctgggaggaggtgatgagccgcccacatccccaggacaggcacagcccttggtggctgtgcccccagtgccacaggctaggccgtggaaccccggtcagcccggagctttgattggctgtcctggaggcagcagttctcccatgcgcagagagacctccgtgggtttccagaacggcctcaactatatcgccatcgatgtgagaggcgagcaggggtccttggcgcagtctcagccgcagccaggagacaagaactcctggagccggacccgtagccttggggggctcctcggcaccgtcggaggctctggcgccagcggagtgtgtgggggtccaggcactggagctttgccctctgccagcacctatgcaagcatcgacttcctgtcccatcacttgaaggaagccacagtcgtgaaaggtgaggccctttgaccttgaggatgggggagggagagtggagtattgggtggctttggatgccactcttactagtgcttccttggcttaattgccaaccggctgcctgggccttctccctcttggctaccatgttgttattgtctttctccaaagagcttgtcaggaaagtggacttggcttttgagtagaattgatgtcttcccccatggttgggagactttgcctttgttttaggtccagtcccctcttctctgcgttcttatggtcctgccctaaccttctgtctcagtgtaggtgctacagagcggaaagttgtttagatctgtacagttgaagttgctcaaggcaccagctactggttctctgtgtgagtggctgggtcccaggtcgttgctgctcagacacaaggcttatttaaacatacctaagagcccctcagcaaagtaagcatgagtctccatggctgctcgcatgtagactgtgacaagcctgtccatcaggggtaccgtgcgtagttctcccaagggaaatggtagcagtgtggcttggcttacataccctgatggtagcggttctcacctgtgcataactgggagtttcctggagggtgtcctgtctgcagatactaggaaagtaaacctccagagctttccggcactacaggaccagaacctggcaaagtggcattgttaataagtccctgggtaacgctggggctgttgatttgggcacaccaggtagcagatccctggggaggtttgagaactccagagccattggaaaggtccttgcagggtgggtgaaggttggcatagggacaggatgggctctgcttcccggagcaccgcatacactaacagccgtgtttcaggatcagagattgaaagagactgtgaaagatgaatgtacggtctttttcaggaacagtgggtctagagggtgcccggcagtgccccccccccacccccgctctccccttatcaaatatccatgagcacaggcagctggtaaaacttcctgtatctcagacatggctgggtatgcaggggggacaagggagctggagtgctcaattctgttcctgtctgtgtttctacatggggttgctagcaggacagacagactgtgtgccatagtggagccagtgttgtggtctgggtctcaaagggacctgtatacttttggttcttaagtaagcaggccagttgaatgctatctacattgaggctgtgtgtatatttgaggccatcaactcattggatccaggtttacagcttgggacaaatcctggcaaattgtggggtaatagatgaaaagctaattcttattattataattacgactggagcagaggaagaggagtatctaggaattaccagcagcaatacagcacttcaacagctaattaaatcaacgggaagttggcagaatgcgtcccttctgtggtgaatctctcagccgaaggtcgctttgtcaaggtcttactaaacagtacagatttctagtgctaggaagttgaggatagctacgccacaggccatataaacacagtagtgtgtgactgaatgggggaattctttctgtctgcctcacccacacacttagcaacttccatgtccctggtagaggagtaaacatgtccagttgaggctgggtgggtggtctcctactatgggaacgcagtctgaagtccacactgtgaagttcgaggcctgtgttatagtcactaccttcagaaaagggattccctggcacatcagaaagaatgctgacctgcaggagtcagtttgtttagacacctggctcatctactcctgcttaaggtttcccacacggatagagttcctaccagtctttggggttaacacgtgtgaaatctaaatggctctccatacaagcagacatgggagcaattaggttactgttattctgaattctgtgggttttatgttaaaaactcctttctaaaagggggtattttaaagggaaaacagataactaaaattcatctgctgtgccaaagccacatgtttaaggggaggcacagaagccaaattagatttctagcaaattgatttgagcagagtgcagcctcagagtggggggaagtgcgcatgcaatcttagcttgctgagctgggcccttgatgtctgatgggccaggatggacatctttttgtgcttagctcacgtgcaggtagacattggtgatgtgcacagattgaaagttcgctgcagagtggtgtacttgagagcatggtttgtagaagcatgagtttgaagctgaaatgcagaatgtcctctcagcttactaggctctgcccaggcttagccttgcccggtgcttccatcctgagctgttcacttatttgccttggtcagacctcattggttacacatgcacggaataattgagctcagtctgggtagtatgtagcagtacataaggtccatagacacagagtcctggcagtgtcccatagttgactgcagttgaaatggagatgggaagatagatttcttaaactcagctgatgaagaagctaataaacaccaagtctgcatgcctgtgatgaaagtctgattaatctggtagaattgctgtcttcttaggaactgaaaattaattgggttagctatttttaaaaattacttctgataagactatgcacatttttttcctcaataggactggattggtaaggtcccctggtttggttctccttcagaggggggttttcattccgtgggcttctaaagtgtaagaaggtgattagatagataagtactatggaaaacacctacatttagttttgtttgatcgaaagtctatccacacatccaatttctacaagattggagagtgagtgaggtgtgtgcaaaggagcttgatttagtctagaaagctctgcctttgcaagtgcttcattttcagagccagtgcagtagccttgcccagcctcttatctctctgtgggtgccacctgggcatggtgctgcgcagggtggctcccaccccctaaagaagcagcagctgaagtgctaaagaaagcactcgggctctggtgaatgaaagtcacgtggccagttctgcttcctttattgaaagaaaagcctttactgaagtagttgggagaaggaaggagggtggggccaggaagccaggcttctggttgctaatcttctccagagagccacatactcacgtttgcagcagttgattcccatccttcccttgctgggtcgcaaggaaaggagaaaaaaggtgccctaagcccgtacaggggaagtgctaagaaaacagcctctccctgctgtcaggaatgtgggcagtgaggatacttctgaaaataagcactcctaaattaaagattagtaaatacaagcctaaggaacaggcagtactgggagactggagaccatgccttctggacagcttaccttccctgccccattgttggctgtgttcctttctctaagaaccacacctcctttctttaagaatttagccaggtgggtagttcagccttagagcaatgagaggaaagcagcaaaacaaaacaggaaaagattcattctagaaagaaaaagaaagagagaaaaaagaaaagaaaaaaaaaaggaacaatgtagagattcaaattacatagtagcagaacaatgaaaaacagacctgctgtctgcctggcttcaaagcacactatctcccctctgtgatgtcttcaggtattaagatctgttgacaagatgaggatgtataattagaatatacattttagaaaaccgactcttaatgttggaagttctaatctaacagccgagcccttaagcttccgatgtttaattagccagcattctgctcattggggatttggttctgttgattgagtttactggagggtcactcctgaagttttgatttcagcactgtgctgtctgtctgtaggtaggaaagtgctggattcttgctcttcacccctcccccgcaaagagcaattttaatagcagtagctgggcataaaggcgttctgttagaatcctactaacagcttttctttggaagcatattctaagagctaggtaaatttgctatcagatttggcaagcaggccagctttttgttttgttttaggaggggggccttggatagtacagaattaaatgttctccgttcaccttggaaacaagggaaaatgtaactttattcgtgtatccacattgccaaatagggtgagggccactattactcagaggggagaggagccccagttgtggtagggatggactttctgtgagcatctctagaccagcatgaatagagtgtatggtttaatacaagatgtgccaagcattttaatgttgccattttagtgtacattttctgcatctccacagtgaatggctgcaaaggttctataccttatctagctatgggttttgtggcagcaatatataaacagagtcctctgtattcattttagtgttttgaatgcatcagtcaagactgcagggggaggaggtagttgaggtagatagcaaaaggtaagggggtagggtggttctggagggagatgctgatgtcagtggtggccactggtctttgagtgtcatttaggggtagtttcctaggctcaggccgagggtgccctgaagtaacacatgcagaagaaagctggactagacagggaggcaggcggcacacaggagctgtttgttaggtgcagaatgtgccagacgcttctgagcttggcagtcttacttcttaatttaattcattgtgttaaaatgctgaaatagagttggtttaaaatgtacaggcagtgtgcggatgataaagcagttcatttaataattgcattttcttttcctgttaaactagaaaaaaaaaaatactgctttacccagtcacagttacttgtccagaagacatgctgagaagagcaggcaatgccttaagccctgttcactttcttgtgtgtggcgtttatgcaatgatatttgcaaaatatttcttacttctagtgcatttactgaaactgggtcaaacatttggacccatgatatatcttaaagataaaccattacatgaacttggtaccaagccttttaagaagtattagattttccagaaatacatgtttagaactgatatttgtgtatatttttcccatactgttttttttccaaaacccatctttttacttctttctagttgagactaaatgctaacgtattttatgaatacattcagtctttatacagtcacttcaaaaaatattagtcctctactcttttatctataaagagttagcacaggtgatttaccatgatatttaagctttggtctttttgggtttttttttaatgcataaatgtaaactctatagttcatcctaggatacaattttcattatctcttcaaaagccatatgttggcattaggagtgactgcctttttgcatggtcatagtgcagtatttaatatttattactataacatgctttctctactcattctgtggacttaacttgggccatcttcagggatcagagtatgttattaacaatccagaaacgagccgaacacaagctgatgctgaaagaattccaatcatggtgcctgatgaaaaatgaaacaaatattctaagcaaaagctggaaggaaggagctgtcccagggcagaaggaggtgggattcaaagctgtctctttgtagcgctttatttctctaagtcatgtgacatgtatacattttgcaaagtctgcagaatcagcttttataggtatgaatgttttgcctgtatttatgtctgtacaccacatttgtgcgtgttgaccacagaggccagaagaaatcgtcagagcccatggagctgggtttccagagggttgttagctgctttgagggtgctgggaacccaatcctggttcttcagggacagcagcaagtgttgctcttcctccagcctcaggctccagtatttaaagtgcctgctggtcagaggggccaggtgacctatccaagggccttaagaaaagaggaggggtgctcgcggcctcttaggtcctgcctaacacaggctctttacgttgaagtatcagcatggacaaaagcactccctcagcatttcccactggccctgggcttcttgtcttgctcttgcagcagtgaatttccacccggtttcgtacttaggatattccgagtgaaatggaaacagttcaggaagaagaatggaagaaaggacattgtgagcagcccctcttccttaattattttagccagtttctgcctgtcaatttaagaacttcattgtgttcgtgtcccgcccacccacccccctctttgtataagtccccttttgtccatggatttccagacttatcttctggtaataacttgtggcccagccttgcccctggacctcatgaggtctcctgagtgaaaggtttcggttcctctggcagtctctaagtttcaggaaagaacacaggagatggcacttgatataaaatgttgcctccgcatacattaagcccattcagctccatgtgggaacagtatcaggtgcagagtaggatccagaagtgcattcgaggacacagagctggggaccgctgcctcaacagtgtgcctgcaggccgctcagatttaatttgggtagagcagttattaaataccatcaggagagcattggagatggtggtccagaggttggcacaccccgggtgatcatctgagtgctgtgcctgtatcctggggtcagctctctccgctggaacaactgaacatgtgcagcaggacccaccagtcccctccacagccaccccccaccagaccccacccacaccccacaccccactgttactctgtgtaaggaactgcttgggtgtagacaaagggtgtgtttgaggaagaaaagcaaagtgcctattgagaagatcactcacacaagaggcagaggagtgtgaggactgctgtaaggaagacattttttctaggctagttcattgtgaagcctgaggccgtctggcagtgctgaagctgacactcttcaagaacagagccagtcctgctgacctgtgatgcaggctgggttaagattcttacctctctgtgcctttgtcctattcgtggaacatcatacacccctcacagcctgttagcagcttccaaagaaatgagtcattaactgagttaatgatgaataggtttggaaactcaacctatttagagttagcctcaggaccagttcgtagatagtcagctgttgcagggtggttatcttcccaggaccaagtatcccatagggttgtcttattgttcttgaggtccttaaaagaggttgtggggaagattatgtagctggactttagcatggtgacaatgggtttcattcaaattgaactggacacaagctgctccttttggaggtagtgcgattatgaaagcaatacttaggcagactcaccaagcgttcattatatgctcacagttaaaacaacatgtggctggagcaggctgatagggacttccaatcatagtagaaccaaggcaacttctccaggttaaggagagagtagggttcaaagttcaccatcttgccatcatggatctgttgggaatattctagaaatggaatattctggagtggaaaagtgacctgagtgccctaacagaccaatcttggccactatgtctgttattgaagaagcaaaaagaggcaccatcctgaaagcattgagagggagaatgggtagagtagatgcatcttgggaccacgggtccatcctggggcactgacttgtgcattgagtttagagagaggaagaatttgggtgggcggaggtgctgtgtaactgagcagcccctggtgaggtgtggttcccttcatccttatctctgttctgggtcttcagggtggtccacagtgcttcttgctagaaaggacagctggctcctgcaggatggagtgccctagtgttcaggggtgattgtctttatggtggtggtggtgggggctgccttgggaggctctgttgttcctggaatcaaaactgacagtaagtctagaacagcaacttatctctgtgccttcagctttggagggggatgagatagattaggcagaatgaagcgggcctctgagccaacatctctctctctctctctctctctctctctctctctctcacacacacacacacacacacacacacacatacacacacacacacacacacacacacacacacatacacgggtggggtggctaacacatcaggcttttgccccctttttagttactttgtgggcccatatgagaagccaatgctttttcaccaaagtagtttctggacgtatttaattaagaagttagttgtaaaacccagaaaccccactttctggtgtgctgggaaggccctcttgctatcacatagaagtcttttccaagtatggtgtgtgtggatttcccctagcaaggcttgtgcctccctgcaattgagtgcattccaggaagctgcttgtcactactgtgaccctgctgtcctacgccttcctagtgagagaagcagagcaaagctcctctctcctccccccagagttaggccaccctgggctactgccctgccttctgtcctgctctggatcttagctacccctggcagataaggatggtgaagtgggtgggaggtcatagaaatagcctgagatgacttcactaaaatttaaaagtttgcaaataacggtttggaggcttggaacttcaagcaggactcgccacggagtggattagagatctctgctgagtgctggtttttgtgtgacaaggacagaaaaggtctaagtaggactgtgtggtactgagcaggtatggcagactcctaagcctcagtcctcagaaacacctggaaaggaggctctagtggtcactttggatgctgttccagatgtggagatctggcttgcttgggaagttccttctgtgagtgagggctgaggctgaggctgagactgaagctggccagtgagagagcacagtgaagctggccagtgagagtgcataggagatcgggaatcttccggtctgtcagtgtgcagaacacatgtggcagatgtctccagccaacaacatgcctggttttagaagctccatgatgtttggagccagttcagcctcgctctgctaaatcacattttaacaagttactatagaggcaatggccttagagaactgtctgtcctgacaaactaggagtgcggagattcgtccttccatgcctcacctccatggctcgtttctccttctggaagtcaaagcacaacttgctgctttccgagggaaattgaggaaaagttattttccaagatttcgtgtagaccatgattcacatgtgtgtacacagaaaattcatcatagctagatagtcttctaagatggtgttctgagggcattctccatccctctcttcatggtttattgtcctctgaccatgaaattcggaccctttctctgcacaccttccttctgagtggccacacccagttgctgctggccttcccctcccattcccctcccagctactgcagagggcttgggaacaggcagaagttcacaggatgtctgctggcttcctggttgatctatagatctctgcccctgggcctgaatgacaagagcaggtgatatgtccttgctttgggtctagctgtgcaggggggttgggagggccaggggagagtggctttgtctaatgtcctcagcccagcttttcaccctctgtcacaacgagccttggccatggctctgactcaggcatcctgggcctgagtactctagtgtggctggctggtagaggccctgctcaagctgaagtagtctttctggatgtgtggtacatatggacttgagggctttggtcacctgtaaggtgtgcccgaattgcccgagttctcaaggatcttgaggaattggctgaactgtgcccgcaggggctggagcaggcag

SEQ ID NO: 704 - DNA, 3417 bp, Mus musculus
aagcacggccacaagcgctttttcgtgttgcgcggccccggcacgggcggcgacgaggcatccgcggctggggggtcgccgccgcagcctccgcggctggagtactacgagagcgagaagaagtggaggagcaaggcgggcgcgccgaagcgagtgatcgcgctcgactgctgtctgaacatcaacaagcgcgcggacgccaagcacaagtacctgatcgccctctacaccaaggacgagtacttcgctgtagcggcggagaacgagcaggagcaggagggctggtaccgcgcactcaccgacttggtcagcgaaggccgctctggcgaggggggctcgggcaccaccggaggctcttgcagcgcctctctcccgggcgtcctgggcggctcagcgggcgccgctggctgcgatgacaactacgggctcgtgacacccgccacggccgtctaccgcgaggtgtggcaggtgaacctgaaacctaagggactgggccagagcaagaacctgactggtgtataccgcctatgcctgtctgcgcgcaccatcggcttcgtgaagctcaattgcgaacagccgtcggtgacgctgcagcttatgaacattcgccgctgcggccactcggacagcttcttcttcatcgaggtgggccgttcggccgtcaccggtcccggggagctgtggatgcaagccgacgactcggtggtggcgcagaacatccatgagaccatcctagaagctatgaaggcactcaaagagctctttcgagttccggcctcgcagcaagacagtgggcacggctcgggctcctacccgctgccacctggctcccacccgcacctgcctcatccactgcatcacccccaaggccagcgtccgtccagcggtagtgcctccgcctcgggctcccccagcgacccgggtttcatgtcccttgacgagtatggctccagccctggcgacctgagagccttcagtagccacaggagcaacacacccgagtcaatagcggagaccccgccagccagagatggcagtgggggcgaactctatgggtacatgagcatggatagacccctgagccactgtggccgcccttaccgtagggtctcaggggatggggcccaggacctggatagaggactgaggaagaggacttattccctaaccacgcctgccaggcagcggcaggtacctcagccttcctctgcctctctagatgaatacactctcatgagggccaccttctctggtagttcaggtcgcctctgcccatccttccctgcgtcctctcccaaagtggcctacaacccttacccagaggactatggagacattgagattggttctcacaagagttccagcagtaacctgggggcagatgatggctacatgcccatgacccctggggcagcccttaggagtggtggtcccaatagctgcaagagcgatgactacatgcccatgagccccacaagcgtgtctgctcccaagcagatcctgcagccacgcttggcagcggccttgcccccttccggagcagccgtgccagcacccccttcaggggtgggcaggaccttcccagtaaacggaggtggctacaaagccagctccccagcggagagctccccagaagacagtgggtacatgcgaatgtggtgtggctccaagctgtctatggagaacccagaccctaagctactccccaacggggactacctcaacatgtcccccagcgaggcaggcactgcagggaccccacctgacttctcagcagctttgcgtggaggcagtgaaggcctcaaaggcatcccgggccactgctacagctctttgccccgctcttataaggctccctgttcctgcagcggagacaatgaccagtatgtgctcatgagctcccctgtgggccggatcttggaagaggagagactggagccccaggccaccccaggggctggcacctttggggcagctggtggtagtcatacccagcctcatcactcagcagtgccttcctccatgaggccgagtgccatcggtggccgccctgagggcttcctgggccagcgatgtcgggcagtgcggcctacacgcctatcgctagagggactgcagacccttcccagcatgcaagagtaccctctacccacagagcccaagagccctggcgagtacatcaacattgactttggtgaggcaggtacccgtctgtctccgcctgcccccccactactggcatccgcggcctcatcttcttcactgctctcagctagtagtcctgcttcatccctgggttcaggaaccccaggcaccagcagcgacagccggcagcgctctccactctctgactatatgaacctggacttcagttctcccaagtcccccaagcctagcacccgcagtggggacacagtaggctccatggatggccttctctctccagaggcttcatccccatacccaccactgcccccacgtccttccacttccccttcctccttacagcagcctctgccacctgccccgggagacctataccgcctgcctccagcatcagctgccacttcccagggtcccactgctggctcctcaatgtcctccgagcctggggataatggtgactataccgagatggcctttggtgtggctgcaaccccgccacaacctatcgtggcacctccaaagccagaaggtgcccgagtggccagtcccacatcgggcttgaagcggctaagtctcatggatcaggtatctggggtggaggctttccttcaagtcagccagccccctgacccccaccggggtgctaaggtcatccgtgcagacccacaggggggacgtcgtcgccacagttcagagaccttttcctctaccaccaccgtcaccccagtgtccccatcctttgcccacaattccaagcgccacaattcggcctctgtggaaaatgtctcactcaggaaaagcagtgaaggcagcagtaccctgggaggaggtgatgagccgcccacatccccaggacaggcacagcccttggtggctgtgcccccagtgccacaggctaggccgtggaaccccggtcagcccggagctttgattggctgtcctggaggcagcagttctcccatgcgcagagagacctccgtgggtttccagaacggcctcaactatatcgccatcgatgtgagaggcgagcaggggtccttggcgcagtctcagccgcagccaggagacaagaactcctggagccggacccgtagccttggggggctcctcggcaccgtcggaggctctggcgccagcggagtgtgtgggggtccaggcactggagctttgccctctgccagcacctatgcaagcatcgacttcctgtcccatcacttgaaggaagccacagtcgtgaaaggtgaggccctt

SEQ ID NO: 705 - protein, 1139 aa, Mus musculus
KHGHKRFFVLRGPGTGGDEASAAGGSPPQPPRLEYYESEKKWRSKAGAPKRVIALDCCLNINKRADAKHKYLIALYTKDEYFAVAAENEQEQEGWYRALTDLVSEGRSGEGGSGTTGGSCSASLPGVLGGSAGAAGCDDNYGLVTPATAVYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFRVPASQQDSGHGSGSYPLPPGSHPHLPHPLHHPQGQRPSSGSASASGSPSDPGFMSLDEYGSSPGDLRAFSSHRSNTPESIAETPPARDGSGGELYGYMSMDRPLSHCGRPYRRVSGDGAQDLDRGLRKRTYSLTTPARQRQVPQPSSASLDEYTLMRATFSGSSGRLCPSFPASSPKVAYNPYPEDYGDIEIGSHKSSSSNLGADDGYMPMTPGAALRSGGPNSCKSDDYMPMSPTSVSAPKQILQPRLAAALPPSGAAVPAPPSGVGRTFPVNGGGYKASSPAESSPEDSGYMRMWCGSKLSMENPDPKLLPNGDYLNMSPSEAGTAGTPPDFSAALRGGSEGLKGIPGHCYSSLPRSYKAPCSCSGDNDQYVLMSSPVGRILEEERLEPQATPGAGTFGAAGGSHTQPHHSAVPSSMRPSAIGGRPEGFLGQRCRAVRPTRLSLEGLQTLPSMQEYPLPTEPKSPGEYINIDFGEAGTRLSPPAPPLLASAASSSSLLSASSPASSLGSGTPGTSSDSRQRSPLSDYMNLDFSSPKSPKPSTRSGDTVGSMDGLLSPEASSPYPPLPPRPSTSPSSLQQPLPPAPGDLYRLPPASAATSQGPTAGSSMSSEPGDNGDYTEMAFGVAATPPQPIVAPPKPEGARVASPTSGLKRLSLMDQVSGVEAFLQVSQPPDPHRGAKVIRADPQGGRRRHSSETFSSTTTVTPVSPSFAHNSKRHNSASVENVSLRKSSEGSSTLGGGDEPPTSPGQAQPLVAVPPVPQARPWNPGQPGALIGCPGGSSSPMRRETSVGFQNGLNYIAIDVRGEQGSLAQSQPQPGDKNSWSRTRSLGGLLGTVGGSGASGVCGGPGTGALPSASTYASIDFLSHHLKEATVVKGEAL

SEQ ID NO: 706 - DNA, 23833 bp, Homo sapiens
  misc_feature (1)...(23833): n = A,T,C or G
acatacttgtgctacaaaattcggaaagtccgaaaagtaacacgatgaaacgtgagtcctctccccaacccgtcccttccccaggaagccaggttggctcctcgcattgccatatttgtgaggtcacttgcagtaggtatctgtgcacatacccacacgttttaaaaataaaaaaaatggttgtactatactatacacactgttctgaagcttgttttcccacctcacattatacagtcaaatattattctgggtcagtataaacagagctgcctcgtttgtgttacagttgcatagggttcaaacctttgccattacaagacaatactgtaatcatgtgtataagtttctattcctaacaataatgcaatgaacacccttataaagaagtcatttcccatccacatgagtaattcctggaaattagattgtgggtcaaggaacatgagacatttgtcgttttgacagatacagccaaattgtatagatgctgttcagtctgtaccaccagcagccttgggtgggaacctgtttcccaacattctggcaaacacaccgtgttatcaaacttcttgatctgtgccaatctgataggtgaactattctaccacattgtggttttaatttgcattcatcttattacaagaaaggttaagcaaactttcacacatttaagcctttcttgcattaattttcattattgtgaaatttgtattcaggtcattcaccaatttttagaatgtttttagtttcttattttttacagcgctcttttaaagtattaaataagcatcattagcacttcatctatgatactggctgcaatttccttccagcttctactttaactttgcttttactgtttttgttttgtttttactgtattccccctacagaatcctattttagaaagtcaagtttatcaatatttctttacttttctacttggttttatggtttcatgttttaatatttaattttttgcttcacctgacattttagtgaaaggacacaggcatctaatttttatgtgtctacaggtatattttctggttctgccaaccccatttactgaataatctcttatcctccaatgaaataaactgccagctttataatatgctttgtcccttgtatctagatttagttctgtactaaatacaactgaccttttgatttggctatgttcatgtaggttctccacctcccactgatttgtgagcttcctaagcacactgtcagggtttgagattttactccctttcccttagaaagtaatgttagcccgtcaccgttaggtggatgctggcagaggatgtaagcctttccggtcagagactcatggcacagaaagtggcatgacttgcctctattcctcttgcttcccgggcagcatggggcaacagggcggggcctgttggatgccacgcctgcagtgggctgtgtttcggctgacacaaaggacttgggtaatccaccatttttgtagcaggaaataagcaggcccgcactttgttctggaatgcgacctcacctcttagtgtggtttgctgcaagcacaacccttaaaaaaggcttgagtaaagcaaagccagggtcttgcgtatttcactgacccactaacaggcgtgggagcaggagagacgcacagaggagggcctttcccagcagacacagctgagtggttgtggtcggtttgcattttgatgtccacaggatcagtgtctagtacaaagtaggtgcttaagaaacgttgataaatttgaccgaatccaacatttcactgggttagaatgaatttaccaccacacagcataactacatcactacatctattgagtattattctctactacacagatgggtcctcacactatggacccaggcagcgtcaagagtccaaaacggtaccttctaaaggaagcaacctaaaaataaaagaaatagaattactgtttgactcattaaaactaatttctgtgaaatgaaatttagaaacttcctcagctcagagataaaagtcactttctctactctacaccattagtaagaagaaggtaaaattgcagcattggacattaaaatcaagcactaagaaagtttttttaaaaaagccagatgatggttataatatatggcaatttttatcttcaaattatgtgtggcaatattgtaacaaaagacacaagaaaaaaatatttgaggaaagaaatagttgaggaaaatagtgccttattacttagacagaaagctaatggggcaaagacctatgttctgggtaattcttagtatacgtttgaggcttaacaaatatctagcacatttttagtaacaatgtttgcggatttttatattttgaattgaaaatgccataaatgcaccttcacgataaagggtgagcccacttttgtattattctgtaactaaaacatgatgatatttaaaacaacaaagcaaaatgatgatctagatattaatttcctttaaagtttatattgtgagagacaagggtgccattttgaaattgtggtgtacttttagtgtgaagaaactttaaaactaggtacaagtttatcaaaataaaacaggtaagtatcaagtctcaaaaatatgtatttcattttctgtgtgcttttagtagcagtgagaatcatgtttttaaattctcacttttactacctaaaaggaaatttttgtagtataaaatataattttaagatgttttcaatatataattcctattttttttctcttttagcaagacaaccttgggctgacattcgaaatttttactaaagaaccagcaagtactaaaatgcaggctgatgtttacactttcagtagtaattcttagaatgtgtttatctgaactgaaatctctacttaacagtcagcgggaaatggcaataaatggcatctgccctaaatttcacaagttgttgctttatttattttcttgtgaacctcattaatccatactccctcaagtcactttagtttagttaatattatttgtgtgacaaaagtgttttgaacaaggaaaaatggaaaattcatgtataaatagctaatcattggtcttaaacatagcatatacacggaggctcagaggacaggttggtaaagattactcaaaaggagaattaaaagaccgctcaattctcagttgtgtcataatcgtatctttatggtagctacatattataaaatgttttttatttatccctcatactagtaagcgtcaaattcatgatctttgtgagtatactgacaaactactctcacaagctattactattattgatattttatatatcaactttttttcatccataaaagtacctcaacgacatgttcagtagcaaataagttttcagatcccttcactctattgaataacagctctgaacactttgactaacttgaatatcttctatttgcaatgcctaaagattgagaataaagcagttaagaaggaaggtgtaatttgtaaatttagaattgccaaattagtaatgagtatgtaagttcaaataattttacgcaatcaaaaagatagtgacattcgatgcttattgccatttgttatttatgtttttaaaatacatttttgttatgtgtcattttcagagtatgttttctttcctatcttactttttccaatttgcttttcaatctttcaagatgactttggcttatcctaaaaagaatgtgagacttaaaggtcaatgtaggggagaaatacaattaaaaaacacttggcttgccagataagcaaatcttgattataacttatttttgattaggtaaacattctaaaataatactgaatttagattcttgtttttattttgttggctagtattctaaactcttaagtgggcagtgatatacatttctattaaactgtataagtaactatgcaaattgggatataaattgcattagaaaatatgaacatatttgcttgatacttaattcaaccataaaaaataaagtattgcacttattaatgttctcttccctcatttgtcatctgatattgctcttagtcactcactatcaaaatttctttgtttaatcttacttctattaatttccttaaagtttcatgcaaagcaaatttatgtcaggttgtaagcacctttctctcaaagcaaccaccactgtatttgtgacaactcatgccagaaccctgaatctgccttgggaagaaacattgccagttggtggcagcattcacaagagagggtcacatttcctctgttatctttaggttgaatttcaaaacaactctagaaaacagactcagagggctagccttggaaacagcatgcaaacaactgcagaaaagcggaaggtttctgactataatacagttctaccaaacagcagagcatgtggcaaaaaagccaggctggctcccttcctcctgtttacctcctgagcagtgtatgaaacagggtgagcttgctcctggaatcaataggtgaatcaatgaacacaggctggtcttccccacttcataacatctgtactctgtacaaggacactccgggccaccctcgctgagcatcctcccgccctctcccagaaaatatagctgtgtcatcttacagacatttttaatgtcatctgcttatgatgtgcagattgagaagcagacaattttgttctgctctggcatgaaaaaaaaaaaacgttttaatcggcagctaggatagcaacatgaagcaacacacaggacatcaatttcatcatgcaaaataccggtgtattatattacaggggccaagcattccaaggaaaagtaatgatctaagaagatgctcttgcattttaaaaatatctactagtgttatacagtcattaatgtataatttccatttcaataataggaagccttctgggaaaaaaagcttgtgttgcttcttaaatctagaaacacattctcaaaattcaaacagaacaaaatccagaggcatattaataaatattttcaactcctaaccgcagtcactttttaattgggcatttatgtatttcttcaacataattatatttataatgaaaaaatgttgagaatactggattagctgcatttgtaactacaacatatttttctaaacagtattaattcaattgataagactttaaaaaagttatagtagtttgttctatcatatatgcacattaaataatcatttattttagaaaatcctccctcataaaatgaacatttaggaaagagactgatccatatttttaacaagaataataaacacacaagtagaaagcctttataatttccaaggggctgatcaattccattaacaaatcctgatactttaaatgtttgcaatgccatacatagcaaatgatccaaacagcagttatattctctcatgtaagtcattctgttgcccatacacagagttagcatgttacaaaactcttgtgaaatttcagttgaaacattagcaaataaatttgctggtaaagtgcaagaagtttccttataaaccctagatgaggaaaagtctgtccacagttcgttcatcagaggaatggaatttctcaaatgagctactgaacaacattatctaataaaatgaaatataatgaaatggtgccactcattttaaagattaaatatatcctttgacagaaacctgtgaagttaaaaatctttccctcttaaaataccttttaaattaaagctattctaactagttatatagcattccacttaatctgcttagtttttagattgagctcacctaaatacaaaatactgtcaaacacctacagggcaaagaactaaaaaaagaaagaaaatttcacaagcaataaaatgctattcacctttctcctcccatacttgcctttcctatatgaaacaaagaaaataattagtgatgttcattattggtagtgctactagtatttgtattgtgaacctgtaacatatttttaaatctctacacttttatataattgattctttcttgaaaagtaattatttcagaagacttctaataaaataatcattattgtatatgattctgttaaaaatagaaaaaacaaacaaacagaaaaaactccctgctgaaagatatggccattttattagctgtgaaaggaaagaaagcttccaaggaaagatcttggaccatgagaaaaaatttcaaccaggctgtttgctggcaagaggccatgccagccccagccagtcctgcgtgcagagcatgttggcagatgttattagctgacttttgttgaaaaagtatggaagaacagttggaaaatcacaaggtgtagaacaagctttaaataaataaatagcttatctggcaatagaaagggggaaagaaaacaagttcctcggttgaggaagaggactgggatacttctaattacagagtttcttactgttggtttgtttcatgggctgactctcaatgagaattgaaattgtatcatccacatttgtatttggaggttctaactgcagaattgcaattaatttccagtttgctgtaggaaatttatactctctatgacagaataccacggacataggtgataattctttaaccttctctcttttgtccccagtctggtaactgaggcagtacatggggaaagtgctaactgccaatccagagctgctgacaccttaaaaacactggcctttaacactaggatggccccaagaaacaagcaaacaggaaaagatgacacctgctagcgtgtgacaggcacagcaagtaaatgttcaatacggatatgaaaatgcaactgcataataaaagtcaacatgaaaaagaaaaagattgcaaaatatactttctcagaagaaaccatcacatgatgtttaaaagtggtggttcctttagcattgtctactgatggctggcaacatacaggaacatagaggtggcccatttacatcctcataaaagtgggatgtaagtgatcacaaagccaataaaactacaccacattttcttcaagcaccaagataagaatcccttcatctttcctgactagacatattgctaggcaacatttgtgaacgtaagaaaaggtaacaagatctaaaaagaacgccgaagcataatgttcataaaggtggcgcccccaacacacacaatcatacacacatacctatacacacacaatcatacacaatctattatataaacaaacacgcacacatgcacacataggtgcacagacttaaaatggcatttcttgaggtatttttttttaaggtatgatttaaaaatggaagatcaactttaaacacacctttttgaggcacactgggtgatatttgccacaatgattattcttcccaaattcaggctactgatcaataatcctaactgtatacatgctaaaaataaaaacgctataatctttgtactagtcagggctctcttggcacataaaattagccaacacaatcttcaagtcacatgttacaaaaacatattaaaatatatatcactctttcaaaaattacacttattttctcttagattaagattttattacttttaagatacttctatgaattatagaggacatccaaaagtaaacatccgggacttaaaaacaataaccaatattataagataaattattgctgtaaattatttcatgaaggcacaattaaaaaaaaaataaaataaacagccaaagcctgttttgttgagttttcttcgttgcgcaggatcgggagcttgctgggatctgaactcaggaagccctcacctcaccctgacttggtcattgaggagatgtaattgcaggggtgcttatttgctataggctttgaaagtcacaaaagcccagtagatacatgaattcgaagcagttctccaagggcatctccaacttggcagtcaccgcccgcaccgcgcacacaggtagtggacgcccgcccacctgcccgtctgctgggcgcagggcgctcctggggtggggagggcgctcctgtggggggaaaaggggcgctcctgcctcggagggggaaaggacgcccctgtggaaggaagggggggctcttgaagcggtgtggtgagaggacgcttccgaggaaggaagggggtgctcctgcagcggtggggggagaggacgcccctgcggaaggaaggcggcgctcctgcgggggctggagagacgcccgcgcggtctcccggctcagggaccgctggctcgcgggtccgccctctccccggcgctatggaaaccgcactttctccgcctgccgtccccgatctctttctcctattacctcccaaacgcgatttcaacttcccgacaagctgacaagtgaatggcgcagaggacgccccgtaaagcgcccgcgagcgggtgggacacaggcgccccctccgcgcccctctgtcctccacggaagggcgcgcgccgctctcgatctggagcgcggtgctcgcgaacccgcggccgcgggccctggaacctccccgcgtttcgcggctgcggggggacggagatgcggccgggagacggggacgggaaacgggggacggggatggggcgcgcccaccccgagcgcgggagcggccgccctcgcccaaaatggggaccccgcgccccgagagcacggcccggctcgccgcccatgcttccactgcaaggccgcagcccccgccgccgatcccgatcccccgccccgcccagccgcggccccgcccggcgccccctccccggcggaagctcaagcccaattaattgagtccgaggcgggagggaagggccctgcgcgccgtggcccgccccgcccctcttccgcgccccttttcccgccctgggtggcatctcctccgccggcatccacaacaagccgctgattaatgaggccggggccgccccaccccgcccggccgggccggggccttcgcgggagggggaggggacggcgggaaacgcggcccggggagaaaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaaggtgaggaggccctttgccttggcgtctggcgggaaggaggggcggggcgctgagggagcctcttgggtttcactgctcccactttttggggaccttgacccagaagccgacagcctggcactggctccttgttttgtttttctgcgggctgccctgttctcttccctcagagaacttgccaggaacattcgtcttggagttgaatgtgacgttttccgcgtgggagggagactgattttttgaggccccacccattcacccattctgtgcgtcccacagccccctgtcccttaacacagtggaagttctcccagaccggccacactagaggccgcggggcacccgactgtcttcatccgggtgcgtgggtccgtccttctggaaggacctcgggtccggaccgctgccctcagccgcagctttcacctttccctgtgttcctggagctgggctccgcctgattcttggtgagcttgaaggttcagacctgaaagtcatttaagaaatgagcatccattttgatggctgctaatagcgacagttaaccatttccgttttacacacaaactgtgggagcttttccatcagaggcattgtttttctcggaaggggtgaaacggtaaggctgcacacagcctaatgcagtggtgttcaacttgagcatatgtgggagttacctggaggctttgctgaaacatggatctctggcctgtgttaaccccgcagtttccgatgctgtagctttggggcgcggcccaggctgtgcatttctagtgagtctccgcataatgccgatgctgctggccgggggaccaccctgtgaggaccctgccccaggtgagactcacctggggaggattgaaaaattacctgttgggcctcaccccagacccgttgaagtgaaacatgagatggctaggaggcagggacggacatttttcagagttgtccaggtgatttgaatgtgcagccaggatttacaatcagtgctttggagaaaacaagggaaagacaaaaaacacaggtcttctcaagaacaattggataggagggtgcctggtattgttcttcccgttctgatcaaatatccatgaggagagagagctgatgcagaatgcagctggtggtgcattctggctgtctaaactttgaatggtgtttggggtcggggagatgagagggaaaggtgaatgctcaattcgggagactttatttaattttgtagctgttttctttgtagggttcctagcaggatagaggctttgtgggaacagtgaaacatatagtaaaatttggatgctggattagatgtgagcctaaggtgtaaacagtcttcaagggtcatgagatgaggatcaaggtgggctggagattcacagccttttgttcttaaatagaccagtttagtgctatctaaatccagcatctgttttatagtatacttaggactgtcggtccatgggatttaaaattatagctgtggggtgaactccctgttattctagtgtaatagagaaaagctatttcctttattaaaaccgtatactagaagatgaagagtcacagagaattatcaggagtgtggtgcttcagcatccaattaaatcattggaagtcgccagaatgtatcctgtgaacagtgattctcagctgaaggtcactttggttggagttacttatacactattgctagtgtgtcagaaagttgaaggattagctgccttataagacacagaccattataaacacagcagcagcagcagcagtataattgagtggggaaaaacacacatatttatggtctgcacaaatgggtatatgccagagtgaacatgaaagtaaattacatcttacccgaatctgattctaatcagaaaacagccaagaacataacaccttttcctgctttcagtggagctggtgggacaaacctggactgggtggagctggggccccagcagtgggctctgccatagcaggcgccataagctggaatttgtgcctccaggcctggagggacgcaaggcgtttctgatgaagccgatacattcagaattggggtccaaataggaaataatgcccttttcaggctagtgaaaatgttgaactctaagagataagtttatttagagactggattgagcttttgtttaagatttcccacctgcgtaaaattcctttcagcccataggattcttgattctgaagtccagacagaagcctgtgttctgtagctgctgaacaaagatgagagatcactggggctgctgtttgtccgaagtttgtgtgggtatcatgatgaaccctcttctaagaagtaaaaggatcttttaaatcaaaatagacaactgcagtcagtccaccatgcccaacgacatttaaaaaaaaagaaatatctgccccattgggtttctagtaaagtaagttgaacacagagaacagcagaataggaaaggctagtgtcaccttagtccacgtagcaccaaagttgtggtccgttgagacagaaaggaagcatttaggaacttgggataaatacccacttttatttaactcatacatgcactagaaatttgtttgggatgctcataaatacagagttcacagtagatcagtgtcctttgaggaaatgatttgtagaaggccgacttgcaaagcatttctttgaagatgaaatagagaaagcacttcctgggcggccccctgccctgcctggctcttagaagtggcctgtgtttccaccctgagctcttcctgttctgcatgggaagacctcgttagtgatgctgatgcagaataattttggggttatgtgggtaatgtttggtatttgcataagtgatagcagagaggtaaggttccagccatgtctggcacttgtttacaatagaatcgtgaatgggggtgggctttcagtgcaagagccagttaaaaagtatatctcaggtacatctgtttttattagtccagagcaaactcaaaattatgcatcttatttgagggcaggttaaggttacttatcatgtgtttttggtgtgtgtgcatgtggaaaactctaaccaatttgttaggtttcgttgttgtttgggaattggaaagacgctactgaatttcctgtgctttaaaactgatttttaaaattaactttatatgtttttgtgttaggatggtagattgatgaatgccataaaatttgctgttttagtattcctttttagtgattttagggattttattctaaaattggcgtatatatatgtatgtatgtataagacagattagatcagaattactactgaaagtatccatatttaaattttgttgaataaaaggattatcatttcttaaggggaaagaatgataagagatatgtttccaaagggacaataaaatcacgatttatgttgaaaagttttgccttttgaagtcgtaaagcagagaattttcctaaattcagaaatccagtgaggtgattgacaaaccacacaagttttctgtttgctgtggcgggtgctagtttgctttagttggctggctctggccataataagacaatagcgtgcactgctgctgccctattcgcaggagcagacaactaaggtgctaatgaaaacacacacgggctttcgtgaatgaaagtcacatgacttgttctgtttcctttattgaaagagaaacctttacaaaaatagtacttcatagaaggaagcatagtatgtggaacactaaaccaggaatcaggaaaccaggtttctagttgctgatcttaatgagtcattgtgtgtctatgggagagccacttaatcctgccttctcactttccctgtctgtaaaatgggggtaattataatcctcccctttctgtgtcacaaggccgctggaaggtaaatgaggtcataaacatcaagagtgttttaagctcttctaaaggaagatgctaataaatccagttgttgatacttattgctttgaaaccatgaatgtatacaggaaagacacttttgtaaatgggtgctcttaaattgaaacaaacagtaacagcatagtctgaaaatggagccagcaccttaaaaattgcttacctttactgcttattgctagttccgctccaggctcccaagagccattgttttccccctttatgtaacttaagatctgttcatagatatttatgaacagattgtaacaaagtggtgttctaaattacatagtaaagtaacaattagggaaaacagtatggtaatcctgaaactatgttaagactgaacttctgattaccttttattactggtttttatattaagagatgttgacaagatgaaaatgtataattagaatatacattttaaaaatcgcctcttaatgccgaatgcattgaaagaaaaacagaaccctgaggttgtttgactactcattgtttagtctgggggttcattctttggggtcgatttaatgagggtggtcattcctgcagttttgatggtagcactgtgcttatcaaacatagtaggaaaatgcgtgattcttttgtttttctaccacccaaaaaggaatcttagtagagaattgatattttattttctttagaagtatgagtatttaaaatgaggctcttttttctgaagagaagaacttggaaaagttttagtaacagcatgagtataatgggttttctgttaaaattcccactaatgcattttctttagaaacgtagttctaagagctaattttggtatcagatttggcaagtagaaagggtttttgtttgtttgttttggtttttttctagggggagtagcacagaatcaagtgttcccatttcaccttataaacttaagggaaaatgtaactttattctttcatctgcattgccaagtagaatgaggaaaacactgggtgaggcaaagtgctgtgccccccgccccccatcctgcatttggacagctgtaatgcaggtggattctctgtttcatttctctagtacggatgacagcagaatgtatatttctatacaagatgaacaaaacgttttaatgttggcgttttaatgaacaaatgaaaacaaaattttctgaatgtccaaaagtattggttataaacacattaactgtcagatcatgatttttgtgaaaagaatgctgtccaagtttagatagggacactctttctatatttagtttgagtgggttcttcaagattgcagtggttattctgactcatttcaggtagattattgtacacagagttcagtgctagacttttctgaagaaaactagtaaagtcatcatttggcatggaggagatgatggggttgatgattgctactgatttcaatttctttcaagatagctacagagacttacattaactgggtgctaaaatacaatgcataggtgaaggttagtgtagaaagagttggagtatatgttgtataccaacattttgctctgtaggtgcaaataatgcaagatgcttctgtgtgttatagctttattacttaagtgaattcattacataagaattctgaaatagattggattaaaacttatgggttacatgtttacaaatgataaaatagtcaatttggtggttctgattaattttctattagactaggaaaatactaagtttgtatagagtcacttttatgtgtccaaagacactgtaaaacttgaatgggtaaaggtgaagccttggaaactctgtccagttttcttatgtcatatatgatatctgtatacacaaggtttataaaatattccttgcttactgtgtttttactgaaatttggaatatttgatcaaatattttgacccacgatatattttttaaagataactgatcacacgcattgcaccctgtaaatgctgggtttttttctttttttttttttgagacggagtctcactctatcactcagtctggagtgcagtggtgtgatctcggctcactgcaacgtccacctcccgggttcaagcgattctcctgcctccgcctcctgagtagctgggactagaggtgcatgccaccatgccctgctaattttttgtatttttagtagagatggggtttcaccgtgttagccaggctggtctcgatctcctgaccccgtgatcttcccgcctcagcctctcaaagtgctgggattgcaggcataagccactgcgcccggcctaatgctggatcttttaatattcattttaaagagtatcaggttttccagcaacaaatatttggggctggtgtgtgtgtgtgtgtgtgtgtgtgtgtgtgtgtgtgtgtgtgtgtgtttccataatatctcatccagtcatgctccaggaggctggatatgatatttttctccataactgaaattcaaggattaatgatgtgttctttgttcatgttgaaactttataacttaagcatagtctactgctactttatccctatacagttagtacaaatacttgagtcagttattacggtgtggtatgaaatttcaattgttttcaatgcataaaaacagatattatgatatagttcattatactatgtgattttgttactttacaatcctattatactgtgtgattttgttaccttaaaatccttatgtttatgttaagaatgattcattcttggatgagcttggtggctcatgcctgtaatcccagcgctttgggaggccgaggtgggtggatcatctgaggtcaggagttcaagaccagcctggccaacatggagaaaccccatctctactaaaaatacaaaaattagccagccatggtagcatgcacctgtagtcccagctactcaggaggctgaggcaggagaatcacttgaaccagggaggcagaggttgcagtgagctgagatcgcgacactgtactccagcctgagcaacaaagagtgaaattcagtctcaaaaaaaaaaaaaaaaaaaagaaagattttgcatagtattaatgcttaatctttaatatttaagaatatgatacagtgctttctgtatgcattctatggacttaaataagtcaatctttggcctccaaagtataagtgtaacagataatcccacaacttggtagacaactggcaactgaagattttgaaagaatcttattgaagttgaatgcaatgacgatgtaccattattctgatcaatattgacggataactgcctgccactcttctcttggggttaaaagagttgtgtaaaattcaaagggtgtttttcttccctttatagtggtaagacattttcctatatacaatatggtataatattccaaaaaatcctatggcataggcagaaccaccatgaaccccattctttggaatcaagaacctacagtgtggagaggccagatgacttgctccagatctctgagccaaaaggagaaggagtgtcgggttcaacctcataacatcttggtatccctagcccagttctctaatgtcatattgtctgcttgggaagctcatatgcaataattacattaggattttatcctagacccttgcctcaagcaacatttaagttaatattttgctggagtgatagttaatcatctccccctttttcttccactgggtatcaattcaaaggaaaatggggaccattgaggaggaagactggtaggaaagcgctctatttattgaaatcagtttttacatcctccggtttggagagtttagtatttgatactattttcaaggctgtgatgttactagtgaattttaaagttgaccatcaagttggtgatggatctgttctggggactccagtcatgcttcctggacctctagatgtgtcaacaaagtggaaaacttagattgctctggctgtctttcattacctcttggtaaagcaaactgtatatgatacttggtaagatacctccccaccaccgccaccatcaaatacattaaaactcttgcaactcaggtggtgacaatacgaaaaaaatatacaagggtgttctgagaaggaagagttgagaaccgttgatagaaggtaacttagttatttaaggttgtgaaaacagaggctgtgtgaggtccggagtcttagtcaaggtcactgattcaattagtggtagagttgtttgtagatatcatcaagaaagagtaggagaatgtgatacaaacaatgacacatctcagttggttctttgtatcttgatgaataactttctcccaggatacagcctatgctctttagaacaacttagtatttgtggaaatgatattagtctttttactttggaacattttagtaactttcttcatccatagactaaaagaaaccctgaaagccagaaatagagaatgcagaattccttaatgaagaaacgcgttataaatcagagaaatatggctgttcatgactatgtggacggtgtctactgagtggggagaagatttggcaaatatttaaggtcatgtatttactttatcaaagaaaaggaaacaaagttattgtttcatgaagacccccagtgaaatcgaaaggcctagattatctagcagaattgaaggcggctctgtgtaacaggttcagcctgggcggtgacacagtgatgagtcagcgggtgcattcggtcactgctctctgtgtctctaagacaggtgcttgttctataagtgaaatatcatatattccccattatggataagtccattaacatttttctaagaaatgagtcattaacctatttaatgagtttatttgaaaactaatcaatttagaatttgcctaaggaccaataactaactaatcagttgttgctaggtggttatcttctggggaattgagtattttgtcagtgcctttttatttttaacagcccttgtttttttctttttttttaattctcaggaaaaaaatcatttagctggatttttatatgaagataaatagttttcatacaaatttaatttcacagaagctgccattattctaatgacgtgggtataacctcactttcaaaagcagaaagaaacactttagcaaacacataaaaattcttaagatattcacactttaaaaaatgtaataggcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagatcgcgccactgcagtccgcagtccggcctggccgacagagcgagactccgtctcaaaaaaaaaaaaaaaaaatgtaataggcaaatctgtggcctggaactcttgtgggcagtgcagtgtttgctttgtgcaagctgtcaggcctctcagcatcaagagacagtacctccttcctggccagcacccccaacggtgagcgccgtgacccaccaaacagcaggtgagattggagacctggctggatgagcaaagcaggaaagcagttttgctatccgggcgaatggagttacggaccttcttccaggttaagaagaaagccacgttcggagcgccctgtgttgcagtgatgggtttgttgagcacccaccaatttagtcaggaaaactgatgcagacgtgtggtctgggggtcttcatgaatcggccagaagccttttccccagcaaggtttgggtgcctctgggaacttttgccttctgcagaggacctgggaagagcgtgcacctacctgcaccgctccgtgctatgaaccaccgaaaatagggactgaagtcagggaccatctgaccacgtgaattcccgggtctgcggcagaagccgcccccgatcccgtcatctcagtggccaccctcacccatgactgccctgcgctgcctgggcccagcgcatgccgggtg

SEQ ID NO: 707 - DNA, 3833 bp, Homo sapiens
ttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattga

SEQ ID NO: 708 - protein, 1278 aa, Homo sapiens
  VARIANT (1)...(1278): Xaa = Any Amino Acid
FFVLRGPGAGGDEATAGGGSAPQPPRLEYYESEKKWRSKAGAPKRVIALDCCLNINKRADAKHKYLIALYTKDEYFAVAAENEQEQEGWYRALTDLVSEGRAAAGDAPPAAAPAASCSASLPGALGGSAGAAGAEDSYGLVAPATAAYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFEFRPRSKSQSSGSSATHPISVPGARRHHHLVNLPPSQTGLVRRSRTDSLAATPPAAKCSSCRVRTASEGDGGAAAGAAAAGARPVSVAGSPLSPGPVRAPLSRSHTLSGGCGGRGSKVALLPAGGALQHSRSMSMPVAHSPPAATSPGSLSSSSGHGSGSYPPPPGPHPPLPHPLHHGPGQRPSSGSASASGSPSDPGFMSLDEYGSSPGDLRAFCSHRSNTPESIAETPPARDGGGGGEFYGYMTMDRPLSHCGRSYRRVSGDAAQDLDRGLRKRTYSLTTPARQRPVPQPSSASLDEYTLMRATFSGSAGRLCPSCPASSPKVAYHPYPEDYGDIEIGSHRSSSSNLGADDGYMPMTPGAALAGSGSGSCRSDDYMPMSPASVSAPKQILQPRAAAAAAAAVPSAGPAGPAPTSAAGRTFPASGGGYKASSPAESSPEDSGYMRMWCGSKLSMEHADGKLLPNGDYLNVSPSDAVTTGTPPDFFSAALHPGGEPLRGVPGCCYSSLPRSYKAPYTCGGDSDQYVLMSSPVGRILEEERLEPQATPGPSQAASAFGAGPTQPPHPVVPSPVRPSGGRPEGFLGQRGRAVRPTRLSLEGLPSLPSMHEYPLPPEPKSPGEYINIDFGEPGARLSPPAPPLLASAASSSSLLSASSPASSLGSGTPGTSSDSRQRSPLSDYMNLDFSSPKSPKPGAPSGHPVGSLDGLLSPEASSPYPPLPPRPSASPSSSLQPPPPPPAPGELYRLPPASAVATAQGPGAASSLSSDTGDNGDYTEMAFGVAATPPQPIAAPPKPEAARVASPTSGVKRLSLMEQVSGVEAFLQASQPPDPHRGAKVIRADPQGGRRRHSSETFSSTTTVTPVSPSFAHNPKRHNSASVENVSLRKSSEGGVGVGPGGGDEPPTSPRQLQPAPPLAPQGRPWTPGQPGGLVGCPGSGGSPMRRETSAGFQNGLNYIAIDVREEPGLPPQPQPPPPPLPQPGDKSSWGRTRSLGGLISAVGVGSTGGGCGGPGPGALPPANTYASIX

SEQ ID NO: 709 - DNA, 77941 bp, Mus musculus
  misc_feature (1)...(77941): n = A,T,C or G
aggggcctttctttcccaatgatggctgactaggccatcttctgctcctcagggaaaacactcatacacattatttttttaaaaaaactaaaacaagaacaaaaagttttaagtaaaatgtgagactgctccccattctgcagaaaggcacataggcatatagccatttatctccttttttactatctccctttctctcacactgtgtgtgtgtgtgtgtgtgtgtgtgtgtgccactaaaaaagcagaggccaaaaggcagtttgtcatggaattggaataaaaatcattaaacagtacaaggacagaaagccattaaaggtgttactgagcccaggaaatgtaggcacttgactgaagctccatatcattgtggacctgcatagacatgaaaacacttactcagaagagataaaagccctgcctaccaaatgctttcctggatggctgtcacctctgaagaacttgctaccctagtagtaggaagcttggagaacattgtcacagtcacaaagttagaagttagagaggagctggcctaacttaacaagagttttttccaaagatctttatgtccattcaccacatcacaaacatatctagaatgagaaaagccaaaccagccaggctatgctggtgtacacctttaattgcagcacttaggaggcagaggcaggcaaatccctatagagatcaaggtcagccagggtctatagagtgagttccaagacagctagggttacctgagtaaccatgtctcaaagaaggcgaaaaaaagatgacgaagaaaggaaggaaagaaaggaaggaaggaagggagggaggtcggtcaagaacaggcaagaaaaaggaaatcctgttttacttcctccttcagagaactgaaatcttgggagcttggggaaattccaccaaggacactacatgggtcaggggtgaatcactggctgacagctgtcctaaagggatgctgagtggtgatacaaataggagtacttgtattgtagtcctgtttatatgctgtacaacagtggtgaccctagagttagttacaccatggagcagcacagccttgctcagagaagctggtctctaaataaatatctgaaaaggaccatgatggatgaaatcgtgcactagaaaaacataaatcaatggttctgtgtgcaggttattctgtcctccatagacatttctggttgtcactagttgccactgaaatctcaatggagacaccaagatgctataaaataacaagtactgggcaccctgttccctaccaaagaactatacaaataccaattgtgctaaagtcattggatattgatataagacatatctacatatataatatttataaatttatgaccattaaaagccagtgtttacatgccagcaatacaaagagttgcattagtaccaccaaacccaaaggaattggtgagtccaatacaccgaccctcagctttccattcctgtgactccagtggaacataattgagatcaaattcaggctctgtacaatccaggtttaaagttggtgggagtttctggtggtaacaagccagtgcagtaaaagttgcctcaactgcccctgcagcacccagaagatgcccagtggctccctttgtggaggatatggcaagggcacaagcatggtccctaaagagcctcttgatggctctgttctcagcggcatcacccagtggtgtggaagtggcatgtgcgttgacataggatatctgctcaggtgatacgcctgcatcttttacagcagcagccatgcatctggtaagagaagaaaattatcaaataaagtttaataacaggagattgttcatctgagtagcttgtataagatcagtgtcacagcaaagaccctatgatccacaaagctaaaagtagctagtttttgtccctttataggaaagcctgctaaacttctggctgatttaattggataaaacataatacagtttaagcttagatggcatcatataatcaaggactttttttcaaagtgtggtctttagactggagctagttagaaatgtagagtcttaagcatcaatctagatccgcagtcagaactggcatgttaacaagactcctgggtgattaagggctaagaaatgctgctttgaaaagatttgaaaagaacagaatatacctagacacatctatctctattctccaggtctgataagtgttcagagggaggctgaggaagggagcacactcatgatttccaaacagaaggtggggtataagaagctagcaaagacacaactctattggctctaaagtccattcaatttttgtttaaatattttcaaatgttttcaatcatttcaagcaaagaatttttaaaaagcctttgatctaagagaatatatactatacaccaagaccaggtaatgtttttttaatttgaagttccaatagtgccttaatatagtatcttaagaggaaaatatattttgaacagaacaaccgttctttaccttaaagcaccttctccttcgggatcgggggcagttatgtgaccggcatcacccgagagtccataacccaaaatttctgcgtagatccgagctcctctctgaacagcatgctcatgttcttccagcaccagcacagcagctccctcacccatgacaaaaccatctctctctggatgaaatggccggcaggctagcttaggatctgggtttgagctcagagcccgggctctggaaaacccagcgagagataatggactaatgcaagagtctgtgcccccagccaccatcacatctgcgtcaccatgggctatgaatctaaaggagtctcccacagcatgtgcacctgtggtgcaggctgtggacactgagtgattggggcccttgagtttgtagcgaatgctaacctggcctgcagccatattgatcagaatcttagggacaaagaatgggctgactttattataacctttggtctgaaacagcaaagcagtttcagaaataacttcaagaggaaccatgcccatgccaatggcaacgccagtagccacctgatctgcttctcgtttcggatgccagccggagtctttcagggccaactctgctgccccaacagccatgatggtggaagaagacatggacttggcatctgatttggacacaaagttttcttcattaaactgaccttcatgtggacctcttggtacataagcagctacactgcaagggatattcttgtactcatcaccaaccacagaaacaattccactttctcctcggagaagccgatcccaaactagttgagtcccaacgccaagtggtgtcactaggccaatgcctgtgatgacaactcgtctgcgcaacatggctgctggcacagttccataaaatctgtgtttgcttattaaccaagaatatgacgctggatatggatgggagattgtggcttttagaaaatgttgcaagcattttgacaacatggttgaaattcagaagatcagaaacacattcctggaatagaccacaagagacagcaagcatcatttaaacgacagtagaatcttacacacaccctaggtgtgagtgtggtcacagagaaatgcaaccctcgcttggacttaacttttatttgtaatcgatgaggtccttcagactgtcaactgatagctagctcactgggttttacaatgccaacccaccctacagggggcatccttcttcaggctcaccgaagattactgtacagtgtggactgagtccatgtggcatttctaagattaatgcacaggaggccgcctcaggcccattctgcgttgtgcactttatctacttccgtgtagggcagataacctttcaggcggtcccgccacagcccagcaccgccgtgttaggaaggccgggtgtaacttcccgagctcagcgttaggagctctcagggattcacagccacgcgacgccctccacccctaccctgaaacccgggtgcacactgcagtcactacctgaaacaagcctttgtgggcgcccaccgagtgcgcatgcgcactcatccgcagcgcagcgtttccgcccggtgcctgacgtcagaggtcagacgctccggccagagcttcctccgggttccgggttgtgagtgccccgctctagcctcagagcctgttttgatcgcttgggaaacctcacctagtcaacagcgataatgcctagatattcctgtgctgccagagaagggcggctgtcatttccccaggacattccggggaggacctatagcggtagcctccctggtagctctgtagaaaatattcatagaactcttcagaatgtcaccaagaaaccgaggtcgtttggggaaacatctaaatgccacgtagacaataaaataatactatggctgaatacttagaaatgtgcaaagacgttgagaatttgttaggagacgttagttacaaaacttttaaaggtttgcaaagagatcagataatggtaccgcgcaatttcagcacctgggcggcagaggatcaggagctctgtcctcagctgtggagagagtgcaaagggagcctgggctaccatcctgaagactttgtctttaaaatataacaaaacctaacgtctgtagtgatctgcagtgcttatggtgtcccctctacctccatttttccttacctttatttaccttagcaaatgatgtaaacagctacttctgtaacaataaaaaagggctgactcatgacaggaagtgaccagaagattgcccaatatctgaagtggaaattcctgagcttacgaaagttttacttgctcagagataaatctgtaatggataagtaggataagtagcaacacagccaggggatgtctattaactgttcaagtctgtcccacgtgtgagctttgctttttcttcagataaaggatagactatgctatcttgtagtcatgattatatattttcttgtgggcaataacctcttcaggccatcgttgccacgtatgctagctttccaaatgtagaaaagaatctgaggtaagtttagctatttcctcattactcctggatatgatttattgtctactctgtctaaaatgtttaagaaaattcaacttgttcctgatccagtagctcaccatttgcttagtatgatctccctgcagtgaaaattgtgctgtttcctccagtaccttttggcaatttgttttacatacaaatttctgatctcaaaaggcattggggtatgtggactgtggaaggttagctgaaaggggaactctgtctatgcagccatggaaaagtcatgtcatcatccatgctgcagtgaaactttctggcggtgcagatgccctgggcacttactcctgtaaggaacccttcacccatgctctgaaggtaagctgaataaacttagagtgccctaagtcggacctggggattttgctttgatttattgttgttgctttataaagaggctgggtatttgtttacatcttcccagggaaagaattgttctcaaaacaatgcacccacataaaacgtgatataacaagaccataatgtatatttatatttctctctgtgatcattttacttccatctggaaagggttaagaagtttttaaaatcataataacagctatatgtgaattattaccgtattgtttgctaaaatatcatggtgtattcatgaatacaaatcttcaacttggttttgcttatcattgcctcctcttattatttctctggttcaaagctttatttccaaatacagttctcaattaaataaactttctatccaaacaattaaacttctgtttgtaatattattttagcacaaaggagaccaaggtcagtgctatctcattaagtcatgaaatgcttcaaagaagtggacctagacttcaatctgtaaactgggtgaatacatgtgtagtaactgaggggaaggcaagcatttcaacagacagtagtacaatacggacaaaacaccaggcctttggggccagtgccaaatttgagaagctggacttagtagataaagttatcttccactaagctttatagcttgataacctgaattccatatctctctctctctctctctctctctctctctctctgtgtgtgtgtgtgtgtgtattttggtttgggtttgtttttttttttttgtcattgttgttattgttgttgttctttgctctgtttttttctttttccaagacaggttttactgtgtagccctggctgtcctggaactcactctgtggaccaggctggcctcagtgtcacagagatccatctgcccctgcctccaagggtctggattaaaggtgtgcatcatcacggctcagccattgaggcttgcaaccatttccagaactcttaacagtggaagataaaaaaccaactcccagaaattgtcctttgatctccaaatgccatggtaagggcatgtgtatgcacttgctacacacacacacacacacacacacacacacacacacacaaataaaaatgaggtgtgggagaaatggctcagaggcaaagggatatttccagaaggttatggcgacagcatatcagcagacagcaagcatggtggctataggaagaaatggaaagttcacatcctttaccacaagcatgaagccaagagagcaaacaaaggtgttttctctactactttcagtgacatacttcttccagcaagatgtgccacctaactattcccaaactgaactactgactggaaaccatgagttcaaatactagagcctgtaggaaatatttccattcaaaccaccacactctactccccggtcttcatagatgccctggagtctttcacagtcttaatactgtttaaaagcccaaagtctcttctaagatgcaaagcatcacagaattcaaccttcagtaaaataaaaaggcaaatcacatatttccaatatatggcacagattgccatcccaaaaggtccaagtggggaataagaacataatggaccaaactatgactagaatccagcaggacaaaacaccaaatcctgtagcttcgtgtcttctgttaagggctccacacctccagctttcctgccagtagcctgcatctctctcttaggctggtccttctctattgacctccttggcagctttctcatagcgttgatatctccaacatcttgtggtctccactggaacccaagcttccctttcacagctctacaaaatggcctatcatgactcttattctctcagtatcttcatgcagagaattccataccacatgttgcctggcctcagaggctctcagaagccacagaggtaggatctgtgacacttcattcttgtatccttcaagtctaaacctggcactgtggctgccagccaggaatggggtcacttgaatcacattagcagcaatactttttcattcagtaactttctgggatcagaaaagactttaggctattgtacaagctggaagttttgctgagtgaggtcttggctagagagtaccctttacctttgttccagtacaaggcaaacttctcaactatgtgaaacatcctctctctagcacatgccttggctgtagtgttaagctccctagatctccttttctctacaaacagtacaatttatcttgttttctagcccaagtcttcccaaagccttctataaatattcccctagccccacaaaataaaaccacatggtcaagttcatcccagcaatatcccactctcttagtactcgtttctgtcagtcaggagtttgcatgttggtactccttttccctgaactgggagtaatccagggaaatgagcccctaccaatcccagttgtagatatgatagctgcccaacataagagggcagttcaggtcatgccactcttggtcgctttagaaatagcagctggtactagaattgcaggaataacgacttccataacacaatatgataaatttacttccaagctcagcacaagttttcaaaaaatatctgaaaccatgcttaccctagttttctattgctgtgataaaacaccacaaccaaggcaacttataaaaccatttactttggcttatgggtacaaaggttagagtgcgtgatggcagaactgcatggcagcaggcatggcagccagagaaggaaattgaatactcacatcctttaccacaagcacaagcagagggagtaacctggacatagggcagaagcatgtaatctcaaaacctaactgcctccccataatgcacttttcctaacaaggctgcaccagctggcctgcctgtatcctttatatactgggattacaaggatcagtcaacactcacagcaaatagctgggaatacagcatttgaagttgggccacaaacataattattactttgttatggaccagaaaaaaaaatgctagtagttagccactgaaaaatttaaacaacagctaataacatactttgttgaacataatattctctttctaagacttattctttcaaagtctcatagatatacaatgttctttggccacagtccatccattatctctcttccatcacctttgccctcccctttaacccccctttccctcatctgcctccttctttcatgtctttggtggtggtggtagtagtgatatatgtatgtatgtatgtatgtatgtatgtatgtatatttgattctcctgcctctaccttccaagttttgggatttgccaacatgcctagctgaaaacaatattcttgaagttggtctacaaacctaagtgctaaaaatgtaggtatattttacagatgaatattcagaagttcttgaaaattctccgaagaaattgcccagaaacattaaaaaacaacaaataataaagtgtcaaacgaggtcacataagtaaatatctttaaaacacaaagccaacaagtacctgctacgtgctagtgattcatatatgtaattccagctattcaaggtgagtggagcatggaaaactcctgactacaaatcaaggtcaagtgcactctttgtggcatttcaacattaaaaagtaataaaaaagccaggtagtggtagacaagcctttaattccagtactcaggaggcagtgatcaggtggatctgagttcaagctgatctatagctggagttccactttacccagaactatgcagagaaaccctcttctgaagaagaaaaagaagtaatgaggactgagtatgaagctcagtgctggagccaatttccagggttgatgtcagtgacaagggcatcagctaaggaggttagtgattccctttctaagataaattaaggatactggtaagggatatgccagtatgagtcaaaggatacaatgtgtatataaactttatttacttgtttgttcctcattttattctatttttgtatatgggttttatgcgagtatccataggacactcccaaaatgctccttgcatcagaatcataccttgtgagcaacaactgagttttcatcaacagaattcggaaaatacacaaatcagaaacccagaagagttctgagctatgctctgtttttgaagccggacactagtaaccaaagggcaagactgcagtaaattcccctgtgagcccagcctaggccacagaccatgatcacttttcccttccccataaccgcccccaccccaccccaccccccaaaaaaaagacataacaaaaacttgctcggtcttctggagtcttttcttccacaaaagacttttatctaccgtaaaaagaaggctgtgcaattatctctgggaccctacccgacacaagcagccaccacagctcgagatctactccactggctcggccccttgtaccccgtaccccaacgttcgcaaccggcctctccgcggctcgccccgcccctagcccctcccggaacgccccgcccctcggctcctcgccccgccctctggccgcaggcctctgaggcggcctaggcgctcctcagcgcctgctcagtgcgggccgcggtgcgcgaggtggcgaaggccgcggcgcagccatggcgtcggccacactgggcagctcgtcgagctctgcgtccccggccgtggccgagctatgccagaacaccccggagacctttctggaggcctccaagctgctgctcacctacgccgacaacatcctgaggtgcagccggggccctcgagcctgagggccgcaggcgggcggggccgcggacactcgggcctgaggcggggcgggctgggcgacgagggcccgccgaggctgtcactgagtttgacagctgtgctgtcccatgtcgctgcaggatcccggcgctgtggctcagcccgagtgccagttaaacgttcacgccgagtttggcggttgacacatttatagtttaagttacgaactttgtgtcaagtcacctttgtactgagtgcagcactttccacaactggctgggagtttgagtcagcacctcccatggccgctccggtcaaagagtgtggggaagggatgcggaggggcagacagtggaggtcacttcagttgagcccctgggcgctggctcttacaaacacaccgacccgaagtctgtaggaattcttagtttaaaggctgtacagttcatgcggaccagctttagagagttagttgttagagacattgaggtgttgtcctgtaccccaaactggcatggaacttgatctgtaccccagaactcatgccagtcacgacctaccaaaagctgagattacaggtgtgtgccaccacaaccataattcttcatttaggtgacattagtgatatttaaaataaattgaaaagggaatataatgtgattctatgccagatgttatgcagcatttgggcttgcacataattgtgacttgtgtgaagatggccttcctcctttatgacacctcagcttaaccctgagatctcacagcacctcagagtacaaggtgtctgaaagaactcataagcttgattctccagagcccacagctggcgtttcatactgaattgtttaagtcttcaacctcccacccccatacataagagaaggatggatttgtaaagacatttcgattcttttagtacaatgaaaccaaagatgctaagatcagagtactttgaaagatagctttgcatgcagacagttatttcggatcatgaccatcattatgaatatttactaaatttcttaaagaaactggttcattttacagcctttactgtggcttacatttctgatcttggagtttttgttttataaaggaaattagagcagtttgtaagagaaatgattcaggttgatgtgagaaaatgctcctttagtttgttttcaacaagtgtccttgtgttcttagaattcaaggtctggcttggttgggagatgatatcctgcttcttcatgtccaaatccagtgacttcttaactcttaaggaaaagctccatgtcttcctggtccctgaccgcacattataattatacttctgtaatttggtagagaaaatcaggttcctctttgcattgctattttcttttaaacccactagtgccatagtggaggcactattgaaggcatattgtcccagcatctcatttgcctcagtatcagaacaatttatagaatggatatgcaaataaaaatgcattagcttgttttgaagtagatacttgtcactgaaatctacaatgaaataatactcttaaatttctgcttgaatatttatcatatcctaacagtaataaatctaaataagctccaaaagaaatgtgtgctaatttgtatgcaaaagctgccacccattttagataagatgagcttactatggactttatcaagagcaaaacaaagcaactctgtattagttttcctgacatcacaggtgagctgcttagctaatttgattcatgaaccagagtttggtttagaacttttcatgtacctaagaataatgttgaacttcttatcctcctacctacacctctaagttacaggtgtgggctaccacaattgctgttatgagctgccacagattgagccagggctcaatgaatgggaggcaagcactctaccatctaaatggatcccctgtccctagttcatttattctttaatataaatatttgatattgtactgttttgtttacaaagcacacatagtgtttgactattaactgtactgagtgaagaaccaagaatcaaacatagtttctttgttcaaataatataaatgtatttgggagaagaaaggtttgaaaaacagctacagtgtaacatcaaagaacaattccaagacagtgttaatgtctctgtctttatatttttatgttaggaggtagtagggagaccaaacatgagacatttagtgaagggataggcaaaggtgactcacagtttctacagtggagtttccgggaggaaaccattagaagaaacaggcattgattatgaagtcactgcataatcataacaataaacccaatggaatggagaaagagaattttcaatgacaatgcaagaagtaatagaagacaaaaaacttctaatttttaatgtaggttgccactgacacgtagagaaattgagtgtaattgaaagttggtgagtctgctggcagcttgtgtggtggtatatgtataaacattttaaccagagcagtaagtttcaattttagtcaactattttaagtgtcattataggcaatttacatataatttccaagtttaagtttaccttataaaaggaagaaaaatactctattctaggactacccaacataaatgacctggcacatatatcgcaactactgaggtggttgctattattattatttctattaaattaggtgaaaagtttggtggagtgtttgactaagtttgttctttgaaatttcatgtctgtagcccattgtttattcttcatctctttccctgtcaccatcccctctagtgtacaaattcctcccacatgcaattatttttgtaatgttttgtcttgtgccctacagtgggggttttgtggtttttttggtgtttgagaattgttttttgttattgaaacagttccgtcgtttggcatgttgggattataggtatacactactgtaccttgataagtagtcagtgtttgctcaaaagaaaagtggatgctagaggaggggccagtggtagttctgtatccttcctaaggcagagctgtttcagaaaaagtgggagggagaatgtgactttccgtaactaattcaaatacaaaggcaaatattatttttctgaaaattaaatagtttggtagataactatgagagtaaaacaccaaaaaagacaaaaatattttcaaagataaagttgagcacagtacaagaaattctgctgccttctcaagattctatccttttaacatcatgaaaaactacatattcagaaaaatgtcccaagaaaagatacaagataattgctaaaaagtgaagtaaatattacaacttacaaaagtatttagtaggtaacagagatggatgggggaagcatcaaagcatgacaacaaaaacaaaaaactgtacagagaaaattaagttgatagagaatcaagcaaaattcaattcaatgcccaggataccatagaaaggcagggctgactttgggcttagtctatgcttgaactcaagcaagtctgcttagcatttttaatttaaaaatgggttaaacattcatagcaactaagatctgaaacaggggattgtgagtttgaggtgaaacaagccaaaggaagatagagagggacctgggaactgggtatgcccgtctctgctgggctttgctatggcatgacagaacccagtaagtagcatgcagcggccatggggagcctgagaagctgtgaggtgggcagcacatcttcagctttaactgggtatgccatggggatagctgatgtgcatcatgacaagtcatctgtggttagcattgacacatgctaggctcattttgtactttagattttgtttaagtggtgtctcagggaaaacagggatgttgagtattctgtggtgcatagggagtctcccctcagctgtggtctacatttcatgggggtcaagactgagaaactctgcccctaatacatagtaaatgtagagaaggtaaacactcccaagctgccagcaatcaatgcttgcttctgaaatcattggtgaaaagattttttttaatttccacttttttgtggacctacaaattttatagaacacagtgaaaatctcatagtattatcaagttattataaaagttattgaacacacagtattggaattgttgtgggaaggagtttgtagaccaacactaacgtatgacagttaaacagtaatatttagagctttgtctttgaatatttgtggttttgttttattttattactgtcatggtttgtatatacttggactagggagtggcaccatttataggtgtggccttgttggaataggtgtgacctagtcggagtaggtgtgtcactgtgggtgtgggcttaagaccctcaccctagttgcctggaagtcagtcttccactggcagcctttggatgaagacatagaactctcaactctcagctcagcctgtgccaggcctgcctggatgctgctatgctcccaccttgatgataatggactgaacctctgaacctgtaaggcagccccaattaaatgttgttttttttataagactttccttggtcacagtgtgtgtctgttcacagcagtaaaaccctaagacaattaccttatttcctttccaaaaacattttaaaacaaggtagaaacttacagtaaagacagtccttggtacagggaggaaaggaagctaagtgaccactaaggttcattatgctggaagcaaagcttttcagctgtttcaactcacaaatgcttcttaaacacagtcgttgtaccctgagcaccattatagatgacaggacccctcagagcaagcagacacggtgctaccctctgtctggggcgacttctagaaacttaaaagactaaaaaggtacttatctgtaacagccacacagtttcctatggcaacaatgatactgtcatccatgaagttggacagcacaagtactcagtggtactgaagtatacgaatcatgacgtgtgaatgatcgtctcgactgctcattccttatagttggaatttatactaccatgtgtagaaggacagctgagaggaaaggtgaaagaaacatatataaactcttaaaaagatgagtggtggtatattgcccattatgttatctttttttcttttttttaatcagaaaccccagtgatgaaaaatacagatccatccgtattgggaacacagcgttttctactagactcttgcctgtcagaggagctgttgagtgtttatttgaaatgggctttgaagaggtaagtatttgaaaggtcccctccccattctttatgtgcaaagcaaacagtactgactgtgaatagttgtttgaatgacatttttttaatatatttttttaagatctatttatttagtgtatatgagtacacattagctgccttcagacacaccagaagagggcatcggattccattacagatggttgttggccaacatgtggttgctgggaattaaactcaggacctctgggagagcagccagtactctttactgctgagccatctctacccaacccccctgaatgacattttttttaaattaattggtcattttggaaatgtgtataattatttgttgttgtttttttaacatcttagatatttttaaagtataatgaagtcaggataaagtgtaacgagtctctatagattcttaaaaatctcaaagtttagaataaagagcatgaagtacaacccaaggatcaaatgcggccccttcagtcttccagcagcatacttgattgatctatctgtgagtgtgcattgaatactacagtatcaccactgtccagtaagaagtagaaaaagtaaaatacggaaaagtcactcgcctcacagaatgcttttctcctgcaacagtaatctcaagatggtgtaccatttgatttcccaagaagagtttggtgtttccatcctctcaaaccttgtggcacagtttactattatagtacagtaaatgtcattattaaagttgtgaattttagccaggcatacttatacatcctgtagtcttatcttcttgggaagctgaggctggaggacatgagttcagggcagcctattacataatgtaaaatggacagacagacagactgaggattttgaatcttctatgtacccctatttctggtgtataggatatttttttaaaagttgagcaggaatacaggtgccatttgtagatgttgttaaagaaataggatataggggttttttcctgtctaccattgcgaaccaaattctgatgcacaccgtgaagattaacagtgaagtaagttaatatctcacccacagcttatgttctaataggttagaaaacaggaaagagaccacaagacatgattctgcactcacagaaattagagttgcagctgctgtagcagtgaagtgaccacagaaggcctctgaggtggtaaagggtaggacctgagtggcaagaaacccctcaggttcctgaaactcagttcatacaggggattggcttgggcaaagggcttctagctgcagtagttttgacctgggaaatagctttatgtatagacaaagaccagaccacatcaggtaaacacttagactgttaacattaattaatcttggttatcagtttgattagattgattaaacatctgggagattggtaaaacgtacttcttatctcagggattacagaacaggaggtctatgactaaatgaatgatttaatctcttgagggattcaacctttgacttgattaattagaactatggagatggtggcctctgtggaggaagtagctctctagagaaatatgtttggatgctatttcttacgctgaccacatcctgtcttcctagaaagggtgcctcctccactggtcccaccatcatgatattctgcctggctgtgggctcagaaacatgttgccaagtgactcactccctagtcactcagccttctgaacctgagccaaaattaatccttcatcttttaaattgtttatgtcagctattttctcaaagagacaagaaaaggaactagtattgacaccactggaaagtttaaagaatggaagacaatttccaaatattatttcagttattgtaaagagaatattctggataatctagagtgtaggcaagggatgatacagagaaaccacttggcttcttacactggtctaagatggcatggcagtggttatatatatttctgaagaacctttgtttgtttgctccaatgttcctagttccgagagtattgctattacagcacagttagtaggctataaacagttgctaaacaaagcactgatgacatagagacaagatgtaaatggattcaagaattgtgtgtgtatacatgggcagaggaatgaattggtcttgaatttaacatctgtacaaggggaaagggagaaatttctgacagaataggtttaggtttcagacactaagtaaacaggagtaccactaattaagatgaaaaaatcttgtaaagtggcagtttttatgggagaaagcactgcctgactttttgacagtttgggctactttactattgaatacttttgaagtaaaaatatttcttagtggaataagatgagcccacagctcaaatgagacctggccaggattataaattgtggtatcatctgattgcaggttccatataaacatcagaatatggagaatttcagactatagagtggtaaaaatgagagcactgctgattctttgcaaggagatgaagataaaactagacaggaaaacttagtttttggtttttaaaagccatatcagtttctcattgttgaagtcatggaatccaggggataatatttgtcttttttgtaacaaatatttgttttgctaggtagggtaaccctctgatctaatttgcccagaaaatgccccagtgtcaggcattcatcatggttggtttcctccatgccagataacaaattgttccaagacttggaatagtatttgatgtgagttacagtgttctgataaaatgatactatatttgcttctttggccatctttagatttcacactttaagacagaccagaagcaactgtttcatccatgtaactaagctgtgtgatggactgatagagctgaaaatgtactgggagttttggtaggcttttacgttggaagatatatctaaaatttaccctgaaatttaccagtatatattaaaatcctgagcattatgagtgaggttgaggaagaatgggatccaaatgactttgtgaccctgaagtttattgtagcagggcagttctcagctgggagccacacctgtcttcctgctgcgtcccctctcccaggcttcagtagggatgaagcaaggcagtttttcagaacaatttgggttgtttggttttctgaaacacattgctgtcatttagttgtcatgggacaatgagaattgtcatggaaaaatgttttgataagcagatttgttgaatcttagaatccctaatttcttaaaacattcttggagctattatatttatcttataattttgaacttttatgaaaatgtgatgctttggttttgaacaagaacatgttggcctgtagataacagtttttaggattggttagaggagaaggcaaggcacctgctctcctgggctcaggaggtgtggtaacagcttttagtcacattacagtttgtagagttactgtttgccacagctgcttctcaactcctcggaacttgattgggtatattttcatatcacctggtctcttggtttataatttactattttaaattagttttatattaaagctgtctgtgctgcagataagcacttaaccgctctcaacaaatattgcttatttagatgtattttgttagaagccttattaatactgtatatctgtgttgggggagcagcaacagggattggggcagtggccggtgctggaaagacagcccagctgttaaaggcagttgctgcttattcagagggcctaattttgcttctcatcacccacatacagtagctcaccaaggcctgtaactccaggagatccagtgacctctaagggtctttgtgagtatccacactcacatgcatacacacagatgcataaataaaattatttttaaaaatgcatcttagccagccgtggtggcgcacacctttaatcccagcactcgggaggcagaggcaggaggatttctgagttcaaggccagcctggtctacagagtgagttccaggacagccagtgctacacagagaaaccctgtctcaaaaaaccaaataataaataaataaataaataaaaaataaaaatgcatctttaagaaaatattctgtagtactaggcattgtggcacattctttgaatcaggaggcagaggcaggcagatctctgtgaatttgttgcctacccaggctgtataataagttactgaccagccaaagctacacaatgaaaccctaaatttaaaaaaattaagaaatcagtctatagtttgggactaaaagtgtcacttagggtagaggacttgccttcattcatcttggaattctgctgcccagcattctgagtagctgggattacaggcctcagcctctcaactcaagccttttgtgtggcagcatttctaccatcaggactttgtatggaattttacagaaaataatagtactttattttatggcagagaatatacaaataaatacttttccactctcaccattttattctattttagtgtgtgcaagactcttagcaccacaataaaattttctatcaatgtatacttttaactgttttggggaaatggtgcccccagagaacacacttctgattatgtaactgttttctaaagacttgggttagaaattgttttataacttttataaaaatgttttacttaaaattgtataaatctaattattatatacaatttattaaacaaggtcaaggtaactggcattcatgtcatctcagacatacatagtttctttgggaacgttgaaaatactattgactattttgagatagtcaattgtcaaccatatttgtcttagtatgtgttacataacctcttactggttttattaagactttctttttgttgtgcttttgtttttaaactgtattgtgagaccatcttactaacttgcgtaggcctttattgatcttggaattttgctgcccagcatcctgagaagctgggattataagcctcagcctcttggctcaagccttttccatggcagtatttctaacattactttgcatggaattaatagaaaatgatagtattttattttttgcagaggatataggaatatatattttggtgctcgtatgctatattgtaaagtgttacaattttctaaagctttcctaaggctagggatatagttcagttggtggagcactgctgccccagcactacatagactggacttggtggcacacttaggaaatagaaggaggaaggccaggaagttcaaggtcaccctcagctggagaacaaatccatggctggcctgggatataggacacctgtctcaaaaaacaataaataaaggtccctggattacatcaaatatgccaagctttatatactaataaggaaacacattttcttttagtttaaaaactagcatatttgttgatatatgatacatttaaggagggagagatggtgccatggttaaaagtactgtctgctcttccaaataactagagtttgactcccagcacccaaatagcagctcaaaaacatgtgtaatggcaactccagtgaagcagacacttctctgtcttctctggcaccatacacacacagtgcacaacacatacacatgcacacacacacacacacacatatatatatatatatgcaaaatacccatacacataagagcatattttttaaatatatgatatactcaacagtatcaataccactgtatataagagtgactgtcactttaaagcagaaattaagatttttctcacttctgtaaattccagggagaaacgcatcttatctttcctaaaaaagcttcagtggaacagctacagaaaatccgtgatctgattgccatagagagaagcagcagactggacggatccagtaagaaggtgcaattctctcagcacccggctgctgccaagcttcctctggagcagtctgaagatcctgctgggttaatacggcactcaggaaaccaaacagggcagctgccaagcctaccctctgctccaatggtactgtgaaaaccaacattccttacttttgtcagggttgaaacagcaaaagagaagcattcccaagtcatgtctcaaatggtcttgggtttagaactctaacatcgttaaatttgctaagaattttgaaaattgtcagagttgtagcaaatgcgagggaaatggccaccttcttttccttcttccttcagtttcttgcagacagcttctatgtatcctggctgaccttcaagccatgatgcacacatttcagcctcttgagtagtgggattatagttgtgtataaacatgctcagctgctgcatttacattttaaagtaaaacttgtgacatacttcttctgaaacaattaggttttgtttattacttataatctacttgttttctcagtatttaaatcagttacacaaatgagtatgtctttaacctcaaacaaatgaaattactgaacctgtgtgtattatggcaattagattaattggttgcctctattgtatttacacttgtaatctaaattttacctgctgccaatcttgatgggaatttaattcagttgctccaactattatatatatcttaaattaaaaaaatgtgttctttaggttttaagtaaatgataatctattaataaactgacaataaatacttaaactcagtgaaatttagttgttaacatgaagaactgaagtcaaggtttttgatgccttagcaggcactatattgataaatttaaatgatcccatttaaaatagctgtgtgtcttttcttggggagatacaaacaaatatcgactatatctcactagcagcagaccaagaaaatgagttcatccaagtctagcttgctgaactactgaatttattgggcttacttataggcttatgaagaatatgcaaacagctgcatcacagaaaaggtccacccggtgtgggtcatgggtgcactcctcccagaagctgcatagatggaatctgctttgaagttagctttctactcctcatttactctggtcattcctggcagcacatgcagctgggctaggtcttagaatccgccgggagaaagcagagtcttaggagagagtctgtattagttccttttctgttgctgtataaaacatgatgtctaagacaaatttatagacagggaggtttatttagagtttatgggtaaaagtgttagtgttcataatgacaaggtgggaggcatgcagcctgagagaatgtacattttgaactataatcaggaagcagaaagagggctgagaatggcatatatcttttgaaatgtcagcgcttgcctgcattgacacatttcctccaacaaggccatatacctcctaaacagccaaaggataccaacattagaggccaaatattcaaataaacgcccaagacttacgggtgacaacatctcattcaaaccaccacaggttctaatacccttcatactttttccttctgtgagggactagcccagtcttgtgaaggtttcccaaatgctggtcatcacagcttctgtgattctaagataacatgggccatgtcatacctagaggacaatattctctaacaatatgagatactttgtttgcaaaaactccttttgataaattttattagatattctcaattttcactgtcaagtttttctgctatttccatagtaattttatgaataacaagtttaaactcttatacagttattttaattttagtagtcaatatcctccatacagtaaaactttactagatcaattcttaaatccacccgtcatctattcaaattgcttaattctggatgcttgaagctcttttctttttctcatcctagaagaccccaagacgctcctttgaaaatattaaaggtgtaggtcctggccagctaagagacagatgtgtctcatcctttcttgtaatttgtattaagtaatagttcctggttgcttggttttgtttgtttgtttgtttggttggttggttggttggttggttggttggttggttttgtgaaagatttaactccttgaacgtctagagaaggtttaattcctctatccatactcatttgtgtctcctttgatttattatacctgtaagtacttcaagtctttgtttctcttttcctttgcttcatgcatttcattggtttatagtaataaattcagctacttcttagaaaggtaactgttgaatcatcaaacatacaggagccagcatatgtgaagtgaaagccatgaaaactctggagctttcagagtttgcttttagaaacagttattctctatgtagcgtttcacatcttcagtacaaagttgtcagttacagacagtagacctacttgactgacagggtataactccagtcatttcaccccttacaagtagtgtttagtgttttgtggtttttttggggtttattttgttgttttgtttttgttttattttgttttgtttttgttttgttttgttttgttttgttttgtttgagacaaggcctcacttgagccagattggctttaaactcactatcctcctacctccacccacaagatgctgaggttataggataggccacatttttcagtgtacattttacctgtaatagaatgttaaacataatataatcactgtctatttctaggttgtgtgcttctaaaataatatttcatgtatcaatcatgtaagaactaagtagaaaataataaatttaaaaaccctcctgtggattctcatatcccttccgtgtgtgtaagcagcccatcagacacagacttaggtctttatcggtttctagatactttgatacatatacagcgcctgactttacctttttttttaatggctttgaagttttctaattagagtgttagaatacattattttaaaatttcctactttcttttgtttaattagtgttaaaagtttaaaatgtccaatgctagcattttataaaaacttataaatattcctgaactaagtacttcattagtgttgttgctcaggagatctcttcctactttctgaatcatggtttgctcctaaccttgcagttcaggcattatgtaaggcataaataatgacagctttaagatactatcagtcaagataaactgcattattaccaaaagaacttctagagacatgtactattggtgggatagtatttatcaactccccctttgttcttacttctttatgaactttatgaaattctagtaatttatgaacatcttttggttgtctgtgaattactagaatgcaggtttttttgtaacctgagttgacctcaaacttggtgtgtagttaagagtgaccttcaacttcctatcctcctgttcccacatcccaagtgttgaggttaccaacaggcatctgcaatacattttacaaaatcagttttacttatctttatgtttgtgagcctatatgagttcaagtcaggagaaggcatcagatgccctgaaactggagttgctggcaactgagagttgctatgtaggtgctggaaactgaacccaggtactctgtaaaagcagtaagcactctaccactgagctatctctctggctctaaatatcatttcatttaaacttttaatcatcagtttctattctgtaggagaacttagcaattatttttaccatcatcattttgagtgttaataccaattgatatttataatgaactaacatcaaattgaaaaaacttagcttccattgaagataaataaattctagtaaactttgtaactgtttctgtagctatatcaagttagtttttaaagtttaagtcatgatgcatataaaattgttaggaatttttcataaattcttaaccactacaaattactgcctattttatataaggatatatttaagacaattatcataatttatggttattccattgaaattattaaataatacaataatgggaaaataaagtcacctacatatttgttcttattacaatattgggctgacagccaaggcttttcaagtgatagatgctatactactgagctatattctctctgagatcattaatttttaaatttatctgtctcataaaccaacaataaggcaatttcttaatctggatctgtttaataagagaagaaatctatttgggtatacgaattttaatgttcagtaatttgctagtctgccattcttaaatgtcaaacatacctttacatccttaagggcattacttcaattatgaaagatcctaatgtttgcacatttagtctctattaaaaatgatgaagctaggactggaaagattacttaataactaaaagcatgtattagtcttacactggttcccagtacccatatcagatggcctacaactatcagttactccagctctgtgggatccagtaagctcttctgtccccacaggcaccttccctcatgcatgtacccatgcactcacagccacacacaaggtaaaaatgcatcttttttgtgatggtgatgaatgtggtaggtgggacattaattatagcatccagaaggatcatgagttccaagataacctgagctacataggaagaccctgccaaaacaaataataagttatagtctgtttgagaccagctagggaagacaggaaaactgagactggtaaaactaaacactagaaattatatgtatgtaacatttcaatttttcttatcaaaaacacacacgtatgaaatgtaaagtctggaaaagcacatacacataaccataatcttctgaaaagtggtaacagtgtaggtgacatttacacctcttagtagttcgttgggtttctttttgcaacaatatatagctttcacacagaaaaatttctttttttgtaagaaatgttcattaattccaaaaagaattaaaactgccacttaaaatgtattattatacagaactttcatggttaagaataggttcccatcgagaagtcacaaatataaaggatggtgtgaaacgtggaaaagaactggtgggcttggagatggttgattcttttaggaagtgagggtggccatccagcatcactgatttgtcagaatcccgagcattgagctttcttacagagtcttcaacatctaacatcagagccaaaataactggaagtatgaatagtgcaagaaaccttcttggtcccaaacagatttcacattttaaacttccacttatactccaaataagttttcctgtgtcaggcaattaactcctgccttagcacatggttccccagctgctgtaattgccctgcaatcaacagccttctagttctatggtttaagcccccctttatgggccaatgagtatgtaatgagataaggtaagaaaataaagtttattgttgaagatcatttgagtgctatttaaactacaatgaatgaggtaatttccagatagaaagggataaattgaaaataaaaatactctaaatgagttcttgtcctctcagtaaatgaaaatctgcatttaggaaaaagacaccactttaaatgtatcattttaataagaattttttcaaataaaaatgaagagttttatataaattttgctttataataatttctgtttgtgtcagtcagcatgttctccctgttgaattttctactgttccattccttacaactgaacttgtgtttgctttcttcccaactattgaatatagctgttaactgggatctcatcctctgacactctggtctctcttctcaggaaggcttcttgtggcacttgtacctttcctaggcctgttctctcccgggtggcactggtatctcagatgctgctgctctcccatcctctcattgtctccatttctctcaaacacttgtctgacgtgtctccatcctttcattatgtaagatagggacgcgtattctgaatatattttgctttattcatgaatactgtgtacattatacaacaatgcagtgaaaactcacataattctaaaaattggaaatacattgcttactttctaactatgaacataaatctccattttacatagtactgataattttggatttgggggtgtaattttgttagcgctcatgatttgttgttgttgttgttgttgttggtacattatggtgcagagtttgctggtgaatgatgaagaagggaaggagtccatgttagactagaatgccctctcatttttgcctgtctaaaagcctccatacctataaatttgcttagccaggagcacgtgaaactgtaaccctgccacacatcatagacaccgtaggagcaggccgctcctctacttcctgccattcttgtttttcctctgagtacttctgcagctcatgggggagccacttctcatttaaatattaaccagtattataagttcatcgctttacatttttgactaagattgatggtagttctagcattttcttcccattgaaccattcggtacaattcatcagtgcctgcagtcagcccacgttaggtgccacttggactgcttggtcccttgtaacttattttccctatttctattattacaaactgttctgaaatctagagcctttgttctgctacatttcttcagctgtttttctttgttttagtcgggcttttgtatatcccaggctggctttggaactcactgtgtaaccaagagtaatcaactgagctgcctgcctctgccctccaagtctaatattgtggtctgtagcagcacacctggctgtaagggcttagctcagcctgttttcatttgatcgctcactattgactgcagctggtcatttcttgttgtaagttgttagctgctaatctagcttctcatgagaaaaatctacccatcattccttggtgcctcccatggtgggctgaatcttctaatatcaatttactttattaagacagtcccccacacaccacctacttcactgtatgttccctcattaagactctcccaaagtgattgtaggttatgtccagttatacatactagaaaagcactctatcaactgagctccatccttagccttctttggtacttaagaataaattgtttaacttaccatttaatttctagtatcctagtaaacaggggatcagtaaacatttatagaagtgtcgttggattcctgtacaccataggctacttgatctttgaggctgtggccttgtttgtttcagtcttaattacttttccagtgtctgattcattcacaaacagatatttgttaactcactgtggtggatctatgaatatatgatttattcttttcctttcctttgttcatttttttatttcttcattatatcttcctcttctttctcttcttccgtgtgtgtgtgtgtgtgtgtgtgtgtgtgtgtgtgtgtgttgtatgtaagtttgagatactgaggattatacctaggcttcatacatgctaggcaagtactgtaccactgaactctatgtcctcacctctttttacctgacacctgctgagacagggtgtcacctagttgtccactctggccttgaccctaacaattctctgacctgagcctttgcagtacctgggatgcaagcccgtgccactgatcttagctactatttctttcttgtacacatattccagtgcttaacacaatgcctggcatactacattcagtaatgatttgctaatccactcatatttactcttgattgctcttgttgagtagcacctgcctcctgattaatggtttctgtgttgtgatattttagaaagtatattaattttacccttctacataattagctaggttgtatataagttctatgttcctagtcatttttcatcagaatttcaaaccatgtgcttcatgtaaaataccatgactctctgccctgttctccatacacatttaatttttcttactgcttaaaggcttttagggtttcaataatttttacctactgctattcactgttgtagtctagttagttttccattcatcctagctcttcagctatgtgagatttgcttctgttatttctttaagatgtttctttttcccaaagatttacttatttatttttttatatatgactgctgtatcagcatgtatacctgcatgccagaagaaggcatcagatctcagtatagatggttgtgagccactatgtggttgctgggcattgaactcagaacctctggaagagcagtcaatgctcttaaccactgagccatctctccagctcccagccccctttgagatgtttctttttttccattgtttgtaattttttctagaattcctcctagattaggaaactgatttatcttgaatgcctgttctttttatacattactcttagaaaatgtcttagacttctgattgatctttctttgatgcatttattctgctgtttgatcataccagtggcttctttattttagtgtttaaacttttattactaagatctgtactacagctttttgaatactggtggttcccactttacagtctttaacttactggtttggtttgagttttctgtgttacagtagtatgaaagaaaggcagtgcacatccaggagaaaccatccctaaaaactaagtgtgttcgttgtcttcttggactggagatatatggcagacactttctagcaatgatgaacaggggcagtgagcttcacctccaccagtctcagcatcctaaggtccgcagtgtgctatgtcaccaatttcactcaaaatattgtcaacttgtgacacgttttccaggatataaccccattggaggaatgtctttatgatatgtgttctagtcttggaaatgtacttcttttcaatttcacctgtgttttccattatttcggtagggtttgcttttctgatactaattctaacacatttttcatttctcatggctcatgccagttttgtagacccctccatacctggcagagcctaggagctgccagctgcatttgtttccatcatctgtatggaagcacctggtatggacttgatgactaacctttctttcgcaactctaagcatgcagtgtcaagaggcaggcttttttggtgatgaaatgactaagaagaagaagcagtgttcctcctgtagaccctgcccatcctgttgttcagtctttagcttctcacaccttacagttattttggaaactttttcactttctgtcagcagtttggcaggtaggcatactgccttgctttccccctcttgtccatgcataaatctttcctcttttaggtatgtactgacgttctctgtctgataaaaccatgcctcctctgtgatgccctatgttccaagggtttaaagatgcactgctcagcgcactgtcttgttcagagcatatgagtggaaacacagtggaaaatagacaggccccgatcttagtattgtaaaggtatccatgtaattgtttttggtgaattcacatcatcttaatgaaatctgagaaccacagcattattatatcatttccgtagtattgcaaaaggctaactgtagtttttttttttcttcttaggttgttggtgattcaaccatcttaaaagttcttcagtccaacattcagcatgtgcagctctatgaaaaccctgtcctccaggagaaagcattgacttgtatcccagtcagtgaactaaaaagaaaagctcaagaaaagttattcagagctagaaagttagataaaggtagtggcttccataatgatttattgctaagtatgcatcattgctagatagtagtgcctttggctatatgtgcacactataaatacattacctacacctatgtggatttttaagaagcataacaataatggacatatatttgcttttttaaaaaagtattttgtggtaacagtaatgtagaaatcctcctatcctagcattttaagtatacagttcattctattgagtacttttctgctgctacatgacccgtatcactatcctcccttttgttatataaaatagaaaacctaccgaataaatggttatgccctgcccttccctaactccagctactgacaatcactgttctactctctgtctctgatcttgacagctctattgcatggaagtgcattgtgtttggcttatttgatttagtgtaatgtcttcaagacgtgttcatgttacaagatgctgtagagctgtcttctgttgtgagatagatgatgatccattatgtgtacatccgtgtcttgccttactagtcatctgttggtggacacatgtattgctttcatgtttagctcttatgctgctgtgaaaatggataaacagatatcactttgagacctagttataattatttggtattttaacttgaaggtgctaatatgctaattttattttatttttttggaggaattaccaaattttttcacagtgtctgttccccccccccttttttttttgccttcttatcagtggtgcacaggatttcagttcttatctctgtcagcagctattatatatacatatatataatgttttacatgttgatacctataaaatcacatatatttatattaatatatgtgataattacataaaacaaaatattttcatatatatacatatatgtacatatacatatatgtacatgtacacacacatatatatatatatatatacatacatatatatatatatataaaaccatgttaatagagctgaagtagcatctcagttttgatttgcctttccaataatgttgaacatcttttaatgggcatttgtatattgtccttggaaaatgtctatttaacatttctcttaaaagtatttttaatctggatatgaatttttataatgttggtatatgtatgtttatggggaagatagaactttatggaatatacagcaagtattatttgtatgtgttggtttttttattgtgctacagattgaaccctatgaattacatctgttggacaagtggtcctccatggaacttcacccacactctttggattttaaaacagggtctcagtgtatagcttggggctggcactgccttcatgatcttactgcgtctgcatctcattacaggcatgctccaccatctctagctgtagtgactctaacagaattcacccctaaaggtagacacaggttcactttgttattagatattatttattgatgcagaataattccacaacagttgcttttgtataagctcaggcttgctacttacactgagcatcccctctgcctctgtccctccatctggaaatacaaataattaaaagaacaaatgaattagtacatttaaacagcccagaacaatagttttgacctttataattgtttggtaacattaataagtctcaggattttagttgttagtatttttatgtccatagggtttttgctttttatgtaattgatttttatctagtcatcttattgttcagtactctgtttattagctcactggatgtttgggggaaaggggttgccatgttttataataagcattttttagtactgtatcttcagagtcctagtcacttgtgtgcactgcaggcaccttgtgaaaggcaccttgcctttattccccccacagtggtggtgctgaaatttatttcactgtcctacactgtgatgactcaggcagtgttgttatgtgttggatcaagattagggaaaggaatgttcttttttaaccttaatctgatctttccctgtgttcctcatttcttgatgtaaagttaagtttctaacatgtattattttcttttttcatattctgagatgagaaatatattgaagtgttttgattaacgtcctatttttcagtaactacactcccatttccatagtacccccagtctgaggataaaacccagggccttcagcaaacagactttcccagtgagaatactgttacctgtggggacaaagctgaggaagatgctaatgctagcaggtctcagtttattttgaatgtgactatgtcatgattactgttctagaaaacattaacattattaaagaaagcttaagattctctcacagtcaatcaatccttggtcccaccgtattgtgcaattcttcaaaattcattcttccaagtaattctatgaagaaagtagtttaatctgtgtggagtttattcaaagtttatcatctcatgtacatttagttcctttatacttttcattttcatatcaggaacatcttgttaggtgtctataaactgttgtagtgcagatgtatttaaacactgcactgcgtgtatatttaacttgcacagttccccatgcatgggcactgagatcactctctgttcttatttgtgctgaatgccatccactgaagtgctcgtgaaacctgcttcctgttgcttggacagattccctcttgccaatggcatgtggcattgtttcacagaaagagtatttgtccttctgatgttgacgttactttaagagggattattatcactgatttgtaggacagttttatgtgttctagattgatagtttcctttgctagacacattagaattttactactccctatctcaatgttctttgttaatttattaggtgtaccttctaaaattcagaagttttaaataacataattttccatttctggattctgtattattggtcgaatcatgcttttaagaaaaccttcgcaggctggggaaatggccgcacaaggatgaattcccgagcttgagtacccagaattcacaaagactgatgtagtggaatatatgtgtaatctgcactcctacaggaagatgggggatggagtcagtggacttcaagaagctcagttattccgaccatacaagttacaaaaggagatgctgactcaaacagtgtgagacgcaaggatcaacacctgagctcgccttctgtgtactgtgacacatccatacacatgtgcattgcacacacacatgcacatactagggaggccttctggggtccagttataagcatgctctcttgtaactcttaactactgtagtactatagagaaagacagacttcttacataaatgtattaacagtatcagatatctaggtaaccacttgtctcaacttaatgggtgacccattctcttaacatttctttgacatgacaattttgtcttggtgtttaatgttttttttttctatttaatgagtttgtttttggttttgagctactgttttcctgtatatctaggctagcctggactgcttttttgcctcagtctcctgcgtgcttaagattacaggcctgcaccattgcatgcatgccacctttatcaaatgccttttattcacttttaaactatcttttgactgatacagaagacctgtctcaaaaagaataaagaggtttgtctctcagtactctttcttttttcattgattttttataaatgatatttgattattaaaaatcagtaagttcatttactatgggctggagagatggctcagcggttaagagcactgactgttcttccgaaggtcttgagttcaaatcccagcaaccacatggtggctcacaaccatctgtaatgagatctggcgccctcttctggtgtgtctgaagacagctacagtgtacttaaaacatacaataaataaatcttaaaagaaaaaaataaataaataaataaaactttaaacatgcactattatcacagtgcattagtttttgagtaaaatgacagataaacctacgctgtgtagataatatacacagtgctgattatctcgtcaacagtagacaagaactcacttccatggtagttcttttttttaaatattttttattaggtattttcctcatttacatttccaatgctatcccaaaattcacccataccctgcccctgactcccctacccacccactcccactttttggccctgacattcccctgtactggggcatataaagtttgcaagtccaatgggcctctctttccagtgatggccgactaggccatcttttgatacatatgcagctagagtccagagctccggggtactggttagttcataatgttgttccacctataggattgcagatccctttagctccttgggtactttctctagctcctccattgggggccctgtgatccatccaatagctgactgtgaacatccacttctgtgtttgctaggccctggcatagcctcacaagagacagctatatcagggtcctttcagcaaaatcttgctagtgtatgcaatggtgtcagcgtttggaggttcattatgggatggatcactggacatggcagtctctagatggtccattctttcagctccaaactttgtctctgtaactccttccatgggtgttttgttcccagttctaagaaggggcaaagtgtccacactttggtctttgttcttcttgagtttcatgtgttttgcaaattgtatcttgtaccttgggtatcctaagtttctgggctaatatccacttatcagtgagcacatattgtgtgagttcttttgtgattgggttacctcactcaggatgatgccctccaggtccatccatttggctaggaatttcataaattcattctttttaatagctgagtagtactccattgtgtaaatgtgccacattttctgtatccattcctctgttgaggggcatctgggttctttccgtggtagttcttaaggagacctgtacgagctgttgtgtttgtttgctgtattggggcatgtattgcacatctcagacaagtgttccctgagctcagttgccagactctgttgcctattaggtaacatcttcttcttttcatataaattctgtagtaatagttttttgagaaaaattcttttataattttaattgagattatatttaattacaaaataatatggggattaacaaatttaaaaggaacaaactttctcggagatactatgtattgctgaactgtaggcacctccccatgcttttacatttgtgaaatatatcaaacaaagctaggagagaagggaatccagctgacccttggacagcatgggtttgaactatactggcccacctataaatgggtctataaattaaagtgtttttcatatgtcccatgcatatgcatcctaattcattttcccattggttctgtcttgctgtgcacacatgcatttttagagtgagcttgggttgtggtttatacttagaactaaagtttaaaagtgtagtttattaaaagttaactcacacaatctaggcttcagtggcaccagtcatacttaagaaattgaagcaaatataaagatgcaataatctatcctaactaaaactagccatagtattggtgtcagtgtcccagctcttctttataaggaaaggaatgagatggcattgatagccaagtgtgcagctgtgaagacctctttcatcatgttttactttttttgttttgttttgttttgttttggtggttttggttttggttttttgttttactttaatggtttgtattttaatacacttttcaagatttttaaattacttcatatctagacaagttgagatttttaacaacttaatgtaaatttactacttgattttaaaagagtaagtgcattgcaaatacctgtttctgaagggcttaaattactttttaagaaacagttttgcagagatcccattatatcctagtattgttaaagaatactatattatttcagacacctgtgatgaatagcagatgtattagataacactatactatgtgctttttcatagattttttatttcttttaatttcaaaacattaaatgtagagattaaggctggcaagatagcccagtgggacgggtaggcagggctgacaagatacctcagcaagttgagctatttgccagcatcctaacaagctgaggattttctctgaggacccacataagaagaaccaatttttacaagttgtcctcagatctgtacacaagcatactctggcacacatgagcatacacacacacacacacacacatccatgagtaaacgtaatttttaaaatagacaggaggtgatgttttattgataaattagacaaagtattttgtgtcatgcttacttgctggggctgttctgtacactctagatatgcttgggtgtttgtcttttgttgtgcatatccaagaataaattctattacacagttgaagcactgacaaaaaaaataatagatactggagaacattgtctgctcttacagaggagtacccagatagaagcttacgatcttctgtaagtctagttttgtgggatctgaaactaggcatttaggaaagacaccaatacacataaaagaaatctttaaaaagctaacagcatgatatttaccatatctggtattcagacatccacctataatttttttatcatttcatgtttacctatgcatatatccaataacaaatttaatatggccaaaattaatatttgatggtgctggtgacaaaactctggaccttgcacacatcaagcaagtgtgctaccacttaagctgtgcttctcaaaatcatatttttctatctcccttgtgttttatcggtcgattccatgttgacccccattccttgagacaatgccatgctctggtcagttgcatagcagagactgcagtagtcccttctgctgtaactgcagtcacacagcttactgtgtgtgtgttagccctgtccacagcatctaacagtccttacatattctttgtgaagacttttatcattttacactttcatatatttctgctcccagtctgagcatgaagtatataggaagttttgaattttgggggctttcaaccttaactggttctcttctaacttccaaggtactaatgtaagtgatgaggacttccttctactggagctcctacactggtttaaagaggagttttttcgctgggtgaataacattgtgtgcagcaaatgtggtggagagactagatctagagatgaggcattgctgcccaatgatgatgaactgaagtggggtgcaaagaatgtggagaatcattactgtgatgcctgccagttgagcaaccgcttcccaaggtgggtacctgccaagtgaggtgggggctctctcagtggaatagtaaacaaatttattattaaattagctttttaatctccatttttaactggacttgatatttctttaggacaaaagtctgcagactaaactggcagactagacccagccatatccacattctctggttttgtaggacacagccctctgacttatgggtcctgtgacagttttctggctgtcttttctgtctctccctcgtgtgtgtatatctgtgtcttgtgtagcccaggctgtcctggaacttctaatttttctgcctctaattgttgagtgctaagattgtaggcatgtatcacaatgtatccagtgctggggactaaacctctagctttgtgcatgttaggcaggcagtttatcagttgagctaatctccagtccttactgtctcctttatgcagtttgttgactgtatgaaagtgctgatgtatacagtgaaaatattagcgatagtgatgcctttaattaatcatcagatacgggggtaaaagtaagagcagaaattattttaattaggacttcctctgtcccagcctttcaaatctatctcaatctctgtatttttcttgtttatttggtttcatttgagactgagtcctgctgtatagttcaattatccttttacatatcaaaattgcacatgtgcacactaaacctcaataatcatatctccattttaaacttgggaaattaaaatttttcaatttacttttttcaacctgtagcttataagcttcatgttagattttcttaataggcaatagttacgaagtttagttctgttgcccagcaagaaaagatgccacatgtttgaaaagcctgttctggtggagtttagtactcagttttgtcttaacttggaaccagccctacattatacataaaagaatattatacccaatgctgatataaaaccagctttgttttgttgttcttcaacatacacttacacaacacctttacagtaccatacctagttaagtccctcttataaggctttttgtttgtttttccctaggcaacagaattaaactaacaatatagtatagattagtgctatttatggtatttatgcaaagtcattttataataatttcctgctttacttttagttgtctgtgcaaagttggagaataaacacatgggggtggggcggaggtgttttgttatgtttttctagttagcagagctagacctcgaggcctctgctttgctggtgcagtgcttcaccactgaggaattgctcttgctctactccatttgacttggcccaagaccagaatgctccagttcattaatatgccttaatgtaaccttgaatccctgttcagttagaatgctgaattcacttaagcttaagcaaagcagctgcttagccgacttttcaatgcagagccagttcattcattttcttccgggtctggagctagcctttctgcctagctagagcacaagacacacaccagcttttctcagtgcagagtaaaaatctcagtgctctctattcttgtgatacatttgtaattgaaataacttttgggagaatgctgcacacatcttgcttgtaaattagcaagcatttttaagtgggtccagaaattaatcaaaagtcattattaaaaagaaaactggaacttatactaagttaaaatatctgcatatgagtgaggcgtccagctatgtttacacacagggagaatgaagtcttgtcaaccattctctaccttattccagggagacaggtgtctaccaagccccaagaatcctgcctccatcacccacagcattggggttacaagtatgcatggtcacacccacagctctttacatgagtactggatccaaaatcagttccttatttttccacagcaagtgttcctaagcactgagccatctctccatccctaatccccacagccctcatttgggttttcaagtttggaagcagtgtctcatatagcacaggctagccttgaatgactttggattcctagtctcctcctcccttccaaaccctgggattatacatgtacatcttttttggtgatgggaattgaactgaagttccatgtatgatagtcaagtatcctaccctaaatccctgcccctgcccctacccctgccccttcccctgccccaagctaaaatccattgagtaatttttaaaggtaattacatagcaagcttatttacttgcaagagaaccattgaatatcttaatcacagtttttagaaaaactgcctatctaaatatttttagaatccagtcaagatgaaaactcccctgtccagctattctcctacatcttagctgttacatggcttgtaatactgattctggagtgtggcagtatgaataggctaatcagtgcatttaccttctttgaattggtagcacccatttttaattaagactaaaactgactgcatatagtaaactacactcattgaagacagttgtaccttttaagcatggttcacaaagactagcacagtaccttgtataggctgtgttttaagtcagtattttaaaataagacagtaaaagtcatgattggtgttttagcatacacgtgatttaagttctttaaaaatttgattttgatcatgaatcacagctctcgtctttttgttttttaaaacagatataacaaccccgagaaacttttggaaacaagatgtggacgctgtggtgaatgggccaattgttttactctgtgctgccgtgcattagggtttgaagctcgatatgtgtgggattacacaggtacagcgtgagtaggagagaagagacagaagagaggagctttgtaaacttgaagttgaggtttacagcctgagcccctcattttctctttttcatatcacctgagttctctgttaaccttctgtaaggtaacagcagtagcagcctcacaggagatctcaagactgtaacatttgtcccacagctgccccattcccagtgtctggactctatcctatcggtgacattaacagtaccttgttctgtgtgatgggaatgtgtgtagtaacgtgctatagagatcatgttaaaggattgctgtagttgatgtagtaagcctctactgcattctatagacactaaggaaaacttgtggacttgctcttcatttagaaaaaaactcatgtcaggttcgtgttgaaagtcgctttccctgttccagggttttccttgtttcccttgttgttttagaattagattaaaccttcagctgatagtcttctctcagaatcaaatatagagcctcaagcgctcaagggtgtttaaggcaggaggattgaaaccagcctgggtatccatttgcctactaaggagactccatttcaaaactaaatatagaccatgaataaccaggtctggagaggttcttgtttcagaagtcacatttattccttcacagcccactagttcggatgctcttctgaaagctttacctgccttagagtcacagcacacatcatttttagttaagacttaaactgactacattttaaatacaaatactgtataattatgtgtgccacaaaatgttcttgctaattaactcggtgttaagtattataagttagtttattatatgattcttagaggattacttatagttattagaagtcattcttgttttataaacttaacttctacttcccttttctttctcttctcccacatgagtagaccatgtttggacagaagtctattctccatctcagcagcggtggctacactgtgatgcatgtgaggatgtctgtgacaaacccctcctttatgaaataggatggggcaagaagctttcctatataatagcattctctaaagatgaggtaggacatcagagaaaatgcacaccttcaaagtgtacttgacatatgggccacatacattggtagggtgctgtttcttctgtcatttgtaaacaccataaagtcattggaatcagtgtgtcccctgtcggtgtccaagggatatttgtatccatttacgtatagatgaatagtgggtgagttagtttttaatcttaaattaagctgctgcaaacattcaggtatatacttgttttttcttgttgcctaggagtggaatggctgggtcattgtcagattattttgcaaagcagtggcaccattttattttcttaccagtagtacatgagatttgctagtttctccatatccttgccaaagtttagtgtggctttactatttttttttgagtcggtggtggggggaatattttctttattaacttttaaaatgttttcacctttccaggtctccccttcagaaacaccctatcccattccccctcctctgcctctgtgacggtgctcctccacccacccacccactcctgtccttgtcattccttaacactagccttgtggctttacttttttaagttcagccctgccaatgagagcatggttgtgctttccaagtgtgcttccctaatgacacagtgtcctgcctggagcatgagctaggtttcattttctaaacccgtgtctcttttcttctgagtctagaggtttcttttttttttttaagttcttatgtaagttgtttttagaattttgtgttgttaatatttgcctcgtgtgttctaaatggtaaaagaaaagaaatcagtcaaattctcttaaagattttgcttttacattatatggaagaaagctttgctgctccgtgacactgattttctcttattttctccttagagcgtgttatgttttagttagttgagacttgttttgagcatctacattactgagctgccctgcccaagatggctgaggaggctgggcttctctccttacttgtcctctctgtcagaattcgcttctgtagtcatgcagcaatgagggtaaagtttcatttggttagttctgcgatggcagcctctttacaatatgaaaatctaacattctgaaaatattttaacttatcactattttgttgaaaaaaattaaagtatattcttttcaatgtctttcactttcatttagttttactatggcttgtgaggctggccttgaactcacggatctgcctcagcctccttattcctggattatggtcgtaatctatcatgctcagcttttctttctttctttcttttttttaattgaacaataccctcaactctggtttttaaattctaacacaggatatttttcttagttacttgtaagagttccttgcattgtagctatttaaaaaataaagctattttttaaaaaaattaaaggaacattgtgatttttgttaaattgttgtgttctgtaactgattccaggtagttgatgtcacctggcgatactcttgtaaacatgatgaggtgatgtccaggaggaccaaggttaaagaagagttacttcgagaaactattaatgggcttaataagcaggtatgtagtggctgtcattttaaagaggacatttgaaattttacatatcaggaatagtccgttttaactctttatttacttattgagaaagatctcatgtatccttgacctcatgtgctaggataatatgtgcaacagcatgtctagtttttaaaaattacctttattccttaacaatttcctacagtacattttgatatttaccaccccacaagtatccccagattcaccttccctccctcacccccacctacatatcatctacatatcatatatttttttttttggtcctaatgtgtgctgcccaaatactcttggtttttcaagacagggtttctctgtatagcccttgctgtcctggaactcactttgtagaccaggctggccttgaactcagaaatccgcctgcctctgcctcctgattgttcttggtgggaggcctgacttggagcttgatctacaccaggtgtcacacccttcaggaaaactgtcttcaccccagcaattattaattaccagtagctccctagataatggtgggacttcatccctacctccctgcttcagtgctgggattttgccagcttgagtgtatgcacaagtcttgtgcatgctgccatgactactgtgagttttacatgtacagcttccctgctgtgtctggaaagcacgttaattgtagtcagtcagccacaagtggctcttacaaactttctgcccctcttcttcagtggcgccccaggccttgagggaagaggtgtgatacaggtgttcactgtgtgctgagaactctgcagtctcttactcgcttccagctaactagctgccacacccaagtttatatagttcagagaatggaacccagggccttaggcattctaggcagtttaccaagtgagctaattcttatccaccattgaaatttctaaagtattacatctttctaccaagactattttaataagccagtgtctttttttattcttaattttttattatttaaatgtattttatacatcaaacatgttaataatattgagtattttgagaatcaaaaaatacataaaaattgttcatcttttatattcatatcctttcataacctaaaaatatcattaaggaatatttaatactatctataactgaggatcctatatctaatgttgaattctaaatagtttcaaaacatataaaatattctttgggagttaagcataataaaagaggatgaaatattataaatgaatcattaagaattatattcaaaagcccttatatgatacaacctgacatagtgagagagtatttaaaatgcattatgtatctgtgtatattgcctaacaataagtttactttaaaaagattatcaatgtttctaggagagaaattatttttttcagtaattatatttgaaaaatttcaaaacagcaaaatctctttgaagttaaatattaagaaaatgctaatttcagggacagtgagaaaaattataaatatttccatgatgtttgtagaacatgattttaatgtttcaactattgctattcaacaaacatagttattttatgatatattttgttgttatgtctcccttttcatttctgattttattaatttggatactgtctctgtgcctctggttcttctggctaagggtttatctatcttgttaattttctcaaagaaccagcttctggtttggttgattgcttgtatagttctttttgtttctatttggtttcctgctgtccactcctctctggcatatttgcatctttttgttctagagctttcaggtgtgctgtcaagctgctagtgtaagctctcttcagtttcttttgggaggcacttggagctatgagttttcctcttaccacttctttcattgtgtcccataagttttggtatgatgtgtcattttcattaaattctagaaagcctttaatttctttatttgttccttgaccaagttatcattgagtagagcgttgttcagcttccatgtgtctgtgtgctttctgttttgtttgtttgtttgttttttgttttgtttttgtttttgtttttttgtatttaaggacagccttagtctgtggtgatctgatagggtgcatggaattatttcagtcttcttgtatctgttgaggcctgttttgtgacaagttatatggtcaattttggacaaggtactgtgaggtgctgagaagaaggtatattcttttgcttttggatgaaatgtataaatatctgttagatccatttggttcataacttctgttggtttcactgtgtctctgtttagcttctgtttccatgatctgtccattgattagactggggtgttgaagtctgccactattatcctgtggggtgcaatgtgtgctttgaactttagtaaagtttcttttatgaatgttggtgcccttgaaattggagcatagatgttcacaattgagagttcatcttggtagatttttcctttgaccagtatgaagtgtccctccttatctttttttgataacttttggttgaaatttgattttattccatattagagtggctactccagcttgtttattagggctattttcttagaaaattgttttccgaccttttacttaaggtagtgtctgccttcatcactgaggtgtgtttcctgtatgcggcaaaatattgggtcctgttaatatatccagcctgttagtctatgtcgttttactggggaattgagtccattgatgttaagagatattaaggaaaagtgattgttgctttctgttatttttgttgttagggttgggattctgttcatgtagctatcttcttttaggtttgttgaaagattactttcttgctttttctagggtgtagtttccctctttgtgttggtgttttccatctattaccctttgtagggctggatttatggaaagatattatgtaaatttggttttgtcatggaatatcttgatttctctatctatggtaattgagagttttgctgggtataatagtttgggctagcatttatgttctcttagtttctgtatgacatctgcccaggatcttctagctttctggtgagtgtggtgtaattctgataggtctgcctttatatgttacttgacctttttcccttactgcttttaatattctttctttgtttagtacaatttggtgtttttgattattatgtgacaggaggaatttctttactggtccagtctatttggaattctgttggcttcttgtattttcatgggcatctcattctttaggttagggaagttttcttctataattttattgaagatatttactggccctttaagttgagaatcttcactctcttctatacctattatccttaggtttgatcttcttattgtgtcctgaattttcctggataaaacattaggagctttttgctctttgcattttctttgactgttgtgttaatgttttctatggtatcttctgcacctgagattctcttctatctcttgtattctgcctgatctctttcctaagttttctaattccatggttgtctccctttgtgatttctttattgtttctatttacatttttagatcttggagggttgtcttcatttcattaacctgtttggttgtttccttgtaattctttaagggatttttgtatttcctctttaagggcttctagctttttacctgtgttctcctgtatatgtttaagggagttatttatgtccttcttaaagtcctctatcaccatcatgagaagtgattttagatccaaatcttgattttctggtgttttggtgtatccaagacctgctatgttgggagacttgggttctgctgatgccaagtaaccttggtgtctgttgcttatgttctttttttttttttcaataactagataagggtttattctttgtatcagcaaaggacttgtgcttaagtaggaaaaactaaattccatactcaaattggattattagaatacaataaagacaatggctggagttcctttaaacagatatacacatccccaactctttttttttaaatattttttattacatattttcctcaattacatttccaatgctatcccaaaaagtcccccatgccctcccccccccacttccctactcacctattcccatttttttggccctggtgttcccctgtactgggacatataaagtttgtgtatccaatgggcctctctttccagtgatggccgactaggccaccttttgatacatatgcagctagagtccagagctctggggtactggttagttcataatgttgttccacctatagggttgcagatccctttagctccttgggtactttctctagctcctccattgggagccctgtgatccatccaatagctgactctgagcacccacttcttgtgtttgctaggccccggcatagtctcacatgagacagctatatctgggtcctttcaacaaaatcttgctagtgtatacaatggtgtcagcatttggaagctgattatggggtggatccctggatatggcagtctctaaatggtccatcctttcatcacagctccaaactttgtctctgtaatttcttccatgggtattttgttcccaattctaagaaggggcacagtgtccacactttgcttgcctcctgccatccagttatctctaatgctaccttcccttgctatatatgattggaacctctccttcctgtgatcctggttgtgtcagaactcctcagttcagctgtctctgtaatcctgtgattctgggatcccgtgatcctaagatcctgggtgtgtcagagttcctaggagtcaagctgcctctggaaccctgagattctggtgtggccaagttccagggatcctggggtcctgtgaacctgtgggcctgggtgtattaaagcacctgagaatggagctttttctgggtgttgtgggactggctgtggagtttgtgcccaaggtctgctcagaagggccaatgtctttttatttatggaaatttttgcatagtttatttaagtgttatagggtgttatatgctaagtgtcacatttcttctcaaaatgaataaaacagcatttcagtattcatagtatttgcatagaaagtatgcagttgtgggcttgggacataggtcagtagttaaagtgcttgctgcataaacatgaggatccccagaatttatagtttacatgggtaaactgtaaatgtgataggttgtactgtaactccagcactgatgagttacacacagatagatcctgggagccttccagctgctgatctaggcaagatggtgagatgtgggttaattagaaatcctttctcaaaagtaacatggagaaagatagaggaagatacgtgatataaacctctaacttctctctggaacatatgataggcacatgtgcacaccacacacacacacacacacacacacacacacacacatacatcattgctgggcatgttggtgaatgtttgtaatcttagcattcttagccgttggggctgttgggaggctgaagtaggaggatagtgaatttcaggctaacaggctaacgtgaactacatagagagaccccacctgaagaatggaaaagtatcctgtttagttttcaaactgtatcttgagtatgatgatgtacttgtacttgtgtacatatgtatatataagtgtacctgcatgttcatgtacataattttttaaaataaggcatggaatggttatactgactactaaggaaaaaaagaatgggtctgagatggaagaggcttttgtaaccttttggtagtattttgtgtatatttgcagttttgtggtacattcaaaaacaattttgttctacctgacagcaaaaatgaagccaactacctaaatctgatgctagattgacatatatggtaacgtctctgtctagtttgaactcactttcagtcttatgagagaagcttgatagagaccctagcctggaatgggagagcatggctggagcattttgtatgatttgatttgcctgccttccactctgttaggaattctgtgttgcttctcagagctttggcccacagtttattcctgacttctcagcctcttctcatagtgcttaataactggcaagtccctgggaggggaagaggtacagtatgcaccttcacattagttcgttttcccctgaaataatctcgcatcctggctccttggtaacttcctactttatatacccagtcaatctcccccatcccctctttatctatgtatgtgtgcgcacgtgtacacatgtctcatagttttttatagctaggccattggtacaacacaagctagtctgtcacaagcaaacagaaggtgctaccgcccatcttaaagctgcaataatccaggtcatgagagtttaaaatagatgctaaatgatttattaaaataaaatatataaaattaagttttctgaagttttaaattttctaagtagtaaactttattatttctttcaagaactcttcagtttttattttgcttaaaggtattcttctgtattctcataaactctaattttaaacattaattacagagacagctatcattatcagaaagcagaaggaaagaacttctccagaggataattgtggagcttgttgaatttatatctcctaaaaccccaagacctggagaacttggtggaagggtatccgggtcattggcttggagagtggcccgaggtgagacgggtctagaggtatgtgttctaggcaagaaggctgacttagactatgtgtggaccgaagtcctaggtgatgagagttttcttcctgggagattgtatgagtagtatatagggatacatttacaatatgtaacacagtttaaatctcacttttctcttccatctaaaagtaaaactagacacatttctttttttttactgtttttattatatattttctttatttacatttcaaatgttattccctttcctggtctccctccaaaaatcctctccacttatcccctccccactgcttaccagcccacccactcctgcttcctggccctggcattcccctatactggggcatagagccttcacagcatgaccaagggcctctactcacattgatgaccaactaggccatcctctgctacatatgtagctggagccatgagtcccaccatgtgtactctttggttggtggtttagtccctgggagctccagaggttcttgttagttcatattgttgttcttcctatggggctgcagacaccttcaactccttgggtactttctctagctccttaattggggaccctgtgctccaatgtatagctgtgagcatccacttctgtatttgtcaggcactggaagagcctctcaggggacagctatatcaggctgttgtcagcaagcacttgttggcatccacaatagtgtctggggttggtgattatatataggatggatcccccagccgggcgtggtggcacatgcctttaatcccaacactcaggaggcagaggcaggtggatttctgagttcaaggccagcctggtctacaaagtgagttccaggacacccagggctatacagagaaacaaaaaaaaaaaaaaaagggatggatgggatggatccccaggtgggggagtctctgtctgatcattccttcagtctctgctcacatttctaacaattggttgccttagtggataaggctatcaaaacctgctttattcagtctaagaattattatgtacctgtttctgttgccacccacttgcatcactagatattagggaggctaaagcaggaaaacttcaagttcagtatgaccatcagtgaaacttttgtcaaagggaaagaagttcgagaaagaaactcagcagtacagcacttgccaagcatgtgtgaggctctgtcctcaggcctcagtactgagggtagggttgctctcacctatatctatagaaatggaatgcctaacactggaactgatctgtatggtggaagtccatgtgcagggagacatagggcactagattgcctcttatctagggagcttcaagaagcattgctgcattattcagcagacatagagcctaggaagctacataatgaaagtgcctgaaaggaaaatgacccattacatagtgacaattctgaacaaattaaacttttatgtcacctttatctaagtatgccattgttcatttttcatgtcccagagtcccagtaaattctgtgtttgctttttagttcattccatcatctgtggcaggctgttagtaatgttgctttagctgtagaattataacagccaagttcaacaaatagttccagtcagtgctgacacagtgaaagctaggagtctgaatcgagatgtagccattaaagagctcgtttaactcacagctgtgctcagctgaaaacagggacattatttaggtcttcagttcctttcctttggagtgagtgtgcttcctcttacatgggtatacactaattaaactttaaaaatacaaactgggccatagaatgagcttatttttccctgttgaaaactttgagattttctcagtttctggagaccatcttactgccatggatttaaaaagaaaccactgattctcacattacaaatggatgttctaaaagtgagcttaaaggagtgttaaccctaaataataattgcatcttgatctcacaatcatttggagcaagaagaaaatattgctgatattgtttccagaaaggaaagttttatcataacttcattttatgaagactaagagggatggcacatgcctgtagttccagccctaggaagactgagacaggaggatctcaattttgagatcagcctggtctctatttttttaatgaaatattaatcttgttatgtgttgctttgcttctttccatacatgctatattcagtaatgtgctttttaaaaattttgacagatagttatcctttatgggagaataggttatcattccaaacacttttctgtggtttgtgttagcactctgaaatatctttgataaaacagagaggatgttgggttgtagaagtgcatgctcatgttttgtggcactgaggtgataggtcctcagtgccacaaaaaggaaagaaggaaggtgggagaaaggaagaagataggaagagaattgagaatgctaaaacagaacttgctaaaatcaaattctaaaaaataatgacttgcttttattcacctttgagagcaaatagacagtttctgctaaagaaattcattctccttcatatgtagactgatgaggggttttgctatttttttgtcttttaaagataagatcttgcagtgcagttcaggttggtgtcaaacttgctattttattccttcattagccttcccagtactgactgcaattatgtttgctccaccacacccactaaatgatattttaaaacattacacacatgcatgtacgcatacatacacttttgttagatattttcatagtgtgccccactgttgtgatggagtaataactgttatatcaagttgagagtacaaagattgctgatggttttgccttcctgtgggccttggcaggatctggagacaattcagttatcaagttttcaccttgggatcactattatctgtgtggagcacagacagagaagttgaaagaatgcaaagctggtaataacctttagtgtcagagttacagatggaggtagaagagtagaaatgagggaatgagtgtatgtaggtagatgggttttctattgctgggacaaaccagtatgaccaaggtaacttacagaagatggggtttatttggacttttatttccagaagaaaaggagtccaccaccctcagggaaggggaacatggcagcaggcaggcaagtaggtagacgtggcactgacacttgcagctgagagtcataaacaggaaacagagttctctgacaatcttaggggacttctgaagactcaaaccctttccccatgacccacctcctctaacaaatagtttcagtaaagaagaccaagtattcaaacatatgaatctatagaagccattcttgttcaggtcaccagaatggatgagaagagtaatccttaaattacacttagtcacacttcctttccagcagtgcctcgtgttatatcagtatttgacttgttgtgtgcaatgtgagtttatgtagtttttatactttactatactgtacatagtatctctttgttttcatgtctccacaatattgaatattgaatttctgcctttttttaagagaaaggagattctgttcatcccttctgaaaatgaaaagatttctaagcagtttcacctccgttatgatattgtgagagaccgttacattcgtgtctcagacaacaacacaaacatttctggatgggagaatggtgtgtggaaaatggaatccatattcagaaaagtcgagaaagactggaacatggtaattcaatgcatgaaactgtttaaaatttgtgtcattgtttaagcagatatagattgccttcattttccaattatatataatatgaaactgatataattgttttgggtaattcttgaagtgggaaaagaaagtcatgttcccagtatttaatcaaaaatgcattagcgattcttatatcctggaaatttctattttatcattattcaaatgtaacacttttaaatttttattagattttttcatttattttatgttttaattttgcttgcatatatgtatgtgcaacctgtgcatgattcatacccacagaggtcagaagagggcatcaggtcacgtgaaactaaagttatggatggttgtgaaccaccatgtggtggtagaaattgaatcctggtcctctgcaaagcaacaaatgtttttaaccactgtccgaattcttttttaggaaaaaaataatcaagtgaccaataactctcatgactgccatgtaactgtgtacgagtgctgccgtttaattccttcacatccataaattgccagcctactaatgactaggttctagtgagttttaatagagttaacccaatgtccagaaagctaaatatctcacaaatgacataaggatgtgagtagctgagctcaagtattggttattccctgtctgtaccctaaaaatgtaaagatctgaaggctatgcttcagtcccattcacttatacatcctagattgtacaccattgtcatattacccataagggatgagagctttgctttaaagcatctccactccatggaaacaccataaataatctgttacccacatgacaacaatagataatactgtatttttttattaataatgttggaggacggagagtgtacacacatgccatggaccatgtgtgaaggtcagaggattactttatgaagtcgattctctcctttcacctttatgtgggttccagagattgagcactggtcagcagacttcctcagtagatgcctttgcccactgagccatctgtctgatgcctcaaacatatcgatagctgtcctccactcctgccaagacattaattaactcatagggagctttaaaatcagcatacaaaatatttaattggacatttttcacttgtaagacattggatagatcaaaaaataagtcatagaatgaagatgccatgttcatgagcatctaccatacagtacaaagaaacaaagaaggtctgctctctttctcaaattcaattatgggcttttgtatctaaacttagctatagctgcactattacacagttgagctaaatcatatctaatcagggctggagaggtggcttaagagttaagagcatttagtgtgcaatcatgagctcagccacccatgaaacaagctgggcaccccacacatatctataacccagctttgaggtgggcagaagctggagtatattgctggggctttgtggttgtcagcctaactgagaaataatgagcccacactcagggagagaacttgcttcaaaagaaacacagatcatgaagaaagaggctagccacacccactcataggcacaggcacccacatgcacactcacacagacacatacacacatacaccatctgtaaaaatgagcgattgcatctaaccataaagtggggatcccctttgctgaactgagaataggttatgggattgttaagcttgcaactttgcaaatatttttacttagctaaagaaatgcataaaaaccaaacaataaaacttagaatttctccaggtggtagtggcacactaatcccagtacctgggaggcagaggcaagtggatgtctgtgagttttaggccagcttggtctacagagtgagttccaggacagccacgactacacagagaaaccctatattgaaaaaagcaaaaacaaaacagaacaacaaaagaacttggaatttcacagtgtctgtgtgattctgtagttggtaaaagactacccttagcctaaatttccaagcagaaagcacaatggaatagaagttttgcctatgcagaaactagtctgtacttgctaaactgaaactcatgtttctctctaaccagcagtgttgctagggaaaataatagagaaaatgatggcatgtgacaaaaggtgcagtgtttgagaaacagggcagctctgctggcacactgctcctttgtcttccatgctcctgtgttcatctgcagacatttgctgtgtacctgttatgtacactaggcttcttctcagctaaatgagtgaatatgagtcctttttcttactgtctaacagggaaaacataaacagccatcttaacaaccatacagggtgctataataaggatagcactatggaaacgctgaggtaattaactctggctgtgggagttgggcagatctcctcaaaacaggcagtatttgagctggacatgagcaagattagtagatgttcaaaacagcagggatacatgtctgtttttggtannnnnnnnnnnnnnnnnnnntctccctttgggttttctttaatgtttctacttcctttttaagatcttggatggttttgttcaattccatcacctctttggttgtgttttcctataattctttaagggatttttgtgtttcctctttaaggacttctacctgtttatcagtgttcttctatatttctttaagtgagttattaatgcccttcttaaactcttctaccaccattgtgagatatgattttaaatccgagtcttgcttttcgtgtgtgttggggtatccaggactcactgtggtgggcatactgggttctgatgatggtgagtggtcttggtttctgttagtaagattcttaagtttgcctttcaacatctggcaatctgtggtgttaatgttctagctgtctctagctggagtttgttcctcctgtgatactgttagcctctgtcagcactcctgggagtccaactctcacctgagtcccagtggtcagagcacttctctgtaggcaagctctccttttacagggcaggtgtccagaagtctggagctctgatccacctcctgagtcctggggtcagagccctccctgtaggccgactctcctctggcaaggaaggtgcccaggggtctgggtctgatctccacctcgtggctgaggatgaaggcctaaagggaccctgtccaagaagctctgttgcttctgtcacccacgtgctctcctgtgatcacaaggtcctgggtgtgctaggggtccttcagcatgcagagtcctctgtggccctagacgccctgggcctggttcacgcagaggatggtggggctggcccagactggaagggatcccagcctctggccgggcagggttcctttgtctctgttcctgctggcacaagaccctcctccattctttggagctgatgttgcattccactcatctgtgatcgggaggtaccaggtgtgctaggggtcctgcgtagttggagtcctctgtggaccttggtgccctcggccgggttcatttggaagatggcagggctggccccgactggaatggatcccagcctctggtccagcggggttcctttgtccctgttcctggtgtcacaagaccctctacgattctttggagctgatgttgtgttccactcacccgtgatcccgaagtcctgtggcgtggagagtactctggagcccttggtggttcaggcggaagatggtcaaaagcttttcatttagtcacttaacaaacatgcagaatgtgcttggtattcaggatggaatgacagaagtagtaaccctcaaggggcctatgactgtgctggctagtttcatgtttacttgacacaagctaaagtcatctgagaagagttaacctcaaataagaactgttccataagatcagactatatacaagctgtagggcattttcttgatgggtcttgaagacccagcccatttgtgtgtggggccatccctggcctgctcgtgccaggttctataagaaagcatactgaacaagccacatggagcaagccagtaaacagcacccctccatggcccctgcatcaactacttgagttcctgtcctcactgttttaatgatgaattgttatatagaactgtaaacttgaggaggaatcctttcttccccaagttgcttttggtcatggtgtttcatcacagcaagagtaaccttaagtaagaccttaagtggcctagatatgtcagctgtttgaatgatagcataagttctagaagaatttgaatctctgagatgttgaaagagggaagatttttgtttaaagtcactaacttcctgactcagagaagtcattgcagaagaaataagatgtgagtaggctcttgtaaggaaaaacaaaaaacagctagagtctctcagcttcaggacaaggtatgaagcagagtgtttaggaacaggggaatagagaatataaaagcacagagtgggaaacacgggccatgtgcagagacaagtaggtagagaggagtatgcagagcagaagggaatggaaattagagggtaaaagttgtcagatcccaagaactcaaattaccttacagctgtgtagtcaggaagtatggggctctcaggcaggtgaatgatgtgattatactagtgcccacggaggtgactccaggagctagaggtacagtgacttagaaaggagggtttaagtacagagcaactcaaagaggagtcatgggaataccagtgtgccagcagtacattaaagtcccttaaagtacagctgctctgcagggtgcttgtgggctgaatagggaactgagagtaaacctcagcagtcaagctgaagatgtacttcagccctcaccaaaagccaaactccagaaagtcccagcagcctgacacatagcaagcacagaatgtttaacaagaatcttcttcattcctcataaatactcaaggaggcagatttgcagttctcagtcctaaaaactagttctttctgtatatttcatgacttatacaccttaccaacaggttgtacatactttgatatgtgtgcagataccaaaaagggctgggatggtttgctggagaaaagatccatgatttcaaattttaccagcattcctgctgaggtcagagagcagcacttacctcctcattagacacacagagaacatatacatctgcatctagtaaaggaagcctataaactatgaagcccaggaagcagaaactggtctgtgaagtaggaagttaaaaacaacccacaggggccagaaagagtgctcagaggttaccaacatatattgctcttgcagaggctgcaggtttagttctcagcatttgcatcaagtggttcccaactgcctataattccagctccacacaatccaaatccctcttctggccttgacaagcacatgcactctacactaacacacatgcacatatgcacagacacacacattgtaaaagtaaaaaaaaaaaacaaacaaaccataaagaaaatcaaaagatataaaaatactagacaagtaaatatttaggaatttcataaatgttttttcctaagtaagttagaatttcttatcctggtggtatttattatttacagacatgaccataatcaaaagtctttatataaatcctattactttaatgcatttcaagttaccaaactaaatattcttaccatgtctaaaattattacttcactatttaattggataaaaatactataaacagaatatactatacggaaaagttataagaaattttaaaatatgaatagggtctagtttatttttgtattatattactttagtatacataaccttttatttgcatgcagtgtgtttatttttttggcattgattaattaaaactatgaaccttaatatatcttaagtttccatggtcttaaaaggttctacctttggactggagagatggatcagcagttaagagaaccgactgttcttccagaggtcctgagttcaattcccagcacccacatggtggcttacaaccacctgtaatggacatacactaaataaataaataaataaataaataaataaataaataaataaataaataaataaaggtactacctttaagactagaaatagatagatagatagatagatagatagatagatagatagatagatagatagatagatactgtcaggcatgttcagcagcttttataacccttattaaccgataaaagctacagttgaaacccagacccactaactacatcaaggtaattcttagagtatgcttgtagtttgaaattaatttgactttaaatgatgataccttatgcccatacttcaggggaaacataactagtgagctccaagaatatactggatggacttagaaatgtatgctgagacaagaatgtctatttctgtctttactacttctcctagacttagttctttccaactgcctttcttttggtgacacctttccttagcttatctttgctaaataacctttagttgccactcccttaaaggggtattcaagttgtgactaatcctaaaatggagaaccagtagtttaaattggttgatatcaatgactccagggaacatggtaccatcacaaagtcccaggtcccttgtacaaataactacaagaacatacagtaggaaaatttgtttgtttgattttgttattccttttccacattaattaattagtcacttttcatctggattacatccctctcctcctctcctcccagtcctccccactctggcacaggcatcaatctaccctggcacattgagtctcatcaggactaagctcatcctctcccactgaggccaaacaaggcagctcaactaggggaaacatgtccaaaggcaggcaaaagagtgtgagttggagtcagacacagcccctgcctgctccagttgttgggaaacccacatgaagaccaagtttcacatctgctactatatatagggcccaggtccattccatgcatgctctttggttggtagttcagtctccgtgagccccaggggcccagattagttggttctgtaagtctgtgtgtgatgcccttgactctctggctccctcaatccctcccctgactcttccacaagactccctgagctctgcctgatgtttagctgtaggtctctgcatctgttcccatcagctgatggatgaagcctctcagctagactcctgtctacaagcatagcagagttaagttaatagtgtcagggatgactttctcctgtgtgatatgtctcaaattgggccagtcattggttggccatgcccttaatctctattccatctttatccctatacatcctgtagacagggaaaattttgggttgaaggttttgtgggtggggtggtgtccttctctctccactagaagtcttgcctagctacaggagatagcaacttcgggctccatatctcttgttgctaggagtctcagggtcaccctcataacttcccaggaatctctcccgtcccaggtctccaacttgttctagaaatgctcctggctgatttcccttctctctcagccctatcaccctcaaccctcactttacccatacctgatccccacctctgttgttgcccatcctactccctctcccaccactctccatccacttcttatgtctatttcacttacccttctgagtgagattcaagcatcctcccttgggctctgctactttggggtctgtggattgtagtctggttatcctgtactttatggctaataccacttctaagtgagtacatacatgcgtgtttttctggatctgtgctcaggatattttccagtttcatccattcttccgaaatttcatgatgtccttgtttttaatagctaagtagtattccattgtgtaaatgtaccacattttctttatccattcttcagtggacatctgggatgttcctagtttctggctattacaaatagagctgctatgagcataattgagcaagcacatcttttgggaatatgcccaggagtcttgagatacaactatttccagtgttctgaaaaaacaccaaattgatttccaaaatggttgtacaagcttacactcccaccagcaatggaggagtggtcccttgctccacatcctcaccaacatgtgctgtccttgagtttttgatcctagccattccaatgagtataagatggaatctcagggttgttttgatttgcatttccctggtgactaaggacattgaaccttaagtgtttcttggccattcaacattcctctgttgagaattttctgtttagctacataccccattttttaaattaggatatttggtttattggtgtctaacttcttaagttctttatgtattttggatattagccctgtgtaggatgtagggttggtaaagatcttttcttatcctgtatggtgcagttttgtcctaagtacagtgtcctttgccttacagaagctttgcagtttcaagaggttccacttaataattcatgatcctagagcctgagctattagtgttgtgttcaggaatatgtctcctgtgccattgagttcaaggctattccccactttctcatctgttagatttagtatgtccagttttatttgacttctttgatccacttggacttgagttttatgcaaggtgataagtatggatctgtttacattcttctacatgcagacatccagttataccagcacaatctgttgaagatgctttcttttttccattgtatggttttggcttctttgtcaaaaatcaagtgtccatatactgtaggaaattttgaacagcagaggatgttgtagtgagattgtcttgaccttgagtggaacacttgatagcgtcatacatcccaccccaataacagaaagcaatagttgactataaatatctaaatctgagggtgagaacagcttttctgaggcagggtcttactgtctagctatctagcttgctatggagattagactggccttagatgtaaagatctgcctgcctctgcctcctgctgtcttttaaggatttatatttattttttatatttttcaagtttttttaaagatttatttactttatgcatatcagtacactgttgacttcttcagacacaccagaagagggcatcaggtcctcagatcctcagatcagatggttgtgagccaccatgtgcttgctgggaattgaactaaggacctctggaaaaacagtcagtgctcttaaccactgagccatctctccagcccctatatttattttttaaattatgtgtatttatctaggcagataagtgcaggagcctgtggcagtgagggcagaaaacggagtcagatctcctgcagctagagatggaggaagttgtgagccactccatgtagatgctaggaaaggaatccgggtcctctgaaagaacaagatattctttaacagctgagccagaaccatctctccagccccaagaccgccttcttagagccggatcgttcagtagatgcagtatgtctaatttaatcattctgataacatttcacattaacgagtattgtccttgctagactttctattgctgctgtaaaacggtgccaaaaacagcttggagaagaaagggtacttcatcttaccactttgtagtccatctgacataagtcaggaattcaagcagaggcatggaggtctgctgctcactagcttttccctcagggctagttcagtttgctttcttatacaacaaagtacagcatgcccagacatgggccctaccacatcatcatcaaggcaatactcatagacttaccttcatgcatatatatgtaaccaatttattgtgtggccttggctaaaagtttccctccactttttcataaattaatttctctagcattcacgttttttatacaatgaacttaaattgcttttttttttttttcctaagcgaactgcttcttgtttttcagcttttcaggttagatgtgtttaaagccagtagatcttgctcaatacttgaattttctagtattttttttaactgacaggtgttgtgtttatatatgctggactcagttactccatatttctaactgttggtagcctggaatatctggtactaaagactgattgtatgattgagttttgtattcagcgcatccccatcaatccttatctgtaataatacaacttcattttccagaaacttcattataaaatagaattgtcaccactagctacagcttctgtcatatgttgtcagattagtgtccttgaatcttttttctatacacataacatagtatttagtaacactatctcatcttctactgaaagaacctagtggggaaacccccactcaatttccgttcggcgcacacccaagaatcacgaacagaagaccaacttgatgtaagaacacgaggtagtttaatggcagagctccgggtcaaagcatatctcacacaggagacagtggtttcgaccacgaggcttggaagctaggggtttttatagaaaaggggcggggctgggggaggaattggtgcggtttcacatgattggtccatttaaacatcaacagactgtcagaagggcagatagggaggtaccaggccagtcaggacatgtaacgacgggcctgcccgggcatgtcctagcctgttctgctatgtttttagcccctgatttcaaagttcacaaacaactctttgggctttttgacatatattacatgaatcacaggtctcaaggtttatttcctttcactacttggcaacattaccttacattggtaagttattttcagccacttgcatattaatgtaaaccttaattatattgttgaatatgaactaagaactatagaatcacatgtttttctttatattctactttcttctgtcatttggagtattctggaagggtaattttctcaattaagattccctcttcccaaatatatttaggtgtgagtcaagttgacaaaaacagtccatacaagcatatttaaccaagaagaaggacagcaagtaaatgctagtcgctgttgttcttacctgatgatagaactagacaacagagtagcacatacaggaagatagtccatagttggtccttcagccatttgccctacatctaaagactatcagttatgtttctaaatgaaccagtctaatttgcatatctgtccatttgtgtgtattatataaattacatagctttaatgcctaataagtacttcatgtttattagaaattccccttccccatgaatccagagcttatacccacacagtccttttgatgtggttccattagacaaaacacaaataattacactgaagtaaggaaagtttggcaagtctaggcatgatgaagtgttgaaggaccttggacactgacagacttaaggcaagagcctgcgatctgaggtacatagactaggcagatgccatggaggacatggaacctaaaactcaaacctgatgagagaggtgttgggcagcaagagcagatgctatcatgcatagctagtgcagcatagtgagaaagggcctcttatagaacatctcttctcatacagacacagagtaagagaatagagtgagattcttacagtcaggcctgagtaagggggttgagctacagaaaacccaggtagagatgtgagtttcgtgacacataaggaagtttggctgtgacagggatatactggaaacagccagtagacctgagcaccttaagctatgactgtttcaagtgagaaggggtggttcactggaaaggcagacctgtatgtcacttccacggcccttggtggtggctgagctgtgtcatgttctttaagagcctgtggcatcactgtcatcagaagcgtgttttaaaatactgacttgaggagatgagtcagtggggcagttatttggaaggacagtcatgttcagcattgtctttctcggtgcttgctttaagtaataaacctctaaacagattatactttaggggacatatgtattataatagctttttatatgcacaaaaagatgccataggatatattgctaatagcaagaaaaattatagtattaagcatctttttactggggaaattttcatttttaattaccctttgttcaaagtattctgcaatgataagactctcattttctacattatttaatttcttctgaaagttcctcccacttgccccgaattttctaggtttatttggcccgaaaagaaggatcatcttttgcttatatttcctggaagtttgaatgtgggtcagctggtctaaaagtagatactgtttccatccgcacaagtagccaaagctttgagtctggatcagtgaggtggaaactgcgatctgagacagctcaagtcaacctgctgggaggtaggtccaactacagtgttcacaggaagtgaccgtttgcctgacactcagggctgtatgcatttcattgaggtgtactgaagagttactcatataactatattaaaattcatttcatctcattttgtattagacaggctggtgtgtgtgtgtgtgtgtgtgtgtgtgtgtgtgtgtgtgtgtgtgtgtgtggtgaaaaaattcaggaagaaaaataacctctttgttacaaagaatatatttcttctataaagaaaaatacctgtttttaagaggggattttaaactctatcagtcctataagaggtacatttgaaacttctccctcgtttttcaaactaccaaaactcaattgtaaattctttttttccctccaacagataaaaatctacgttcctataatgatttttctggtgccacagagggttacattagaagcagagttaagcagaggagatggagacgttgcttggcaacataccccaactgtttagacaaagcttaaatgacagtggagaaaatggcttggaaataattataacgttcaatgacctctgaaagcctgaacttcagggaaatgctggctacaatcactgacccgccatggcctccagtagtgtattagctcagtgtgtatctagttggcagttcaccatcctgtgcaacaggtttcttttgctggctgtacatcatgtaatcctcattaaagtatatcttcatagtgtggaccataagaaatcttcaattaaatgctaacttctgcctgtgattagaatttggcataaaatatttggcataaagtaactgtatgaaattctaatctaaacactgttactaaagttgtaagtgaaaatgatggtattcatgattaaatgctgttcatgactgtgatacaatctagggctactagttacttaacattttctgattagatttttccaaacattctcaattttgaataactgtcaaagtcaagtatcttatgtcatatgatgcatgaaggtttttatcattgtaaatatctggacagttaaaaaataaaatggattatttttgctttatgccttttcagtgcttaccttgcctaaaaattggctttcctgggtatgaagaatattgaaaactacctcagtatatactggtttttcagacatttattactaacagtttatttaaagatactttgcaagttccataatgcatgggaacttgggtattctttacctttgaattataagatacctcattgaataaaatattcttggctttgaaactgtcttgtatgagaagattaagtgatgtgactgaaatctaaaaccattaagcagaaagcagatactgtttgagacatgctgtgatatactatagagtaggtcactatagtttaagctgcgtgaatctgtttctagctataggatttaataccaaatcaataaaaatactggaatcttatagagtgaaagagtagcaattgtctctaaacctcatctctcccatttaaaaccagcatctttaggtgtttaccagtaaatagtaggccaacttttgagaagtgctcccttcctaaaaagttgtatatcgcttttcctcataaatattttctaccatgacacacaaaagaatagataaactgaataaaggatgatcaagaaagaatacaaagctatgcttggctacatgagaccctgtctcaaaaataaacctaccttgtttaatttttcaagtagcttatgtagctgaacttttatgtcttaagtatcaatattcaggaagtctcaaacttcaaattatttgtagcagcataaatggtcaggcactttacaaaacactaagtgcctctgaatgacagagccctagggaacattcaccttgtcgtggaattttgaggcccttaagattagctgtaagctagtttaggcttgtcatagtttcaccacaaaaaccctcatcaacaaacaaagctagtcttgacccatccaaacagtttcttaaatgtcactacaggcaggattctctcccaagaccatcttcctgaagtgtaaggccatagactcaggagtttgtgggtaccattttatggatattctaggatactcaacagcagtgtttttagaaccagttaattcaatataagctattctaaatttggagagtctataataatagaagttttgggtttttttttttttggtcttatttatgtataaattaggagattcaagcatgccttccttaaatgcttttgaaagaaatgaagactaagccactacaaagtccagctgatttattacacgtgggtgtttcctctagattggccacaactactttatctcatccccagtgtatagataccaaattgaaaagctaagtgggagctaactgtacaatgagatcttaattttccttcttaatttgctcttccctcaaaagcctatgtagttctgagatagagtctctgtaactcatgctggcctcaaactggggacaatcctcttccctcagattgccacatgatagaatttcagggatgaaccaccacacttgacctttatccccaagactctagaaatctgcaaagtctaattaacaggaaattcataagtaatccagaaagttttgaaaaactaaatagctgctactgtaaggcctgacagggcatgtcacagaaatgtcacactatgagttgctactccggctaccttatcagtcttcaaatgtgtagtcttgacgcaggctgatccagactttgaccttgctgccactgagaaggagattacctatggtagagccttctgaccttgatggctctatttgctcttctccaagactctgcttcctgctgagaggtacttgagacattgttccggagacacaccctgtagatcacctacgggctagctccaggcaccaagattgagctggcaggggatgggcctaccctctttataaacacagactctcagtaaacttcagaggctttgaacagaaaggtttgtcttggcctcttttctcaccatctgatctcttttagccccagcctgcctttcagaggaacccagttcccgtggccgcaggcagctacacaaatgcttcaattggtaaagttattttagctaaaaattcaagcaagatagtcatgaaaataaaaattgctgcctccacccccaaccctatactatttccagaggtgaccagcaagactactgatgtgggatacccaagacttcctgtgggcttcacctgtgtgcatagatcagctttcatatctttgggtttttttctctatggatgtgcagcctctctctgctagctttattaacacttttagaaatctgttcatttccagtcattaatctcctcattttataccacactgttttgtaatttatactgtcactttatttacagactgttgttttcttttttattgctagatgtattgtgtagaacatccttatacatatttcacatagaatatatgcaaagatatgtgcatttaatattttggtggctatacacttaacaatggtattaacgaacagcaatgtcctcccttttttgcaaaagctaaattgcagtggtggcagccagccagtgttccctgcctctgaagtcccttgttcccattccacacaaaattagagcaggctctgtgtccagtcagctgatgaatgtatgcttgtgatcttctgaggtccgtcattaaaggcctgctgactctggaaaggctctcctctgtgactctgggataatccagccaactccagaaaaggaagagatggcccttttctctaaaagccagcactgactagcccttccgcaggggctctgaggctgcacttcctgagagtgtgctgcacaggtcagagctgtgccactcaggaccagcactgctgcattcctagcatgtgccggagccttgagaataagtggccttaagagacatggaacgattgttacacagcaatggataactatggtaagtgtgccatgtttacgatcctgccatatgaaaccctggagatttactgtgaggtcgatttctcaggtgccactagatgcaggggccacttcagaggccactttccttagctagttttgctttctgctaatttcctgtttatatattcttttgagttcttcctttttcttttttgaagatgtaaaccaagcctacctctcttctcacttcactatagtcattataaaatcctgtaagagcctcaccttgcctttctattttgttttattggggtttgaggcagtgtcggtggtagcccaagctagccttgaactctggatcctgctgcctaagctttagaaattccaggaattttcttctgtagatctgtgccacaactgttagcttcatagttttcccagctttcttcctctttctgggcattgtgtacaattcacagtggtggcttgtctccagtatttttcaactgaaacttttaaatgaagatatttgacataacatctggattttgcatgcatgttaagaagtgatatgtggtggctgctgtagtctatctgtacagacccataccccaaacagtagcagctggcaaaacctgtatctgtacaggcctatacccccatataggaacagctggcaaagccttcactaggacaagaatccctccaggccccaatccctccctctgtaaacccccagcttcagtgacatctcgtgccagtcactcttttctaatatatttgcacccatgttcttaaatattctgattccatgtagatcaaatgtaaaaatcgaagtcaaaccaatacactccacattttatttgatcatggatttttgtacacagtcccatataagagttacctgcgtagaagtgttctgccctatgagaatcttcactttatagctttatgtttatatttcagccatttaatatagatttttttttaaaatgcaagttgcttaagcaaagatagttagaaatgctgagtagtttgtgaagaggcagctatccttaacattgcagcaacttaggacccaggaagaggttgctaaagcttccagcaatcgttcttatcaataccaaaataagagtctctgtgttagttcctgtctttcctcggtttcttccaattgcctgtgaaacaaatgtactcagtttttgttgctgtctttaaaatcaaactataagtggctcagagtattttgaaaagtgtattcttgttgcactttgggaaaccatctctacagagctggccagctctctagagcattctcagtttaaagaaaaataaatcatcattaggctatgaccatggtggcacatagttgtaattccagtatcaagaaactgaaacaggactgagtggtccaggtcagtttgactacatagaaaaaccgtattttaaaaaaaggatggtgaggtgtcctgtgcctttaatcccaacacttgggaagccgaggcaggtggatctccatgagcttgaggacagtctagtgtacagagtgagtttcaggattgccaaagctacacagagaaaccttgtcttgaaaaacccaaaggggaaaaaaagaagaaagtcattactatctttattgttctttccagatacctctgccattatttaattatcctactgttaaaaactaatacaaaaaattgcaaaaataataaaactaaagatagtacggtatgaaacaatgtattttcctctcaagagtatgaagaacttgggactggagagatgactctgtggttaagagtgcttcctgctgtttgtcactcatgagcatataccccccaaacataaatgatacaagaaatccttaagtaatataaacttttgctttcatctacatcttctaatgaaaaacaacagtaccaagagctcctcaggaccctcttgttcccctctccccttctccaaaggcacctctcattattttcttggtacccagatagttgggtacccccttctccaaaagcacctgccatcagaaatttagagtttgtttattgtgtggtctctggctgtgcaaataaatactaagacactactgatctgcatatgtttaagcctgtgtgcatggaatgaattatcatccttctgcaagctgatgctccagtcatttggttagacctgaagtttgtcatcctcaatgcaggagagaccctataatataagatccccaccttgatatttgcttgccaatttatgattatcagaaaacaccacagagtggaatctatcctctctatcaagtgtgcttgggaagatgaataccttctattactttataagtactgaagccattcctactaggaaagagacttagcaggaagaaaaggaagcagcctagcagccataaatagtatgctgaagacggctcttaaatatgacctagagcaggatgtcctgtgtgacatcagtgagcttactatttgggaatgatctaggctttgtggaagtgaatgtttggaaacaaaggcatatttctcatactgaattcctggatggagaaacactgttgtctgaaatggtgtgatatcccttgcagatataaaagacttaaggaacaaagacagcctttgatttcctattaataaacatagccagcaaggatctcacaattcctgtaatctcaaatttgaaactttaaatgctgaagaggaatagtgatggagagctttgtagcatgagttgtgaggtagtgagttccagaactttgtggctgaggaaatgaagctgcacttttgctgggactcaagcatctcacgacaccgactgtggagtgcctgccctctcctgctgggggaaggcccagcatttccttaataaaatgtcttctgaaaatagtaagaagcagaggagctacccaaagacccagtgagaacctaatgtgtgccctcctttggggcatggagtctactgtgtagccttgtctgccctggcacaactctcctgctgcagtctcccccttgggattatagatgtatgcctacatgccctactctaaacaccagacttcttctctccagataggtgggtgtgagaacctcagcccctagttgctcagcaccattttttctgctctccctccttgttccatagacccttggctctaggtattcacagatttagagaaaggaatggctcttacaactagaaccattcgacacctgacttctcaaatgcttcacataataaaccatgagtttttttttttaaagtttatttatggaaacttcattttgctttgtgagtgtatgttaattgtttttctcagattgaatgtatttaagccttgtttcctgataaaaatataatttttagttccctcatcacagaatgaattacatactgagtaaattatacttctatttatgaaataatcccttctgtgaactgttggtttatgttttagtatattttacaatgagaatgcataaattgaaccaggaagaaaagaaaatgtatatttgatatttctgctccttctttttttctttttttttttcttttttcttcttttttgctggtgcctagagcctgggatcattagacatatcagaccgtaggatgaggattgcatcccacccatagcaccaggactgctcaccagaaggaggaggcattagagagatagaactctgggctacaccggtgatttttgtgtcaaaattcttagactcaggctagtgaatttattaagaagtccctgtcttgagtatgtgggaagggaggggagcgagcacacaagcaggtgcatggtgccacagtacagaacatagagctcagagaacaagttcagctgctgatccttgccttccacctgcctggagtttggatctctctggtgtggtcctgcatataccaggggatgtgacctgcaagcatccgggaattctgtccctgcttgctgtcttgcctcaggagtagtgtttttgcatgtgtgtgatggcacacaagtttatgtgtgttttgaatattcagactgaggtactcacagcccagtgagcactcacccctctcaggctctcccagatgcttggtccatttttttttttctggaactcagcacatggcaattctcctgccttggtctctgagagctacgattacagcctggaactcctacaccctgtctctggtgctttccttttctcaaggaagaagttgtgctctcaacaagccggccatttccagactaatagctaatatttaggagattacaatggttacagtgattaaatttggttatttttggtttcctcaatagtttaccaatgggctttgtctttgtcatttcccatggcattctggctgcctttgcttatttgttggttttaatgaaaaaggtgtaattccagccttttgtagtttcttctctcagaccaagcttgcagaggagataagaaagcagggactactcttgagtgcccgcccacttgtcctttgcttggttggttcatactctgtctgtggagctactctgcagagacacaaagtgggtagacccctaatttccattgacatatttagtcaagaactcatgcaggctaaatatgtcagtaatttgattggtttcctcttttgtttgtgccagatttcctacgacaaaataataaatggcaagaaaagaaaatactttttaaaaaattcagtattttaaaaaatacctagaacagttctgagatgatgtcactagcagcccagtttcctgtattagcaacacctggagatgtcacctttatgctctgccaacaccagggtgctgtatgccttcctctcttctctcctgctaggcctggatgccttcctatgctgtgtgctatagaaccctaataagccactcagtctccgtgcagcaccaagatcacagtgggagcgtgtaagcagaaagtttgaggccttaaaaaaaaaaacttttttattaaatgtttgtgaatttcccatcatgcaccgcaatcccactcatctccccgtccctttgtatctgctctccactcttgcaacctcccccacaccaaaagaaaacaaaaaataaaaacagaaaagaaaaaaaatctctccatggaagctgcagtatgttacagtgtgtcccacagtatacccctttgtccaaacaaatcttcacttgcaaaggttcactgctttgagagctctggcttctgctaccccctcagtactgggtcttccctggactccttttggattacacttttgggtgaaagcagctggagcttttggatgcaattagtatagggatgcacttcctcttcccattgccttttcactctagtgtaaagatgaatacactgagactaggagagggcatccctcacccatggcagatatgcttggccttgcaggatggcggtgactttgcaaggacatgtgactgtaaacctttttacccccatcttttattccccagagctcttagagctgccagaggttgtgaaagacagtggttgtcatgagtgggcccctatctcctataacttgtcagtggaggcagcacttccgtgtagcagctgtactttgatcagatgtagtcaacactgcttaggaaagaaaggtcttaaagacaaggctaaaccccagatttctgtaataaataaacaaacaaacaaacaaacagcaataaatattataccttgcttgttataattagcaggaagtaagtgtgttaagagatcacctgttcctagtagccttatctaatgaaaccctagtagacacttaaagttaaaaaaaaatcacatagccagatgactgatcaccagcaaggcatccacaggctaatttgtggcgaatccttgcctcagttcccttcactatcacttgtgcctcctcaattcctttctgggtgtttctaaaacattactatcctccatgcattcctttccaatctcacaatatagaaataagccctcatacttcctcgttttgtttctgtagctggtgtctctctccagatcattctagaacatagcactgtaaagcacatgatcttttaaatagtctactgaactgagtggtggtgatgcacacctttaatcccagcactcaggaggcagaggcaggtggatctctgcaagttccaagtcagcctggtctacagagctacaggtcagccaggactgcacagagaaaactctgtcttgacaaacaaaaacaaacaaaaagtctacggaatcatgttagtcctcagctcaaacatttcttctgttcttcacaagtgaactccccatcccacttatggcgtggaatttccccaaatggtgattgctggctagaccacagcatggacaggtttccaaacacgagcctctgaatccgtttttaacttgtgcctgtgagtcctgagcatgaactgttaattatggaaaatgactactgctaaaagcactgtgccattactggtatgaccactgacaatgaagtacctgagggattaacattttaactgcacttcttagcgaatcttcttagttgtgatttggaccacattgagtatggaggtgatgatttcaacaacctccacttgaaagtcagcatgttctgcttccttgtgcagactcaatctgacttattgttttatttttttaggttcatccaatgtgcttgtcatctgttacacatacaacagattataatgttgggttttgcactactggatagatgttttgcaaatcaaatgaatatatgagcctgtggattttaagcattgtattagttactttcccactgctgtgacaaaaattatttaagcaagggaagagtttctttgaacttgccatctgataggacccagtttaccatggcagggaaggcctggtgggaagaatatcaggtggctgtacattgtgtgtacagccagaaaacagacagatgttcacctgaggtggctgtacattgtgtgcatagtcacaaaaccgagatgttcacctggtgttttccttttttcccttttcactcattgcagggcacagcctatgaaatagtgccacccacattcaagcacccttgtagactagcccagacctaaaggacactcaagacaagccacat

SEQ ID NO: 710 - DNA, 2502 bp, Mus musculus
cgggccgcggtgcgcgaggtggcgaaggccgcggcgcagccatggcgtcggccacactgggcagctcgtcgagctctgcgtccccggccgtggccgagctatgccagaacaccccggagacctttctggaggcctccaagctgctgctcacctacgccgacaacatcctgagaaaccccagtgatgaaaaatacagatccatccgtattgggaacacagcgttttctactagactcttgcctgtcagaggagctgttgagtgtttatttgaaatgggctttgaagagggagaaacgcatcttatctttcctaaaaaagcttcagtggaacagctacagaaaatccgtgatctgattgccatagagagaagcagcagactggacggatccagtaagaaggtgcaattctctcagcacccggctgctgccaagcttcctctggagcagtctgaagatcctgctgggttaatacggcactcaggaaaccaaacagggcagctgccaagcctaccctctgctccaatggttgttggtgattcaaccatcttaaaagttcttcagtccaacattcagcatgtgcagctctatgaaaaccctgtcctccaggagaaagcattgacttgtatcccagtcagtgaactaaaaagaaaagctcaagaaaagttattcagagctagaaagttagataaaggtactaatgtaagtgatgaggacttccttctactggagctcctacactggtttaaagaggagttttttcgctgggtgaataacattgtgtgcagcaaatgtggtggagagactagatctagagatgaggcattgctgcccaatgatgatgaactgaagtggggtgcaaagaatgtggagaatcattactgtgatgcctgccagttgagcaaccgcttcccaagatataacaaccccgagaaacttttggaaacaagatgtggacgctgtggtgaatgggccaattgttttactctgtgctgccgtgcattagggtttgaagctcgatatgtgtgggattacacagaccatgtttggacagaagtctattctccatctcagcagcggtggctacactgtgatgcatgtgaggatgtctgtgacaaacccctcctttatgaaataggatggggcaagaagctttcctatataatagcattctctaaagatgaggtagttgatgtcacctggcgatactcttgtaaacatgatgaggtgatgtccaggaggaccaaggttaaagaagagttacttcgagaaactattaatgggcttaataagcagagacagctatcattatcagaaagcagaaggaaagaacttctccagaggataattgtggagcttgttgaatttatatctcctaaaaccccaagacctggagaacttggtggaagggtatccgggtcattggcttggagagtggcccgaggtgagacgggtctagagagaaaggagattctgttcatcccttctgaaaatgaaaagatttctaagcagtttcacctccgttatgatattgtgagagaccgttacattcgtgtctcagacaacaacacaaacatttctggatgggagaatggtgtgtggaaaatggaatccatattcagaaaagtcgagaaagactggaacatggtttatttggcccgaaaagaaggatcatcttttgcttatatttcctggaagtttgaatgtgggtcagctggtctaaaagtagatactgtttccatccgcacaagtagccaaagctttgagtctggatcagtgaggtggaaactgcgatctgagacagctcaagtcaacctgctgggagataaaaatctacgttcctataatgatttttctggtgccacagagggttacattagaagcagagttaagcagaggagatggagacgttgcttggcaacataccccaactgtttagacaaagcttaaatgacagtggagaaaatggcttggaaataattataacgttcaatgacctctgaaagcctgaacttcagggaaatgctggctacaatcactgacccgccatggcctccagtagtgtattagctcagtgtgtatctagttggcagttcaccatcctgtgcaacaggtttcttttgctggctgtacatcatgtaatcctcattaaagtatatcttcatagtgtggaccataagaaatcttcaattaaatgctaacttctgcctgtgattagaatttggcataaaatatttggcataaagtaactgtatgaaattctaatctaaacactgttactaaagttgtaagtgaaaatgatggtattcatgattaaatgctgttcatgactgtgatacaatctagggctactagttacttaacattttctgattagatttttccaaacattctcaattttgaataactgtcaaagtcaagtatcttatgtcatatgatgcatgaaggtttttatcattgtaaatatctggacagttaaaaaataaaatggattatttttgcttta

SEQ ID NO: 711 - protein, 647 aa, Mus musculus
GRGARGGEGRGAAMASATLGSSSSSASPAVAELCQNTPETFLEASKLLLTYADNILRNPSDEKYRSIRIGNTAFSTRLLPVRGAVECLFEMGFEEGETHLIFPKKASVEQLQKIRDLIAIERSSRLDGSSKKVQFSQHPAAAKLPLEQSEDPAGLIRHSGNQTGQLPSLPSAPMVVGDSTILKVLQSNIQHVQLYENPVLQEKALTCIPVSELKRKAQEKLFRARKLDKGTNVSDEDFLLLELLHWFKEEFFRWVNNIVCSKCGGETRSRDEALLPNDDELKWGAKNVENHYCDACQLSNRFPRYNNPEKLLETRCGRCGEWANCFTLCCRALGFEARYVWDYTDHVWTEVYSPSQQRWLHCDACEDVCDKPLLYEIGWGKKLSYIIAFSKDEVVDVTWRYSCKHDEVMSRRTKVKEELLRETINGLNKQRQLSLSESRRKELLQRIIVELVEFISPKTPRPGELGGRVSGSLAWRVARGETGLERKEILFIPSENEKISKQFHLRYDIVRDRYIRVSDNNTNISGWENGVWKMESIFRKVEKDWNMVYLARKEGSSFAYISWKFECGSAGLKVDTVSIRTSSQSFESGSVRWKLRSETAQVNLLGDKNLRSYNDFSGATEGYIRSRVKQRRWRRCLATYPNCLDKA

SEQ ID NO: 712 - DNA, 84073 bp, Homo sapiens
tcctgtgaacataaccatttcttcatctattttgttactatgcttgacatttttaccaccagcaactactcactaaaattcaaaagtaggccaggcatggtagctcacacctgtaatcccagcactttgggaggccaaggcaggaggactgcttgaggccaggagtttgagaccagctcttgctctggcaacatagcaagaccccaactctactaaaaaaaaaaaaaagaaagaaaaaagaaaaacaaacaaacaaaaacaaataaaataaaattcaaatgtataatttaggggtaggtaaactatggccctggctagatgcctatttttgtaaatagtttcattggaacacattcatgcccacacatttacatactgtctacggctgctttcacatgacaatggcagagttgattagttgcaacagactccatggcccacaaagccaaaaatatttactatatttttcccattacagaaaaggttgctaactctggctaatttaactgagtaaaacataatatgatttaagaaagctaaactattagctatctattaacacattatcagggactttttatttttatttttttgcattttaaatgcactaatctataacagttaacttaaatgtagtccttaaaccagcagtatcaccatcacctgttagaactacagaatctctcagcctgggaaataaagtgaaaccccatctctacaaacaaattcaaaaaaaagaaaactggtctcagtggcgcattcctgtagtcccagctactcaggaagctgaggtgagaggattgcttgagcccaggagttagagactgcagtgagataagaccagcatgggcaatacagagagaccctgtctctaaaaaaacaaaacaaaacagaatctcaagcaccaccctagacctacagaatcagaattagcattttaaataagatccctaggtgattatagtttgagaagtgctgatttgaaaagaacagaatcctgttgaaatggagcaaaaccagacacatctagaagggttgactttactttccaagtctgatgaagggtcaaagaggaggactttgtgagggagcacactgatgcttaagcacaaatgcaggcgtgaaaagttggcaaagacacacatggtcttttccacaactccattggtttttaactcaaatgcaatttttgtaagtatgttcaaatgctttgaaatacttcaaatgtcttaagcaaagaactaaacaatcttgtttagtctaaaaaagaaaaacaacagagatactgtacaccaaggccagacactacaacttccctaatttgggattcccaataaagtgtcttatttgaagaaatatttcgaaggaaataacccatctttaccttaaggcaccttctccttcaggatcaggggcagttatgtgaccagcatcacctgagagtccatagcccaaaacttctgcatagatccgggctcttctttgaacagcatgttcatattcttccagcaccagcacagctgcaccttctcccattacaaaaccatctctctttggatgaaatggtcgacatgccaacttgggatctgagtttgtgctcagagcccgggctctggaaaacccagcaagagataaagggctaatacaagaatctgtacctccagccaccatcacatcagcatcaccatgggctataaatctaaatgagtctcccacagcatgagctcctgtggtacaggctgtggatactgcatgatttgggcccttgagtttatatcgaatgctgacctggcctgctgccatattgaccagaatcttagggacaaaaaatgggctaactttattgtaaccttttgtctgaaaattcaaagcagtttcagaaacaacttcaagaggaatcattcccatgccaattgcaacaccagtagccacttgatcagcttctgactgaggatgccagccagaatccttcatggctaattctgcagccccaatggccatgatggtgggagaagacatggacttgatatctgatttggacacaaagttttgttcattgaactgaccttcatcactacctcttggcacataagcagcaacactgcaagggatactcttatactcttcaccaaccagtgaaacaattccactctctcctccgataagacgatcccaaaccaggtgagttccaacaccaagaggagtcactaagccaatgcctgtaatgacaactcgcctatgcaatctggatattggcacagttccgaaaaacttccttttacttcttaactgttggcataatcttgaacatagaagacgagtgcttgtaattttcaggaaattttgcaggcagttggacatgattaagattcagatgatcagaaacacattcctgtaaaagaccacaacacacctaggaggtattcttttaaatagcttaagggcctaaggaaaaacatccaaggtgttcctttgggtgcttgatatgagctgctaatgaacacagggaaaatgttacatactttcaatttataccttaacatcaaactatctgtttaaacttaccttcttttttagaccttaagtgccgtcagacatttgaagacaaataaatgaattgatgattcattcgagtcaccaaaacagtaattcaatgaaaaatataaaggcacctccagcctgatttgagctgcaggaagcatcctttgtcaggattactgataacttcttctaaatagcatttctggtgtcagtggcacagaaaacacatttcagggcatattcttttaagtaagtaagtgggctttatcaatcttcagtacttaaggataaccagccttttcaaaacgctacccagggccaagagccctagactgagcgtctggatacatgggttggcaatacactctgtgaccaagcttgcgatgggggaaggggacaagtctttccactcctctaaacttctccaattgaatcattggtggaaggaggggttacgactagtggatcacttcaagggtactacgaaggccaggggcgggagtaaaagagtgtagccattccctgtatcgcctctcaggcaccaccacacatgtacacagcccgaagaagcatggcgagagaaaaagaaatcaggccccaggtcctcggactcccctctcgaaattcaaccccgacttgatttgaatgtaaaggaggaaaggaggggcgaaggaggagggtagccagcgatacctgtaacggggctaccccggacacttctccacagtcgggggcgatgacgctctcgagcgcacgcgcacacgcacgtacgctcatgcgcgctcgcacgtacgctcatgcgctttcccacgcacgcgtcccgttcgactctctttccgccggttgactttaagccgcgtcaccttggctgaggtcagaccgtgggaggcggctgggtagctgtttgcgtgagcagagacgcccctctcggaacctcagtgactcgccgataatcgaggacctgccaataacgcgatgaggtagcattttcacccatcaaaaaggcatttttctttggcagtgataatgcccaaatattcccttttgtcggagaagggacaccatcgtattctactggaattgtaagaaagaattaaggaaattctctgcagtttcaaagttattgctatagctcgcaacgttattagtaattgtgagtaaagtggaattaaccaaaatggccaacatcaggaaatttgttgtgtatcttgtggtacatccaaatgccatgcagccgtttaaaataattctgcaggtgaatatttattaatgagatgttgcgactatttgttaggagacatagttacaaaacagtatatatccgttttttcaaaaataattctttaaaggtctgcaagatgtatactgattgtgatctttccctccttatttttgcttagctttatttaataaagcttttctacaataaacaaatgtttttgtaataaagtttttactttttaaaagttgtcaccaggctgttctgcctatggagtagtcattctttgttcctttactttcctaataaacttcctttcacttaaaaaaaaattatcaccagatttgagacagtgctcaaaaattgtctccattgtcacaatggagacatttgtttctaagtgtgaaaaattcattaactgtttgcttagagctgactgcaaaccgataaagggaaaatataacatgaaaatgtaaaaaagcaagaagtcgacaagatggtattcatcgaacatctgtttttcacatgctatcccaggcgtgagttttgtccttgctcttctttagaaaaatggttgagcatagaatcttcatctggaccttctagtcatatttatggttttttctgggcaatgcctcttgaagccattgtttccaagtagagtgctctgcattctttcctacccctacagaagaatgtgagtcaagcttagctttccaggttggtcctggatttaaatgagtttggaaatctattttgtttaaaataattcagcaaagctcagtttgaccttcgtcccaggcctaaccagtcacctctagttgatcctcattcagtgacaaagtagagtttcttgaagaattaaaacaaacacatgtggttataaagtaacacttgatgagtaagtacctaaacttgatctcttttcattgctgtctttaaaataatagtgtgaaaatacctacaatattttctctgaagctgaactcatatgaaacatacagttttaatgtgctatttcttttgtaatatcacaaaatcgtcttggctaagaggtgacaaaatctttcagaaaaataaaaagaccatcatttttgtatctacctcttatcaccttttctttgatctggaaaagggtgggaaattttatgatatttaatggctttacatatttggtaccatatttcctgctacaattccatcgtgtcttcttgcaccaaaatcttcaaatgggctctgcttatcctaccctcctattaagacttcctaggtttgccttaaattctttgtaatctgattcaaaactatctttccaattatggctcccattctctattaaatgagcttgccacccagcaaactgattttctcactatacatgtcttgattgaccctaacttttctcatctctgtgcttttgctattttcaacaaccactcattttcttcctatcaatgcttgaagtttgaatgcaaaaatgagtagaggtatggctcttgctttcaagaagtttatggtctagtaaagggagacacccatagaaacaagtaagtgcaaactgttgaaacaggtgctatagtggaattattataacacaaaagggacaatgaggtctgtgctacctcgtaaagtcagaaaaggcttcagagaaatgatccttgaactgcatcttggaaatgaatgtttgtctagtaaattgggtgggaaagggcatcctggcaggaggagaacaaaggcctggagaaatgaagtgtcatggtatcttccacaaacagctaaatatgtggcccatgtcaaatttgaagtgtgggacaaagcaacagtaaacgcatgagagtaaggcagggcccagatcacaaaagcctggggtatcatactgaggactttggatttaatcccgtagttcagagaccatatgctagccttcatggtataatttggagtgcaacattcttttattgattctaaactcctctagaaaggacatggtaaactctctcattcccttcactggagtctctcttactcctctttgtcttgaacaaagccacttaaaatatttaacttaccagcctggttcctgacaccatttgactttagaatgtggatagagggagccatagaaaactttttaccaggagaacaacatgatcagatgggtgctttagaaagatcactattgcacaaatgagcagggtgggttggaaggatgtggaaatggacacagggaagaaagttaagaatggatgaaacacgaggctctgaaggcaatggcaaggagagatccaggagatgttgagaaggaaacgttactaggatattgtacatgatttaaggagggtggggagtctctcacaggtagcaagtcctctcctttctcaccttctcaacctctcaatttaaggcttctgttcaagttgtcccccctcactgaaactgcagcccacagtgaaattttcctccctctaaactagtagttctcaaagtttactgttaatcaaaatcacctgaagggcttgttaccacacagattgctgggtcccacctttaaatgtggagcttcagaatttgtttttctgacaagtttcctgctgatgctgctgttgcttgtccaaccactgctctaaacttatgacttctatgaaagtagggaccatacttgtctccttcacagtgctgagcaactagtagtcacttcataaatacatgatgaatgaatgaattatggaatgaataaatcaacatttatccttacatttgatagtacacatgcactttttgtgcatttctcaccaaatgacttttgcgaaaaccaatgccatagcattaatattgtgataacaatgtacagtccataaaatcatggaaatcaccattttaaaaaaatcatctgaaatttaagtccttccaaataactctttagcaacacttctgttaaagttcttgagtaactgtaatctcttttgaatattgccatttataaagctattaagggaatccattatataaagggacttggtctctcattttcctggctgcttcccccacttcagtcaagttggagatattctaattcttccatttcctttagaaaagctgaataagctaccctaacttttatacccatcgttgtttcaaacaaccaaagaatgggtactaaatcagcattgaaattcttgttcttttatttatttatttttgttccaaaataaagattttttttttccccaggatttcacctttattaaaaacatcatttttagagttgacatatcatggcgctattcttttttttttttgaggtagagtcccgctctgtcacccaggctggagtgcagtagggcaacctcagctcactgcaacctctgcctcctgggttcaagcgattctcctgcctctcagcctcccaagtagctgggactccaggtgtgcactaacacgcctggctaacactattctttaataaaacaaaaaagaaagaactctgtaaattttccccacgattggtttggtgatattaaaaagttaacctccataaaaaccattagcaaggggaggagttgaagtctttcaggaatttgtatagtgattcactattgtgtgactacattgagtgattaaccaacaactctattcagtacctgctgtgtgcaaagcagtctgagacagatggcacaagagacttttaatcaaatagggaagacaaaactaatgataacttacagtgagatagcgttttagttgaggaaacaaactattatgaagagaaaaacaaaagtcattttgttcccccacaaaagtaccctatgaccattctatctgtcaggggaaagccttagctgacagctttctgcccttcacttgacacctctgcttcaataccagagcatttccactttggtgttttgtatatagacaatcttcctatgtttttgtttttgtttttttttgtagagatggggtcttgccatgttgcccaggctggtcttgaactcctgggctcaagcgatccacctacctcggcctcccaaagtattgggattacaggcgtgagccaccatgtccagcccctaaaattttatttgaaaaaaaaaaaaaaagttctgttgcatttttaaaagttacaagtactgtataatatatactattctcatataattagtaaaggataaataaatgtatcaatggaaaaagaaacccaaattaagaggaataaagtttgtgatagctatatctccagacccaagcccccaatccattgtgtagttggacgagactacatttcccagactctccccttttatctttttatgtgtttttaaattttttttttattttttgtaaatctggccttactgaaatacccccttttatcttgatgaggcctcattcttagtaatgatatggtagagaaaatgctgtgtgtcatttctgggctcatgtggttaaaagtaggtgtgacttttttttttttttttttttttttgtccaagcaggctgcctggatttgtaaataaaatttcactagaacataaccatgcccatttattttcaagtattgtctgtggagcaacagctgcagaggcagagttaaatagttgagacagaccttatggctcacaaagcctaaaacactatgtggccctttacagaaaatgtttcttgacccctgttctaaggtatggaaggagactgggtccactgacattatgacacctgcattattaaagtgttatatgagccagaaagaaattactcttgtgttaagcccctgaaaattttagttacagacggtagtaacatactactatctgttgaacacaccatacttggaaggtggtccaaagatttacatatttattaaaagcgtacgtatatttgggagacgaatagtcattgaactggatgtcatagcttagggtcttgttcggagattctggaagaaaatttcaattcttaaaagtaaacagatgaaacatcaagaaatttaaaagaggttattcaggcaaatcacttatcttaagaaataaagtcaagaaaaatacttcgtgaggttgaaaaggaatttctgcaaagaaggaagccactggtaaagtacactttcaagaacatggtggggaagagactggattaaagtagtaagggatgcatcttctaagaggaataaaagaccttgatcacatgatctacctaaaaaacaagtcacaaaatattacttacccttactgtgtgggatgcaaatttttattcccttcccgcccccgacattctataatattgcgtaattattatgcatgtgttttacgctggtcaccacgcggtaaaccgaatccacaacccattattatgtcgcaacctatggtttaaaaatacacttccttacagaggaatcatatactagttgagctggaacttagattttcagtcattagccaaattctgaaaagaatccatataacaaacccagcagagtttatagccatggttttgtttttgacgtttgttgctccttccttctgtagtctttcatccacatctatgtagaacgtcctgacaatctgcgaagagaaggctctaaggtggttttatttgtggggaaaggagggaggtacatgcggtttctccaccttaatagctggatcaattaggctggccccggagcgcaaagggatccgggtttctgagaggcacgtgccagcaccattcgcccgatacctctagaccaaagccggcctcccctccagccgagctcctccgtcctaaaggactcgacatccccctcctccaggcccacacccctcagccccggagcccaggccccgcctctccctgcggaaccccttcccaacctgtacgaccaggccccaactctgggtcgaagcacctcgcccctgccggccgaggccccccaccttcttccgaacagccccttgccccccgcgaaggggcagccgtagctcccagccgagctcccccgctcctggccccggtccccgaccccgccccaggcccccgaccccgcccctgccggccgaagaccccgcccctgccggccgaggaccccgcccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcaggtgcagggcaacggggtcggacggcgggtaccggggtgggtgggccgcggcaccttgttcggccagggactggggcgtccggcctgagcttcagagggcagcgacgcccggacagaccgggacctggagctggttctgctcctaacgtccgagcccgccggccaggggcctcgggacccggccaagtcccacccccgctcgagaaaaggaagtttctttgcagttgtgacttggcacctgcagtcagggtgctgcgggtgaactggagtcccggaagcggggccgggcggaggagaggtaggaaggcgtgcttcagacactgccgctcttctcgtcgtttaacggcctcagatatcgggacacaacggtaaccgcaccgcgcgtgtcattccccctgcgtgcatttttcgagcggagtggcttacatttccacatacttatcagaagttactcactgacaaagtgatgttttcttcccatgttgagactatccgagtactaaagcataatgcttctgaagtggtgggttttaaaatttttaattttttttctgcccacttttgttgattgaaacattatagtattttgaagttacagtttttatattaatacctggattctactatgtaacataaccctttaagaattcgtggaggtaatcgccttggatgagagtaatttccttcattctcctgtcagcaaaattgcacttctagaggtctaagggaccttgcagattttgggaattgggaggcaagtttgattattcattttgaataagtacccacctcaactcttcagatcaaatgatctgaagggacatggtgtgggggggtagggaaatggaactgaggttaaaggagagccacttgctttaggggtgttacctcatttatcaggtcaccgtgattaattaggttctctgttcccctcagcccctggtgcattaagtgtttggtatattgtcatgaagtctaaaaggaaattctcagtttcaaggttataggtttcacgtgacccaattttagacattagttacatgtgcagtttttaaaatccatgtcagtaatatttcatttaggcaatggtaatgatttttaaagtaaattgaagggaaaatatattgagcccttattttgtggcagatgctatgaaagatgcaacatgtggcctgttcacagctacataattgtgacctgtgtggggaccaccttcgtgctctgtgacaccttctcaactcaccttttttactctttgaggccttacagctcttcacagtacaaggatgccaagggactccataaatgaactgataggctgggttctccagagcccattagctgagacttaccacctggaaagccaccaggctatttaaaaccccactagtcagaaaagagaggtggccttgtaatgaagcctcacttctgctttaaatctagtgaaacccaaaatgctgaggtttagtatgagggggaaacctttgcatgcaaataatgacatttagcatcataatcttcattatgaatgtttactaatggctcgttgctgattttcgtttttgagacggagtttgctcttgttgatgaggctggagtgcagtggcgcgatcttgactcactgcaacctccgcctcacagcttcaagattctgaaagatgaggggtgtgacaatgagcgcaaaggatagtggacacactggaataatgctgagaaattaagagtttaagaaagtctttgtgcgttgcttttccaaggataggaaagaggatatgatgggtttgaagtctaatgtccctacagccctctaagtctttgagggctttagggtcaggcctttggtatcagtctatacacaaaaccacggtcagtttactcaacatacttaataagaaaaagaatttgaggaactggatgtgactgtcattgctggagcctgtttgcagtatacttttactgagaaaaatagattaatgtgaggtccagagatgatataaaaataaaattgctcactgggcacggtggctcacacctgtaaccccagcactgtgggaggccaaggtgggcggattgcttgagcttaggagtttgagaccagcctgggcaacatggctaaaccccgtctctacaaaaaaattaaaaaattagccaagcgtggtggcagacacctgtagtcccagctacttggagggcagaggtgggaggatggcttgagcccataatcatgccactgcattctagctttgatggcgaagtgagacctttctcaaaaaagaaaaaaaaaatgctcactagaaactaaagaggaaaatctatattgtatatcaatagttaaatggtaacaacatatatcaaaataacaaaggccagtcgaagtggctccaacctgtagtaccagggctttaggacaccccaggtagaaggattgcagccggggcaacacagtgagaccccatctcttaataaaaaaaaaaaatagccaggcgtggtggctcacctgtagtcctagctacttcagaggctgaggcagaggattgttgagcccaggagttctaagcagcaatgagctttgatggcgtcattgcactctagccggggtgacagagcaacactttgttttttaaaaaacaaaacaaaaactatatgagaactgatgtgtattttataagaatttttaaacaattgtgaaagcaggaagaaactagaaaattagcccagagaaagacccagcatgtagagatctgaaagctgtgaggaaaagaatagattaaaatagctcaagcagttttgaaccagtaggatatatcatcctggtggtactgacatgtttatcaccctgtgaaatacattgagtgtcaggaaaagatgccccatttatcgaaaactagctttgataaatgtaggattattttatagttcagttttcttaagtgataagaaagagaggctcacttgtgagacagtgtagcatggaagccaggaatgcgaatgttctgcagtgcacaaggaaactccactgagaaaaggccccacatgttaatggtgctgagactgagaaaccctaatctaatacacagaataaagagttgagaataaaattttctttgtatttcacaaccatctgtgattctcaaattacatatagtaaagaacaatgtttttgttttaatttccaatcccttatggacctataacttttgtaaaatacactgaaaatttcatggcaatatcaaattgctgtataccgaacattcaatttctctacttcttgcttcatttttatgcacttgtaaacaaacaaagaaaaaatttctgtactacttgtgtatgggtaacaaataatttgtagattagcaccaatctgtggacattttgaatagcaaaaaaaatagagcatttgtctctgaatattctgtaataaacatgatttttgaaattagggaaaagtttaaaaacattcatttagtatttatgacactttggccaataggcaattgactggtgaaaaacaaatgcaaaatttgttaaaacttataaaattaaaatatttggtttttggttttgtttttacgtcagaatacctagagaacatgtgtagataggacaaagttgataagtcatttgctagcatttgcctactcaccatatcataccccagggcaggtggcttcttatggaagtacatcttcctatggatcccagatactgcctcagaatcctccttaacatagtacttaaagaagtcactatcactttaaggcagttggtgtcaggtatgaaacttatcatcctaaactatgttctgagggtcttttgaatataatactatgattagcttaaccttacattcttttaattttttttaaacaattctgatttatcaaagtaattaaaaatctcaaaccaaaacttttcatgtgctggttacttgtcccaagtgtactattcaaaatcttaattatggtaaaagaaatttatgtcttccttttattgccatactgtctgtgtcaagaatatgtcttgggccaggtgcggtggctcacgcctgtaatccccagcactttgggaggctgaggcgggtggatcacctgaggtcgagagttcgagaccagcctggtcgacatggtgaaaccctgtctctacttaaaaaatgcaaaattagccaggagtggtggtgcacccctgtaatcctagctacttgggaggctgaggtgggagaattgcttgaacctgggaggtggaggctgtagtgagccgaggtcacgccactgcactccagcttgggaaacagagcaagacccctctctcaaaaaaaaaaaaaaaaaaaaaaaaaaagaatgtatcttaaactgaagcgagacccccccatctcaagaaaaaaaaatgtaccttaacagcacagaatgtaatttactgtttttacttatagtaaaaacaaccattggtttagggaagaaagaaaatcaggtgactataaaggtatacctaggtcatgtttgttgaaagtaaagtctttgaagaactatgacctggttttttttatatataatcaaacttttgttttttgtcagaaaccctaatgatgaaaaatatagatccatccggattggaaacacagccttttctactagactcttgcctgtcagaggagctgttgaatgtttatttgaaatgggctttgaagaggtaagtatgttcaaggatttcctctcccctcttcatgcacaaagcagccattatcatgttggtgaataattgtttgaataagataatgttttttaatttatcattttgggaatcagtagaagtagttatttcttcattgattggacatttaaaaatcacaacaagtatagtttaaaatttcagtaaaatgtaacaacgctccacagagaaattcttacgagtctcagttctttaaaataagggtcatacatgcaacccaaggaccaaatgtggttcactttaggcttttagctaaaacctgatttgtgagcacacatgaatactaatagagtctagctacctgtctgtagtaggaaatgaaaagagtctgaagtaaacagaaaaactgagttgagctgccacacagaaggggtttcttctgtgacaggagaggagtctcagtatttttttttgtttttacttcaaatgaatattttggtgttatcttttggaatcttgtggtgtagtttaattttatgacacatcgaaagtagttattaagattctgaattttctttatgtttatatccttaactagttctcctttgtagagcattgaaagaacttgaacaagttacagagactcaatagtcagtggtcgtcagaataggcaattgtagaagttgttaaagagatatgctgagctgctatgtaagattcacttttcttcatgcctctctgcttccctccccaggttccatttcaggccctgaagtaacagtagtgaacaaagtagtagatataatcccatctcacatagagcttacattctagtaggttaaacagccagtagatgtgaaaacaagatgagtgcaaagaagaaaataagaccaggtaatagaataaaaagtactttgcatggcaggcagtggtcagggaagtcctctctgaggagatgacatttgagctgtgacttgaaacatctcaggtacctgaaactctcaggtaagagtgtttcaggcagaaggattaatgtgtgtaaaggatttccagcagaagtaaccgtgaaacagaaataagctgcatagggaggcagagaccaggacacatggggtcttgaggaatgtggcaaaagacttagactttattttaagtgagatgagaagccactgggaatttttttttttttttttttttttgagatggagtttcgctcttgttgcccaggctggagtgcggtgatgcaatctcggcttaccacaaccttcgcctcctggattcaagcgattctcctgcctcagcctcctgagtagctgggattaaaggcatacgacagcacgcctggctaattttgtatttttagtagagatgggatttctccatgttggtcaggttggtctcgaactcttgacctcaggcgatccgcccgccttggcctcccaaagtattgggattacaggcgtgagccgccgtgcccagcctggaaagttttaagtagggaaaaatatttttgaagattattctagcttgctgtaaagagaattcctggaggtggtgggatggggacaagggatgaagcagggagaccggttagaaagcttattacattagtctaaataagaaatggtagtggtttgtatgaagtccatgaaggcagggttttttgtcatttctgttccctgtgttgctagctcctggaataatgctggtgcattacagatgttaggtactcaataaagatttgttgaattaagtactgatggtggagatggagagaagtagatggatccaggatttctttttgtgacagaatcaacaggacttactggtgatttagatgtaagatataagggaaaggaaggaatcggggacttacctatgttttggtttaagcaactaattggatgggagtatcattaattgagatagagaagccttggagagtagcaggttttaggggagaaactaacacctgtctttggacaattgtgaccaatttgctgttaaatattcaagtagagaagccaagtaagcagttggctatatgagtttacaaccccaaaggagagattaggcaggggatataaattatggtgtcatctgattatagatgatacaaaggtatccgaacataaagaatttaaaattccttgttcaaggaaatgccaattttcaagattcaaattggttgggaaaattgagtaaatgacaacggaagactctacccatttctcatgtcgaagtgtcacatattcgatagaattagatttgtctttcattcagcaaatatttgagtgccaagtagggtagccagccattccagtttgctcagtactgtcctggttttagcaatgaaagtcccacatcccagaaaacccctcggtctcaggcaaaccagtgttggtcactgcagtgccaaataacaggccacactgagacttgcagaagtatttgatgcaaatggagtcacagtctcagaaaagattaacaggttttgatatgactaatttatacttaaagtttctgttcggctttagacatcacacctcaggacttgaactctaccaccaaaaagaaagttggtggactttttaaagaataattatatgaatacataatagttgtacattatggggtacaggtgatattttgatgctagcatacaaatgtgtaatgaacatatctgagtaattggaacatccatgatctcaaacatttatcatctctttgtgttagaaacattcaaaattctgtcttctagctattttgaaatatacaatgaattgtttttaaccgtagtcaccgtattgtgctatagaacatgagaaattattcctcctatttaactgtaattttgtgcccattaaccaatctctttctattgcccagtcccttctatccctccaagcctttggtaactgccattccactcttctttatttttttaaatttttatttaattttgtaatatctttttacaatcactcttttcttctatgggatcaattgttttagctcccacatatgagtgagaacatgtgttatttgtctttctgaattctggcttattttacttaacataatgtccctccatttccatccatgatgatgcaaatgacaggattttgttcttttttatggtggaataatattccgttgtgtatagataccacatattctttatccattcatctattgatggacaattaggttaattccatatcttggccattgtgaatagtgctgcagtaaacataggaatgcagatacctcttcaatatgctgattttggaaaatggtggataggagacaggactaacttgcagctcccaattggactgacagaacagtgcctggaaactcacatcgtgaacttttgctctgagaaatactagaggaacataccaggaaaaccaaaagaattcacagaccctttgaaaaaagcagcttgctgctgcaaattccatgagacagaggaaaacctgtgagtgcccgaagtgtgatggggaaagtccactggggaacctgaaaatccagatcacgggagaagggtttaaccttacctagagctgaaattaatttagagagctgagtgaaatataaaagtagaacaagcagcgagaagagcctgcaggcactcctggccaccaaggaagccatttctgactttatctcacaggggtccttggggagggctgccagtggaattggggaaagaccacagggagaatgaaacttgcagctgaacacgaattttcctggactggggtgtgtaggggaggtggcaaatgggaaatgcagatactgcagatacaagcacagaagccaaggcagacggagaggggtgaagcctgaaaaccctgattgctttctcagtggggagacttgtagcctggggcaaaatctcaaccctgcgtacactgcctggatataaacatggtgctattggtggagcatggtgggagtgagactggcccttctggctgtgtgggagctgggtatggcctgttattgctggctttcccccacttccctggtgacctgtatgatgcagcagagatagctgtaatccccctggaaacataactccattggcctgagaaccacacccccatccgccacagtggccacaacaagcccaacccaaagagagtctgctctcagacatgcctaaccctgccttcacctgatggtctttctgagagaaaagacataatctcttgggaactctatggccctgcccactgcctgagaaacccaaatacttatgcaggcaaccctagggcaagcttacatcttcttgatactactgcagctgatgctgtcttgaaagcatcaccttctggctgggggccaaccaactgaaaccattacagcaactcattaaagaacaactctgccccaagaaaagagaatacaacagctaattccaccacctgtaacatcctggctaaccagaggtcttgagtccaatcgcatgacagctttactaccagcacacctggaattcgagaaaaccaacacactaaacaaaactgcaaccaaggtcccacacagagtccacttcactcccctgccacctccatcagagtaggtactggtatctatggctgagacttgaagacagatcacatcacaggactctttgcagacactctctaataccagttcagagcccagtagctctactggtttgctagacccagaagagcaataacaatcactgcagtccagctctcaggaagccccattcctagaggaagggaagagcaccacatcaagggagcaccccatggggccaaagaatctgaacagcagcccttgagcccctgatccttcctctgacatagtctatacctaaatgaggaggaaccagaaaaacaattctggtaatatgacaaaacagggttctttaacatccccaaaagatcacactagcatagtagcaatggatccaaaccaagaagaaatctctgaattgccagaaaaagaattcagaaggtcaattattaggttacttaaggagacaccagagaacttaaagaaatttaaagagtgatacaggatatggatgaaaaaaaatctccagagaaataaatagtataaataaaaaacaattacaacttctggaagtgaagaacacacctagggaaatgcagaatgcatcggaaagtttcaacaatggaattgaacaagtagaagagaacttcagagctcaaagatgaggctttcgtattaacccaatccaacaaagacaaaaaagaattttaaaaatgatcaaagccccaaggaagtttgggattatgttaaatgaccaaacccaagaataattagtgttccagaggaagaaaatacatctaaaagtttggaagacatatttgagggaataattgaggaaaacttctctggccttcctagagatctacatatccaaatataagaagctcaaagaacacctgggaaattcatctcaaaaagatcatcacctaggcacatagtcctcaggttatctaaagtcaagacaaaggaaataatcttacaagctcttaggcaaaagcatcagataacctaaaaaggaacacctatcagattaacagcagatttctcagtagaagccctacaagctagaagggattggggtcctatctttagcctctttaaacaaaataattatcagctaagaattttgcatccagcaaaactaagcttcataaatgaaggaaagatagtctttcagacaaacaaatgccaagagaatttgccactaccaagctagcactacaagaactgctaaaaaggagctctaaatattgaaataaaacctcgaaatacaccaaattataacctccttaaagcataaatctcacagaacctataaaacaataaataatgaaaaaaaaacaaagtattcacacaacaactagcatgatcactagaatagtacctcacatctcagtactaacattgaatgtcagtggcctaaatgctgcacagaatgtcagaatgagtaagaatttaccaaccatgtattctctgtctctaagagactcacttaatacataaagactaacataaacttaaggtaaaggggtgaaaaaagatattccatgcaaatgaaaaccaaaagccagcaggagtaactattcttagacaaaacagacttcaaagcaacagttaaaaaaagacaaaggggggcattatttaatgataaaagggctagtccaacaggaaaacattacagtcctaaatatgtatgcacctaacactggagctcccaaatttataaaacaattgctactagacctaagaaatgagatagacaacaacacaataatagtggagacttcaatactcactgacagcactagacaggtctgcagaattggcatagaagggacataccttaaggtaatcaaaactttgtatgacaaactcacagccaacagtacactgaacagggaaaagtagaaagcattcccccaagaaccagaacaagacaaggatgcccactttcaccacttctattcaacatagtactggaagtcctagccagagcagtcagacaagagaaagaaatcaagaacatcaaaattggtaaagaggaatagactgttgctgtttgctgatgatatgatcatatacctggaaaaccctaaagactcatccaaaaagctcctacagctgataaatgaattcattaaagtttcaggatacaaaattaatgtacccaaatcagtagcactatttctacaccaacagcgaccaagctgagaatcaagaactcaactccttttacaattgctgcaataaaataaaataaaatacttaggaatatacctaaccaaccacatgaaagacctctataaggaaaactacaaaacattgctgaaggaaatcatagacaacacaaacaaatggaaacacatcccatactcatggaagggtagaatcaatattgtgaaaatgaccatactaccaaaagcaatctccaaattcaatgcaattcccatcaaaataccatcatcattctccataaaactagaaaaaaacagtcctaaaatttttaaaagcagcctacgtagccaaaacaagactaaccaaaaaacaaatctggagaaatcacattacttgacctcaaactatactacaagactatagtcaacaaaacagcatggtaccggcataaaaataggcacataaaccaatagaatagaataaataactcagaaattaaagccaaatacttacagccaactgatctacagcaaagcaaacaaaacataaagtgggaaaaggacacctattcagtggtgctaggataattggtaagccacatgtagaagattgaaactggatcctcatctcttaccttatacaaaaatcaactggagctgtatgaaagacttaaatctaagacctggaaccataaaaaattctagaagataacatcagaaaaactagtctagacattggcttagacgaagacttcatgaccaagaacccaaaaacaaatgcaataaaaacaaagataaatagatggagcttatactgaaaagcttctgcacagcaaaagaaataatcagcagagttaacagacaacccacagaatgggagaaaatcttcacaaactaggtatccgacaaaggactgatatctagaatctagaaggaactcaaacaaatcagcaagaaaaaaaatcccatcaaaaagttggctaaggacatgaataggcagttctgaaaagaagatatacaaatggccaataaacatgaaaaaatgttcaacatctttatcagggaaatgcaaatcaaaaccacagtgtgacaacaccttactgctgcaagaatggccataattaaagaatcaaaaaataatagatgttggtgaaaagggaacccttttacactgttggtgggaatgtaaactagtatgacccctatggaaaacagcatggagagtccttaaagaactaaaagtagatctaccatttgatctagcaattcctgtactggatatctacccagaggaaaagaagtcattatatgaagaagatacttgcacacgcatgtttttagtagcacagtttgcaattgcaaaaatatggaatcaatccatcagtcaacaagtggatgaagaaaatgtggaggccaggcagtagtggctcatggctgtaatcctagttctttgggaggctgatgtgggtggatcacccgaggtcaggagttcaagacctccctggacaacatggtgaaaccccatctctactaaaaatacaaaaatttgctgggcatggtggcgggcacttgtagtcccagctactcgggaggctgaggggagaatcactagaacccgggaggcggaggttgcagtgagctgagatcatgccattgcactccagcttgtgtgacaagagcaaaactctgtctcaaacaaaaaagtggaatactatgaatactactcagctataaaaaaagaatgaaataatggcatttgcagcaacctggatggaattggagaccattattctaagtgaggtaactcaggaatggaaaaccaaacattatatgttctcacttataagtgggagctaagctatgtggatgcaaaggcctaagaatcatacagtggactctggggacttggagaggggaaaagtgggaagggtgcgagggataaaagactatacttttagttgagtgataagtgcttcaaaacctcagaaattaccactaaagaacttatccatgtaaccagacatcaaccccttccccaaaaacctattgaaataaaaaaaagaattaaataaaagaaatttaaaaatgcttaaaaattaagcataagaattttttttaaaaaattaaagatcattaaaaaatgattactttttttggatgtgtgcctagcagtaggattactggatcatatggtagttctatttttagtttttttgaggaaacttcatactctttttcttagtttacatactaatttgtatacccactaggaatgtataaagattctttgcatccttgccagcatttattttctgtctttttgataatagctattttaactggagtaagataatatctcattgtggttttgattttcctttctctgataattagtgatgttgagcattttttcatatacctgttagccaattgtatgtcttcctttgagaaatgtctattcagatcttttgctcatttttatttttatttattattttttgaaatggagtcccacttcgttgcccaggctggagtctagtggcacaatctcggcttactgcagccttcacctctcaagttcaagtgattctcctgcctcaacctcctgaatagttgggactgcaggtgcacgccatcatgcccggctaattcttttgtatttttagtagagatggggtttcaccatgttggccagactggtctcgaactcctgacctcaagtgatacacctaccttggtctcccaaagtgctgggattacaggcgtgagccaatgcgccggcctcttttgctcatttttaaatgagatttgttttttgctattaagttgtttcagttccttttatagtctggttcttaatcccttgtcatttgaatagtttgcacatattttctttcactttctagtgtgtctcttcacattgttctttcctttgctgtgcataagctttttaatttgatgtgataccttttgtcaatttttgctttagttgcctgtgttcttaaagtcttactcatgaggccaggcgccgtggctcacgcctgtaatcccagcactttgggaggccaaggtgggcggatcatgaggtcaggagtttgagaccatgtctaacacggtgaaaccccatctctactaaaaatacaaaaaattagccgggcgtggtggcgggcgcctgtagtcccagctacttgggaggctgaggcaggagaatggaggttgcagtgagccaagatcgcaccactgtgctccagcctcggcgacacagtgagactccgctaaaaaaaaaaaaaaaaaaaaaagtcttacttatgaaatctttgcccagaccaatttcctgaagtgttttcccaatattttcttctagtagtcttacagtttaaggttatactttaaggtcttacacttaagtctctaatccatctttttttttttttttttagatggagtttcacctcttgttgcccaggctagagtgcagtggcacagtcactactcaccgcagcctctgccgggttcaagtgattctcctgcctcagtcttccgagtaactgggattacaggtgtccgccaccatgcccagctaattttttttgtatttttagtagagacagggtttcaccatgttggccaggctggtattgaactcctgacctcaggtgattcacctacctcggcctcccaaagttctgggattacaggcgtgagccaccacacctggccaatcttttttttttttttttttttttttgagatggagtcttgctctgtcgcccagcctggagtgtagtggtgcgatcctggctcactgcaaccaccgcctctggggttcaagtgattctcttgcctcagcctcccgagtagctgggattacaggtgcctgccaccacgcccagctaatttttgtgtttttagtagagacggggtttcgccatgttggccagcaggctggtcagctccctacctcaagtgatccacctgcttcagccccccaaagtgctgggattacaggcgtgagccaccccgcccagcctctaatccatcttgatttgatttttgtatatggtaagatacagatgggatctggtttcattcctctgcatatggatatctaactttcccagcatggtgggcttttgtaaatggagtatgaacctaagacctatcccaaaattttcaactgtatattaaaattctggatacttttaggcccacttgtctctgaggctgcattcttttttatgacagtttctgagagtgatgttgaaatgaaaaagattaggatccaaatggatctgtgaccctacagtttatctcagtggagtagttttccaccaggagccatacctgccccctccacctgcacctctttcttcaacctgttgaagatgagtacgggaaatttgctagggcagtttggttgttttattgactggacgatattttcagcatttagtggtcagggtcaggtttgctaaatatcctgtaataagaattgtctcaacaaaaatgccttgagaaacaaatttgttaaatactagaattctttttgatttctttttttttttttttgagacggagtctagttctatcgcccaggctggagtgcagtagcatgatctcggctcactgcaacctctgcctcctgggttcaagcgattctcctgcctcagcctcccgagtagttgggattatagttgcctgccactgcgcccagccaatttttgtatttttagtagagacagggtttcaccatgttggtcaggctgatctcaaactcgtgaccttgtgatttgcccgcctcggtctcccaaagtgctgggattacaggcgtgagccactgcgcctggcctctttttgatttcttaaaatattattaaatctagtgcattaagcttataattttgtccatttatgaaaataacagtgctgttggttaaattttttgatatagacactttggccataattatatcttcttttaggactggttgtaaagggactgaagggaagggagcatggcatgagcagcgtatctgtcttactggggccctgtctgagttgtggactgagacctacatctaaataacctgtcatgctctttttccttctctgtccatggagttgtttgcctttctcagtgctgttccagtaacattatgagatcagatgccttcatatttggttttaaaccagatgtctggtttctcttcctaggcctcctcctagatataagaagattctttctaaggttgaaaaagtcgttgtgttacaatttgtgccagtcgtctaatcattacagttgtacaaatgttctccgctcattcccttcaactatttgtgcaagctcatgggtttcagtctctgttcagtcaaagatggagtcatttatagcataacgattaaggtcatggagtctgaatccctgctctgccagttgttctgtggcttcaagcaggttaacttccctgagcctttgtattttcatgtgagtattggccgggaatggtggctcacgcctataatcccagctttttgggaggctgtggtgggcggatcacctgaagtcaggagtttgagaccagcctgaccaacgtggtgaaatcctgtctctactaaaaaatacaaaaattacccaggtgtggtggcgcatgcctgtaatcccagctacttgggagactgaggcaggagaattgcttgaacctgggaggtggaggttgcagtgagccgagatcacaccactgcactccagactgggcaacaagagcaaaactctgtctccaaaaaaaaaaaaagtattaatctaatacctacttttcagggtagttgtattacttgagatgatgtatttaaaacgcccagcattttgctttgggaggctgaggtgggaggatcatttgaggttaggagtttgagaccagcctgggcaaaagagtgagacccctgtctctccaaaaaataaaaatcatccaggtgtggtggcatgcacctgtagtcctagctgctgggaggctgaggatggaagatcgcttgagcccaagagtttgaggttatagctttgatcactccactgcactccagcctgggtgacagagggagaccctgcctcagagaaaaaaatgcctagcacagtacttagaacacacaaagacaatacattgtagttgtcttttttatagcaattatgaatcatacgtggagcttgctggtctaatccagctttttaaaaaggattcagatggaattgactttcatgtcattgagtaatgtcttgttcagttgattcctgtaggtctgccatcaccagggaaatacagtaatattgtcgattttggagtttaatttaaatgctcatgatctgcaggtctgtgtactacagactgttgcaacttttttttttttttttttttgagactgagtcctgctctgtcacctaggctggagtgcagtggcacgatctcagctcacctctgcctcccaggttcaagcaattctcctgcctcagcctcccaagtagctgggattacaggcacccgccaccatgcccagcttatttttgtatttttggtagagacagggttttgccatgttgaccaggctggtctcgaacccctgacctcaggtaatctgcccatgtgagcctcccaaagtgctgggattacaggcgtgagccaccatgcccagctgcaactttttatcttgtttgcagttggagaaattactgtttttaacattgtttcttttcaatacctggaaatttgatcaaatacattgtcatttcatttcaccttttttcttgttttgagtaatttactgttttacattatagaatttgttgtagcattttattttaaagcattcttagcatatttataggtattctttaaatgagtcactactgaaatacatgatttttatttcttttgttttgttcggattaccttcctattactgttaaccatccatagttttggattgactatcagggtgtacttttcgttatcgtggaaaaattagttgaccccatacacaggcttctaatcatgtagctattctttaaagactcagattaacaagattcaaaggttgttagataacttcttgttggttttatgtgaccctggattcttttgtgtggctgtatctctactgtcattattatttcatagggaatttcatagagaatagtagtatcatatactattgcagagaggataggaatatgcatttttgcaacccttatgaggccttctgacttattgtttctagaagatcaaatattttttcctgaaagtcctttgaaccacattaaataggctaaggattaaatgccaaaaaggagataattttttttttaattttctggtttatgtttaggcattatttaccttaggctgtatttaaaaagaaccataatggtaagaaaacagtatgattttagaaacatgcattctatattattggtttcattatacatttctgtgtgtgtgtgcacaaaagaatgactgcataaagcaaaggttcacattttttttaattttataaattccagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggtaatgttagaattaaaccttctttaactgtttctttcaaagtgttgaaacagcaaaagctttggaatgtgttatgatttattcctgaatttatgccccatattttgttcttagttcttataactctaaaacatccaaatttcttcagctctttaaaaaattgtcaaatttcctctactgcattaatacttctgatctaaattgtacctgctgcctttcactgtgggggttatttccaacagcacaaccattatcaataccttaattcaataaaaaagcttctttaggtttaaggtaattaagaatgcattaatttaatgatagtggatgctagcaaattagtgaaattttattattaatatacaccatatatacttgtgaagaactaaagtcaaacttacaggcattcttgataaactgaaatgattccatttgataggaaattatcctgtttacaaaaatctcttttgaccaaggtccttacatattcttctcctaagtttttactgtcagaaaaattcttgtgatatttctgtaagtctaacaagcacctcaatggatttttatgcccctccctgagatcatgtgcattccattttgaataccttaggtcttcatcagttttgcagttaaggttggtacagttacagaagctcacttaacatctttcttggtttttaacaccttttcttaggagttttccaattacagtgttagaatatatcttttaagatttcctactttatctttttaattgcagtattatagtttaaaatgcacatagttaaccaatctgcaaaaaagcttgcaaacattttattttacaaaatatctctttcctgggctaagtagtattttgttagtgtcctggctcaggaaagccattcacattttcttaatcttgtttaaacttcttttcttttgttttgtttttttctttttttgagacagagtctcattctgtccaggctgtagtacagtggcaaaatcttggctcactgcaacctctgcctcccaggttgaagtgattctcgtgcctcagcctcctgagtttctggaaataaaggcatgcaccatctctcctggctaatttttgttttttcttctttttgagacggagtttcactcttgttgcccaggctagaatgcaatggcacgatcttggctcactgcaacccccacctcctgggttcaagagattctatagcctgcgcctcccgagtagctgggattataggcacctgccaccacacttggctaattttttgtgtttttagtagagacggggtttctccatgtgtgccaggctggtctcaaaactcctgacctcaagtgatccacctgccttggcctcccaaagtgctggattacagatgtgcaccaccacacccagccctttttttaagttcttaatcttacaattcagatatagttccaggtctttaaaatcctgtccgtcaccagaaagcctctaaacactacactaaaaacagaatgtcattctgttggcaaaacacattctagtgtagaagaaaataaattttctcaaaggtgtatgctattagtaggctagtgtatatcaattcttactactctagtccttcacacaaaatatcttctgtgttgaagttgagagaaattagaatgaatcttgtttttcatagacaactcttggttattcgtggatcactggaatatatgtatttctttaaagtattttgttaattatgctttcatcattagttgctatactacagaatttgacagttttcttctaccttgcccattttgagtggagatactgagaattaaaatgtaccaaagtcagggagccagagagatattttttaaagcatttaacctgtgtataaactagataagtcctagtgaacttataacttttttttttttggttaaaactatatcaagtaaaatgtcgatgtataagttaagatgatagtcactgatgttgacgtttgccagtaagcttttaagatacaaaatactggaatatattgatactcaataaatgatgatagtggtggtgattgttagaaagttaatcttgctactttttctggacattttatgttaatagaattatagtatgtaatcttttgtttctagctctttgtgtaacatttttgaagttcttcgtattgcaggatatatcagtattttgttcctttttattgttgaataatattccattttaaggatatgccacatattgtttccattcatcagttgatggacatttgggttgtttcccatgtttgcctattatgaataatgctgctgtgaacattcacatacaaatttttgtgtagacatatgtttttatttctcttgagtagattcctaggagtggaaccactgggttgtatggtaagtttatatttatgtttttaagaaattaccaagctgtttttcaaaattgtaccattttactttatcatcagaaatatgtgaggcttcccgtttcttagtatcctcaccaaccattgttactgtcttttttagtatacccattttagtggttgttaagtagtagttcattttggttttaatttgcatttgcctgatgacttaattgattttcaaacttgctggttgtacatgctaagtgtttagtgttcctaatggaagtaactttctgataatcctttatttttatacccattgccttccaaaagcagattcaaaacagcaaggacaatttttcaatgacatggtacctcagaatgttagaagcattatgtttccagcttcacaactttatctcggttgaaaatgtgattctgaagtataatatgcttaaaatatacatttagtactttttactcagctaatctaaatgtatgcttttatttagcacatgactactttgagtatgtatatgaaattgttaggaacttttcatcaactctttatcactctagaaattactgccagtttatatatgggtatgtgtttatttaaaccaattatcataatttgtgattatttcattgaaattataaaagtcatatattatcagataatgataaataataaaacgaactagttaattttaaaactaattttatctcataaaccaacaataaggcaacctcttagtcttagtctagatctgtgtgcgagctttttttttttttttttttttttttttttgagacagagtttcactcttgttgcccaggctggagtgcaatggcgtgatctcggctcaccgcaacttctgcctcctgggttcaagtgattctcctgcctcagcctccgtagtagctgggattacaggcatgtgccaccacgtctggctagttttagtatttttagtagagacggggtttctccatgttggtcaggctggtctcgaactcccaacctcaggtgatccgcccaccttggcctcccaaagtgctgggttacaggcgtgagccaccgtgcccggcctgtgtgctagctttgtaagagaagaaacctatttgaacataagatttaaacatccactttctttttcatgaacctaccactcttaaaagttaatacttgcatgccctctgataggggattacattgtgtccttatatcagcatacttagcgtatgttaaaaatgaagatgtgatctgttttgacatgaataacattattatatggaaaaaaggtaaactgagaattccaaaattaaacaacatatgttgtctgtatatgtgtaatattttgatttttcttattagaaacatacacacacacatacatatatatatatgttcatttttttaaaggtttggaaggccatacacaaacatcttaaccataatgtactctgagtgatgaaattatgggtgctttcatattatttatactattgagtattttctgaaatattttttgaagcaacatgtattacctttataaatagaaaagtttttctttaaataagtttattgaagtcacaagttgattaaaacatatttaaaataacaaaacttttatgtctaaaaacaggttctaaattttaaagcctcaaaataaagggttgcataaaattaaagagagggcaagtaggctcaagccttgatttgttgtgtgtgtgtgtgtgtgtgtgtgtttttttttaactaaagaagtgaatttgctaatctaacttccattgattaattaccacgatttgacaaaattatacacattgtacttttttcttatgaagtcttaaatatatctcatatcagaaatcaaaataattggaagtatgattagtgaaggaaaaatctctttgatctaaaaccaacagatttcacattttaaacttccatttgtactctaagtaactttagtctctcaattaactgctgccttatgtagcattagtacatggttacccagctgctgtaatcaccatgtaatcagcaactttctatttttatgacttagttttttcagagttgtgccaatgaatatgtaaagaaataaggcaagaatataaactttattgtttaaaatattttgagtgccattaaaactacaatgaatgaggtaatttccagattgaaaagaattaaattgaaaataaaaatactccggatgaattcttaccttcttggtaaatgaaagtctgcatttaagaaaaataaaatgagacactataagtgcttcattttaatatgaattttttcaaataaaaatggagacatttcttttttttttttttctgtttctatactaatcctagtaaaggagcatatttgtttccatggcgaattccccagacttgtcatcaccaactctacatttcttttgtcagctgttgtacccatctcttctgtaatggaggcaatgtgtctgctcttaataaaggccagttgctcctctctccctgtatcccttctcctctgttcaccatggaatctcacatggacagtgccccatcttggacctgttcttttcttggggaatcttcctagtggcatttaaaccttgttttaggccagttttcatttaaggttgttccactggaatcacacgcaaatttctgaacataattccaggctggctgaatcaaaatggaagaggggtgaagtttagaatctacatttttaacaagcaggttaatgtttaagagctttacctttaagctctcctatcttagaaacaaggcaacatacaaatatccctggtcctccatgccctgtctttctcacctcttcttcccagtactcattgttgcatctttatttcttatatacgtttctagtggatctccatactttaattatatgccctatcagtaaaatatttttcagcacatattgtcaatatatttttgttcatttgtttatgtgttatatacatgtactactacggcaatatactgttcacattataagacaatgtaaagaggatctaaatagtaaataatatgtttaattcaaaaaaatttatttatttattttgagacagggtctcactttgtcgctcaggctggaacgcagtggcatgatcacagctcactgcagctctgacctcctgggctcagatgatcctcccacctcagccttccaagtagctgggactacaggtgtgtgccccaagcccagctaatttttctttattttttgtagagatgagggtcttgccatgttgctcagggtggtctggaactcctggtctcaagcaatccgcctgcctcagctgccaaaagtgctagggttatagccataagccaccatgctccaccaaaaaatttattaatactatattacctaatgaatgtatacaaatccatatttaaaatagtcttgataattttgaatttaaggggctttgttagatctcattagattgttagtgattttcttttttgcactaaaatgtagctgttgaagtgcttatgccaaaaaagcagatgatgtgtttgccctgccattttctctttgttaatgtgtgctcttattattagtattggccttagggcctagagttctttgtaatctttttaagctagattgaggattaatttagttaaaatcatataatctgtaattccacttaacccagtacatttgaactgcacagctttgtcacatgacagctgcagaagtaggagtgcgggtgccactgttaaccctttgactttatgacatttttttctcttacctcagggtagcttctccagtctgtgagggaggcactgttaattcagatagtaaatattattataacttaattgttttacttgtcagacaaaatataaacagaaattctcatactttctgtccacatcctcgtggaccttcttgtacagctcctttgctacagcttagcaagcccactgttgcacatcacttgtatgactcagtctcttgcaaattgttttccttattaatgctatcattagactgtattcttactatggtcagtgatttccatgttgccaaatttaattgacttttttcagttggtttttaccattcggtagtcttttttcttttaagctcaaatttttattaatagccttggaacaaatacattaatatttccttacagtcatatagtattatacagttttgaaagaactttcacgtataccagtcgaacccttacaacagccctgtgaggtaggcagggtaggtgttattttcctactactattgagagcaaagctaagaggtgaagtaaggtcacacagttggtgaatgatggagctaggactagaacctaggccttttgacttgcttcctccctgagaacattcaagtaatgatatcctatgctatataacaaatatttatctcctatgaagttgatcaggtctatttttatacattttacctgtttttctattacctttccctaatatcaaaaaactttaaaactgatgagacatttgagacatttcttctctgttactggactttttcttagatatatcaagcactagcctaagatgaaacttctgttttgaggatccttggctataaattctaaattatgatatgaacatttattttacaaaagtctgcaaatatatgttgaacttaagaaaaacaaaacaggtctgtttatattctcgaaagctttccatctttcccaatatgactttaagatgtgtataagaggaaaactgggaaagtgttcagcaatattacagtattattgggaaaccaatgcagagtgcacataaatgcaagtcacatcacgccacactagtttattttctttgttggccttttagaggatggagaaccattagtgtcttactttcaggtttgatcccatcttatatgtgatatcctcagcaactagctaaaaatgtgatctgaattataccaattggaggactcaagcagcagtgatcaaaacatacgtgtatgtggtaaaagggaagaaaacacttgttcttcattggttttgcctaggtccagtgtaattacttatcaaaacaaattttaacctatagcatctctgttaaatttagaaatgtgaaatatggtagagttatcaacttggaatataagactaaaactgtaactgacccaaaactacctgtcaaaagcacagaaagctcaacaggcataaaaactaaggagtaaaacccaactgttctgacatagagtgaaaaacagcaaatgcaagccatcaggttaaagtgaatcacaaaacattaggcatatagagaatgttttaaaaatatgaaaatgacactgagctgtattaccaggaatgatattttttaaattccaggtatggccttttacatttaagaacaatggagagaaacaaacctatggggtaggtgcagaaaatgaatgggatttagaaagggagttcagttggggaattaaggaaggccaagaaacaaaaacattcaaaatggatttagaatctctcctctaaatccactctttccaaaaatgtttcctaaattgagagatttggtaaaaataaaaaagctagtgacaacaaaagtggctatattaccttataaaataaagtagtatttaaatgtagattagaaatcatgctgtaaaagataaatctgctgaccaggctgtagaacctaaaacttaggtgctgctgtcagtgataaaaggcagaaaagtgtctcaaaaacagaattgccatataaggactcaacattaatgaaactattaagaaacaagtacttaactgtttgtaattgaagcctaatgaaaagcacattttgtgtgtttactaaagagatctaacagttttaactaatatgaaagtcttttaaggtaaaacgagaagatctagaatattctagttcagtatattgggctcaaaaccagctttccttttgaaatgcatctagactagactataattccttacatagtatcattgtcatcatcatcttcatgtttttctcttcagtgggtttgcttcattggctgtgttctatgatgaaaccatgttgatgggaataagaatatttttgggcccaatcattgagggattagttggaacattttgaactgcagttattgcaggaactggtttgacaggtgtggaccgagaaggtggaatctgcactgttaaatctttggcttgtcactgacattggagttgaaactttatttgggacagacactgtttgtggggtcactatagtaggagtggtaggtttgctactaacagcaccaacagtcaatcgtagaactagcctcccttggttaggtccctttttaattaaggacttcagcctatagtttggagctgttaagcagtatctatcaggtgggagtctaggtcctgcatatggcttaatcagtggcaaaggggtttgatttttctgccttgcaatatccagtaagaaacctcttgggggaagagaggtaaaaagatcagcacgacactggattgccagtctcacatcatctgcatcaacattaggtttcttagcatggctcgaataaatttttgcatcatccagaattgtagtcacatttcggaaagcaaattccaaaatttgatttataacctttggtttgtagtctgtgattcccatatccttcgagatctgtgccatcaccaaggcatccctaggagcgttcttgggaagtgccatcttgcccaattccatgttatccagccactcgttatccggagagagagcctattggtagtctttaacttagttggtcatttcatggtttttctcctgctgcaagtggttcaagtgctgacccagttgctcgtatcaaaaaaaaaaaaaaaaagcacgagtcatctctaatgtgttcttttccttttccaaatactcttgacttcatagtacagtcaccaaaacttattgattttatttcctaagttcttttcatatccatttgcttttttttttttcctaacagttgtaaaactaccctaatttaaaccaccagctctcttggagctctgcagtagtcccccatggggtcttctgatgcctgctttctctgcatagtggctaaagtgatattctgaaaacacatcagatcgttttactcttcttgcttaagtctctttaatggcttatcattgcaatgaaaagcgaccagaaagatctttatctctccactgctttccccttagttctctgggtactaaacactgatctctctgatccttcaaaatatgctaagcaatccccatctacctttgtgctgttccttctgacaggaatggtcttttccttccctttttgttagcttcttctcatccttcctattgtgccacaaaaaagttcaggttcaaggaccttgttgtaaagtctcattttatgctatatatttgcttaataatatttatccctatgattaatttttaaccgttatatccccagcacctagcaaataaaggataaaatttgagtaaatgaacattatcagtatttgcttgtttttgtatccatagactacttgctttttgagggtaatgtccatatctattttggtctccattatttttccagtatctaacacattcacacacagacaaatatttttgagttactgtggtgggtctgtcattatttgttgaataccttttccctatagaccttaaattgatcatgtctgtcttgtgcacccattccagtgcttaatacagtgcctgacatgtaagtatttggtaatggttttttgttgttgttatcgacctgtctctactttgcaatatgcacatttaacccattcacatttattctaattgctaagatgtttaaacttatttctgataccttattttgtgttgtctatgttcttgcttttttttcttttctccctgttttgtttagatgaagttttttttctataataggtttattcctttaagagttaggaagttaaatataatctttttagtcttttaattattgacctgaaatctgtaatgtaagtttttaattttatatttttctaccaacatcttcccataagacaagaacctctgttctgctcccttccttgctacctttcctatgaaaaaattgagattttgctttccagttgtgattatctataccaatcgaaacttgtactggtgcttttatttagatcctactcccaagtatgtatttatttttaaaaatttatgtaagctatattttttttggctataataactttcctaataattcttttagataggatttgagagtgatatactttctgtattgttacatatcagaaaatatatttattttgcccctgtacatgattagtttaactgggaatgaattctgtgttcctaatcatttcccctcagattttcaaaaaaaattgcttcattgtttccaatgaaatatctgacatcaaataattttttctttgcgtgtaatgtttcttcttacttgaagactcttaggattttgtttttagccttgctattgtaaaatgtcatcattatatgcttagcatttgtttttgttttgttttccatacatactagctcttcagctatgagaaatttatttctgtttttttttgagcagttgccttcttccattgtttttactgtctttctggaatttcccttaactggatgtgagaagttttggatttatcctcaatgtctgtttgttctttttatcctcattctcagaaaatgcctttggttattaattgactgatcactctttagccatgtttattctaccgtttgacaccatctatgctttcttctttattttatattatttattttatattacttattaatttatttttgagactacattgcccaggctgggtgcagtagggcagtcacagctcactgtagccttgacctcctgggctcaaacgatctacccaccttagcctcctgagtagctgggactgcaggcacacaacactatgcttgactacttaatttttttttttttttttaagagataggatcttgctgtattacccaggttggcctagaactccctactcaagtaatccttccaccttggcctcccaaagtgcctggcttcttctttattttaatgtttaaatttttatatctagccaggcgtggtggcttatgcctgtaatcccagcactttgggaggctgaggcgggcggatcacaaggtcaggagttcgagaccagcctggccaatatggtgaaaccccatctctactaaaaatacaaaaataagctgggcatggtggtggcacctgtgctcccagctactcagaaagctgagggaggagaatcacttgaacccaggaggcagaggttgcagcgagccaggatctcaccactgcactccagcctgggcaacacagtgagactctgtctcaaaaaaataataataataaataaataaaatttttacgtccaagatctatagttgagtctttctctgaatatagtgtactattgaaactttttaaagttttttctgtatttgctgtcattgctacaggattagttcttctgatactgattctcatgcatctcccccacagttgttgtagatccatatgtatttgagaggtcctgccagcttgtctgtgaatactgcatttgcttctaacagctgtggagaagggcagtacatgttgcacagtgggatgtgccagtggcaacagttctgagcttggttactcccctttccttttgtgactctaagtatgcacacttactgctcagaggcagacctctttgttgatgaggtgacaaggagggagaagccgagataattagctgttcctccagagtccaaccactcttcctaatgcttgccctgaggacacttcctattctgtagatcctatggcttctctgcccttgggattattttggaaactttttttacttttcatcaccatcctctctggaggtttcttcctttagtcctttcatatttgccttttctctttcaggaacttctcaaaattcctggttctttaagagcacacctcttttgctactgctgtacattacagggatttaaagtggaaggggccattagatgcatagatcagagctctgtattgatccatgcttgtattcaagaattccgcatatccttatttaaatatatccttaatagtatatacaaaaggaaaaaaatagatagatcttaggctctgacacaaatgtggctgtctcctaatactaatgttatgaagtttatgggtataattattatatttaagtgaatccatacattcccttctatctgtaaaatcataaaaccacagtttttttattatatattatttttgtagcatatggtgaaaagttaatttcagtttttttttttcctattaggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtagtagctttacataatcatttattgctaaatgtaaatcattgctaaataaacagaaaatactgaaatacaactgacccttgaagaacatgggtttgaactgcatgggtccacttatatgtggattcttttaaaccaaacgtggattcacaggatgcaaaacccatatacggagggtcaactctttatatacatgggttctgcagggctgactgtgagacatgagtatgtgtggattctggtataggtgggggtcctggaaccaatccccagcatataccgagggacagttgtagtgccttttgctcttatacattgttttacagtgttatacattataaatacttaacctatttcaatttgagtttttaagaagtacaataatagtataattttattgcatatacctcatggtcacatatcaccttttttttcaattttttaattgaggtaaaatacatataacaaaatttaccatcttacccatttttaagtgtacatttcagtgttattaaatatagtcataatgttgttcagccattaccaccatctatagctttttttatcttgtaaaactgaaactatactcattaagtaataatccttccccagcttccagcaacgactattctactttgtcgctgtgattttgactattctatcttatataagtggaatcatacagtatttgtcttttggtgactggtttatttcacttagcataatgaacctcagggttcatccagtgatatggtttggctctgtgtccccacccaaatctcaccttgaattgtaatccttataatccccgtgtgtcaagggtgggaccagttggaggtaattgaatcacggtggtggtttccctgatgctgctctcataataatgagtgagtcccaggagatctgatggttttataagcatctggcgtttcccctgcttgcactcattctctctcctgctgccctgtgaaaaggtgccttctgccatgataagttttgggaggcctctccagccatgtggaactgtgagtcaattaaacctcttctttataaattacccagttgcaggtatttcatcatagcagcataagaacaaactggtacatctaggttgtaacatattgcagaatttccttcttttttttttttttggcagtttttacagttttatttaaacacaaaacatgcacatgagctgtctactcattttcttcgctgtgcagcctggcattggggttggtgactctgatggccagctgggtggctctttccatgatggctttgcagttcttggaggaaacattgtgagcaatctcagcacagtaagttttgttgcacatcagcagcacttcaagctccttgacgttgtggaccaggaacttctggaagccactgggcagcatgtgctttgtttttttgttgctcccataactaatgttgggcatcaagatctggctcttgaaccttctatgaaccctgtcgtcaatacctctgggtttccgccagttacacttaatttttgacatatcagtcagactggtgccggatgaacttcttggttctctttttgatgatcttgggcttcacaaggggtctgagggcggccatgaggccgaagaggagatggctgccacctctgtaggcagtgctgaggaggagagagcttccttcctttttaaggtgaataatgtcctgtttatgtatatatcacattttgcatatccatttattcatttattcatggatacttgggttgtttcaatattttggctattgtgaataatgttgctatgaacgtgggtgtttaaatactttagtctgaaatcctggtttcaattatttttggtatacacccagaagtgaaactgctggatcttatggcaattctatttttaattttttgaggaaccaccatactgttttccacagtgactgtatcattttatattcctgctaacagtgcacaagtgttctaatttcccctgtttttaccaacgcttattattttctgatttttcaatagtagccatgctaatggggatgaagcggtatgtcactgtagttttgatttgcattttcctaattcatgatattgagcatttttttcatgtgcttattggtcatttgaatatcttctttggagaaatgtttattcaagtcttttgaacattctttttaaaaactttttttttttacctgaatacgcatttgcagtttaatcattggtatgtgtatatttttaggtaaagtagaactttagcccacagaatatatgatagcgtcattagtgaatttaaattagtgaattttaatgtgaatctaacagaaaccatattcagaattaatccatatgaatagaccattgactcacttttatgagtagagagacattatttattgattaagagtaggttttggagtcaactgtctttgtgtaaattcagctctgctacttcctgtgcatcactgagcaagtaatttaatctctatgactcagtttcttcatgtagaaataagaatgataatttttagaaataaatgaaaaaatacatgtaaaagctgggcatgatgtactggataataggaactgaggtaaacaggcctttcatgtaaggttttatgctaatctagctaggaattaatctaactagagttgttttcttgtttgctttagccgtaggtatcagaggcttcaaattcctccagtgttcttgtcgtctcccccattgtctttaggcttccctaagaactcctcattagagtctgcatttatcctgcttggtgttcgtttagttgtaatccattgttattatactggagccctattggtgtgatggtaaggtatcaaggagaaggttctataatcttttgattaaatctcagtattttagtgggcctatatctctgggcctgtgcctttcacaagtgtttgttagcctttttacccccataggtgagacaggaaggctacaaggggctggagtcagggaaatatatgtccttcccccagttcagagaagactctggtaaaatctttttccctggagaggccttaattgtgaagaacactctgggtatacctcacaattcttactcttcccatcttttctagagccacaaaggatttttcttggttcttcattgtgaaaacctggtgggcttcctgcagacaaaatgcacagaagtgtggggacctctcccaagactgaatttcttactcccaagctagtccatactcagcttccagcagtttgtcaaaattgctatttaaatgtccttaccagtttatggctctagtgacttcttttccatgtaagcagattttgactgtgattctctatatttgtgtatctttttggactttggggtgataattcactctgtgacctcagttctctaatgggtccaagaaaagtcactgatttcagttgagctttttattgttttaaaggtgagagtattgacctctgcttgctagaaactggaagatgaaaccagaaatccatctgaaggcttaactatatgtgtctcttccttttttaaccatttgaccaattttcacaaatgtcatttatatattttgctaccctttgtattttggtaatttttgtctttttaaaaatattacactatgccatttttcaatttttgatgactggcttgggccttagatttacttctgctacaggcctgctaaccttaagacagttgttctcttcttgtattaacagtttttttcctgtgtgtacaataagaatgtttattaatatgtgattatacaggccctgtccagcttcaaagtactgtggtcctttatatgatgacttatagaaatgcctgtttatcaggtacttactgaacatgttttgtgtttgagtcattgggctgggccctgcaggggagagacaggataataatatagccttgccttaagaagcagctaaatagaagatgagaattcaaatatacagatcaactgagtgtaaagcagagtccaacaaatgtaatgtatgaagtataatttttaaaacattatgttgtagaccagcttggccaacatggtgaaaccccgtctgtactaaaaatgcaaaaattagccgggctaatttgcagttgcagatgcccataatcccagctactcgggagtctgaggcaggagaatcgcttgaaaccggaaggcggaggttgcagtgagtagagattgcaccactgcactgcagcctgggcaaaagagcgaaactccgtctcaaaaaataaaaaataaaaccattatgttgctaaatgaataaacttcagtgagaaatagcatagagacagaatgttcctgtttgtgtccatcatatttcctctctctaggcaaataacaaccaggaaattgctcaaggagcaaaaatctacaataaagagcattagttaggtgaacattatgtttatcctgatgcatttgtccatctgtcctcacagtgggaatggtcttatcagtggaccaagaatccttcaagtctattagctaagacttaaagtccatttcccataaaaatctgctgatgttccctgctaacatttgctccagcattttttctttctaattataaaggtaatacaggggttgtagaaaatttggaaaatagggagaagacaaactatcaataacttcatcacattggagtatgtgtatttaagatctgtgtatatattctttcacgcttaaaaagttttaattaaaataggaaagaaatgacacagcagattagtagtgaaaattatgaaaatcagtaaaagatttttttttaagggcatgaaggatgagtgggatttataaaatatgtcaaaatacatactaagggattggggattttcttccaagtgtagtgatcaacatgcatagaggcagagaaggacaggctctatttgggaacaatgaataatacagttagactgtgtgtagggtagggtgtatataaagcagtggaagatcaagtaggctgaaaccatattttggttgacattgaatttcagacagagcagtgtataccaagttcatttttaatgttttcaaaaaaattagtaaaatgaaacaaagcatatttctaataaggtttgaaatagtaaagaccaaagaaattcaaaggaaacacgtcttggccgaaagactaatgttatattgtgactataattgaacatacagcagaaatgttacataaccttattcatcagaaagcagaaaataatttctcaggtgttctcgaataggtaattcagcaggattgactattgaaactctgagtgacatcagactgtatttaaggaagattaatctagtaataacttgtgaaatgaattaaaatcaaaagagtacaaggagagaaaaattaaaacacaatagtaatctaatttacataagagggataagagggtgaacagagggttgagattacaagggagaagatggatgtgaaagttgttggggttatagaatatgtggaatttgcagtcaataggataaggcatcatgtatatataaggaagatgtcaaagatgactgggtaactttgaatctaggcaactaggaaattaaaggagtcagtagaaacaggttttaaagggaaaggaagagtgagttgaggtgcctactatctggactgccaagtgaaaacataggcctggaaattcgataagaagtcaagccttgaaatacacttcaggatgataggtaaagccatgcaggtaaatgagattgctaaaattgagaggacagggtggagaggtaggattacagaggttctagaaaacagtgtagcactagccacatatggatatttacatttaaattaaatgagatgaaaaatcaagttcttcagtcacactcagcacatttcagctactcaataaccacaagttagtgacaaccctactggacagtaggaataggaattatttccattattgctgaaaattctattggatggcgatattttagaaacagcaggatatgggaagaggaagagtaacaagtgaaggaaacttatatagtgaaataagtggtatggtaggcataatgagtatatcaattaggattaggttgtgctatgagtaaaatgactggtggcttagagattattttctcatgtaagaaattatggaagtagtcagtctggagctaatggtgagctatcatcaaagacctaggtgccttctgtcttttcggctcggatgtatatgttttccatccttcacatcaccttgtagtccaaaatggctgctgcagctccagccattacatttccagaccaaacatcaggaagaagaaacagagaaaaggcataaaggttttatctctaatttgagcttcttctcttgaagtagtcttccttggagtaacatgaagcttagtcatttagccacacttagccgcaagggaagttgggatctgtagttttttaactggtgcattgtcatccctccaaaattgaaattctataaatgaggaagaagtagcaagtggatattatatggccaccatcagtctctgccccagtgagtgaatggcactgagatgatgacgaagcccccgctggccaagttggtgattttctttcattagtgcagtgcactgttttttcctttccagacaaaaatcatattctgggtctatggactggggaaagtgttttggtttgatgcagaaatggggaccttgtggcactgccaaatgagatagagaagcatgatttgatagctttggcctggtagactgaaggtttgtcatgattgcatgttccagatacaggtaaaacatctttttggaggaggaagaacccatttttgaaaagtggtaacaaaatatatcttggcctactaaattgtatgtgaagatatgagatggagaacatggatgaggctacctctactgatgtttttacccattttctcattctcttgtatattgaagtggttttcagagaatggagttaggtctaaacttgttgattttattttgtcactgataagttactagaaatctacgtttatatggtatttttgaagatggtaactttagaaatttgaagtcttaattatatttttgaaataaacccagtattcacagaatttagcatctaaatcaggcttcccttatctctgagatttctgagctttcatcatacaggaatctacttttatttctctgagcccctagttaaggatattgtttaaatgaggaacattgacccttaattgggtgttactgtttaatagtcctactttcagctggattatacctggagtatgtaacagaagtacaaatactctgttttcctttcctttcttcttggtcttgataatgactatttggtgaacaattacaattctaagtaatattttgaggcatgtttgttcagtcctttcatcattcaaatatttattaagcatctagtgtatagcaagcagaacactaagtgttggggatatagcagtgaacaaaactaagtacctaccattatgggaaagagacacacacacacactagtgaaaagtgctaggaagaccaatgggagaacagagtgagtgacgactagtaagatgctgtttgatacaagattttcagggatggcttctctaaaaagcaatgatttcccttttaggtagaaggcatgagcaactgcaaaggcctcctgaggtgggagtgaggttggcaagtttaagagatggcagggagagcatggtggctgtagccagtgaacaagacaggaggagatagggtttgaggtcagagagggaagagggtatttaagtttcctggggctactataacaaattaccacaaacttggtgaaataaaaagaaatttattcttacagttccagaaggcagaaatccaaaatcattatcacagcgggaaatcgaagtatccccagagccatgcttcttttggaggggagaatctgttctttgcctcttccagcttttggttgctgctggcagtccttggtttgtggctgcaacagtctggtcttaaggccagcatcttcaaatctctctctgtcccatcttcacattgccttctctgtgtgtaaaatctccatttacttgctttttatgaggttaattgtgattgaatttatccacatattccaggataatctccccatctagagatccttaactttataatatctgcaaagacctttttttttttttttttttttttttgccacataaggtaactacattcataggctacagtgattaggacatggatatcctctgagggccattttttagcctacgacggggagccagctgaaagaacaagagttgggactttgaattttattttgaatgagatggaaacccattggagggttttttaagtcacataatctggcctgtacttttaagaagattactctagctgctgcatggtaggcactagactgagaaggagaatgacagtcctctgtttctaaaactttgtttttaatgtaactaattcatgaatatcttcctgttggaaagctttcatattatatgggaaacgccaaactctccctgccattcagttctgttctttttcatgtcttgtcctggatatttataccttaaataattatctataaaaatagtttaagttgtgtggggtttatttaaaatttatcatctcatatatattcagctccttggtgtttttcatttacaaatatgtattggacagctttttaactccatagtgtttgattgtacatacactattatttatacaattccctattgatggacatagaggttgtttccattttctctgttctaaatgccaccacagtggagattcttgtaaaccatgtctcctggcacacatgcacaagtatttctcttggatagatactgaaatgtcaagtgtgtgtaatacttttatattataatggatcctgccaaattgccttccaatttatactagaagtgtctaagaatatttgtttccacttaatgaaagtattgaatttcttttatggactttgtgaatttttctagtgggtttcttaatgttattactgatttatagaagttctttatgtatttagaaatttatctttttgagacagagttttgctgttgtcgcccagattggagtgcagtggcgcgatctcggctcactgcaacctccgcctcccaggttcaagtgattctcctgcctcagcttcctgagtagctgggattacaggtacctgccaccacgcccggctaattttttttttcttttgtatttttagtagagacggggtttcaccatgttgggcaggctgttctccaactcctgacctcaagtgatcctcccacctcagcctcctaaagtgctgggattataggcgtgagccaccgtgcccgtccagaaatttatcttttctttgttagacatgttacaaatttttcctcccagagttctttagtgtagcttttgaaattcaaaagtttttatttttaacataagaaaatttaatttttttattattgattttacagtttgtatcttgcttgcctaagaccttcctaacccaaagtcataaacataaacatactcacctataaacttctattattttatattattccagagaaagtttttttttaatgaactatagtagggatctgatagatagctatttgtcctaatatcatttattgaaacagtccatcctgttagagctgctttaaaatgctaactttattaaatactgtgcatttgcttagaaatctgtctttcagaattcttttgtttcattgatctgtttattcttcactaataccacattgttttaaatattagagttttataatatgtcttgatacacggtaggcaaatttaccttatgattcttgctcaaagttgtgttggctattttgtgcattttctctttcacatgggattttgtagttagcttgtcaattttttttttttttttttttttaatgagacagagtttcgctctgtcactcaggctggagtgcaatggcatgatcttggctcactgcaacctctgcatcccaggttcaggtgattctcccgcctcagcctcccaagtagctgggatcacaggcacctaccaccaaacccagaaaatttttgtagtttttagtagagacgaagtttcaccatgttggccaggctggtctcgaactcctgacctcagatgatctgcctaccttggcctcccaaagtgctgggattagagctgtgagccgccacacctggctagcttgtcaaattttatgaaaaaatattttataattttaattgggattatattaaattatagattaatttgtggaaggttatcagctttagaaatattgagttttccctccaggaacataaatatttctggcctttttacattctctgtagtttttttttctgtagttttttattttgaaatacatcaaacataaatacaagaacaaagtataatatatcatatacctatgaccaacatcaagctttattagattttatcattatgctatatatgtccttcatatttatgttttattatcactctgttttaatcataaaacattaaagatagagatgagaaccccctatatatgtttttaagattgattttccctctccttcccttcttgccagagataccatggtcttgaatatgaacaagagagatctgtttatggaaaagtgggtatattatctgtcatgttataacttactagggttgttatatatactagagatatggttgtgtttttatgtgtttggggatgagtatccatggatggattatattgtacagttgaagccctaatagaaaggctaataggatgattttttaaatgtctggaattctgtgatttctgccttttgtgattgtttcatgtttacttgtgtatatacctgataacaaattcaatgtatcccatttttaaatgtttttcaaaatcaaatttatttttctacctcccttgtacttcaggatcaattcctaactgactatagttccctaagaggtcattgtgttcagctcacttgttaatgcataatgtcagttagaggatataaaatggtaaatgttctactgtttttaatgtgcagttatacttgtcattgtatttcagcctagtgcctaataaatgacagtttcttcttgcctcttattagtgaaaaccttaaaatcatcttatgttttcatatttttcaggttcgtatttgagaataaatatgtttggatagtttaaattttgtcagttttagctcttacttggtcctcccttaatttctcaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaaggtgggtgccctggatggtaaaatcagaataatctcttaatgaaatagttagaagagagtttttactaaatgaactttttaatatttaattatcagaaatatattcctctaaaataccggtgagcaaaccgtggctggcaggctaaatccagccgacatcctgtttttgtaagtaaagttttattagaacataaccatgctgatttatttgcttatggtctgtttttatgctgcaacaagcagagttgaataatggtgacagaaatgatatgacccacaaagtctgaaatattcaccatctgtcttttataggaaatttgttgactcttgttctaaagtataacttgagtatagtcataacatgtttaatgctataaatcttgtattacttttttaattcctaatttttaactgtctgatagctaacaatacttataataatgctgaggtatacttttaccttccatattatcatcggatgattattttaaacacataattgtattcactctcacaataatcagcattattattatcagtcttattagcagaagtttgttttagttaggtgcttcccctgcccaacctaacctactcctcatatctctaaattttaaactaaggacattttaaattttaaattaatttccattctttaatttataagcctgttttcagattttctgaattggcaatgtttataaagtctggttgtattatcagtcaaggaaagataccacgttttaaaaatatctaattttttttagcttaggacatagtttctaatcatgtgcttgttttaacctctagctcttctctatatggggaggctgaggcaggaggattgcttgaacctgggaggcagaggttgcagtgatccaagattgtgccactgcgctccagcctgggcgacagagtgagacttgagactttgtctcaaaaaaaaaaaaaatttaattacctaagttataaattcatttatttagcttaagaaatgcttggttaagcatttgcttaacagacttgtcatcgcagagcccattcatttatgccactgtttcctttccttccaaagcacgtggctgacctctctgctcagctgcagcacttttcctgctcagctctatcagttcaaaacccatctcaacacaaaatgcaaaatttagtgttcttgaattgtctggtaattttataattggagtaacttctgaaaagaatgttacaaatagatcccaaaaaacaacttccaaattagcaggcacctttaaatacttcaaaagagtaaaattttaatcaaaatgattattagaaagaaagataatattttagataaaattgaattaaactaagctaaaatttttgttgagtaatttgttaaagttgtttaccttttaaatacagtgagctagctataccactttagtgctaatgctttaggcaaattgcctagagaatttgcttctccaaatcttacattattcaaaacacagatcaaataaaagctctcctcaccagccactttctgacctgttgtattgtttgatcactaatctgacctgttgtattgtttgatcacattctgccatatatttaaattatttgtgttcatccctttcctcaggattgtgaacaccttgaaagcagtactaccgtttaattatttttcaccaaatgttctaacattgtgcctcatatattctagatttctaaataaatatttaaaaacaaattaaaggccgggcgcagtggctcacacctgtaatctcagcactttgggaggctgaggcgggcgaatcacgaggtcaggagatcgagaccatcctggctaacatggtgaaaccccgtctctactgaaaatacaaacaaaattagccagacctggtggcatgcacctgtagtcacagatactctggaggctgaggcaggagaatcacttgaacctgggaggcggaggttgcagtgagccgagattgcgccactgcactccagcctgggtgacagagcaagactccgtctcaaaaaaaaaaaaaaaattaaacatttctgtttagcatagaggtaatgtaaattctcttaaaaatcttgattttgataattaaggttttttttctttttaaaccagatataataaccctgagaaacttttggaaacaagatgtggacggtgtggcgagtgggccaattgttttacactgtgctgccgagctgtagggtttgaagctcgctatgtttgggattacacaggtacagaatgtggaatgagcagagggtagtagggctttgcaggcttgcaggtttgggtttacattctgagcccatgattctctgttactttttggccttgtcagtctgaccttccatttgccttgtgtaaaacagtaataataccaaccttccaggttttttgaagggatcacaagagttttgtaaaacacctagcactgtgcctggtgctttgcactataaatattcctttttttcccctttatttttttattgatgcataatagatgtacatatttgggggatacttgtaatgcatttatataaattctacagagcaaatcagtattattgggatgtctgagatcttaaatatttgtctttatgctggaaacatttgaattactctcttctagctattatgaaatatgcagtggattattgtaaactgtaaacaccctattgatctatcaaacactaggtcttgtttcttttattagcaatttaccgtggcatttatagtgatgctgtttatatatggataaaaacatgtaataatgtaccatagaaatcttcattgctatagggattactgtaaaaaatttagtaaactataaacttaaagcacagtatacagaaataataaaagtcatgtgatatttgtgttgtccctatttagaaataacttgtgtggtctacatgttaaaaagttgttttccttgtgtttccattttctaaagaattaaatgaaaccttccattaatagttagtgttctcttaaaatcaaatataaagcatgtattgaccagagattctattagacttcctgctggttctgggccttaaagtccagagagagagactgtagtttcaaaagtggcattaactccttcatgatagtaaactcaggatgatattttttatgctgctctttaatatgtctaccttcttaagagttacagcgcacattaagcctaaaactgaccacgttaaaggagattggaaaaacatttttaaggatttcaaagagacagaaattaatacaggtattctaaaatcctgtgtgccacaaaatgcacttattaactgaaattcagaatattatgcattactttatgattcttaggagtttgtgtatagttattgaaagtcattctgatttcattgtcttttttccattgctctcttttctcttacttgagtagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagagcataaaagaaaaaaacttttttccaaaagtaaaatatatttttttcttttatgacagcttcatgaatgtataattaacatacaataacctgcatatatttaaattgtacagtttgataagttttatttgtatacactgaaatcatcactgcaaatcagtattcattgtatggatgtgccatagtttaccatttcacctgttgatggctatttgggtagttcccagtttttttcacaatttcaaattaagctgccatgaacactcaggcacacaagtctttatatgggcatatgctgccttttctctttgcttaatgcctaggagtagaatggctgcattatatggtagatatacatacaactttttaagaaaccactaaactattttccaacgtggttgtgccattttacattttcgcaagcagtatgtaagtttccagtttctccatgtccttgctaacatttagtatgatctgactttttaattttatcccctttaataggtgtgtagtggcatttcattatggtttttatttgtacttccctaatgacaaataatactgagcatctttttatgtgtttgcttaccatccatatgtcccctttgcttattttttttaattgggtattgtgttttcttactgtttggttttgagagttctttatatattcttatataagtccattatcagatatgtgctttgcaaagatttttctccctatctgtagtttgtctttttatgctcttaatgatttttgaagagaagaaactggcgttcagtttaccaattggttgttttatggattgtgctttttgatgttatatttaagaaattttgcctagcccttggtcacaatgattttctcctatgttttgttttagaagttttttttggttttatgcttatgtctgcaatccattttgagttaatttttttatatgatccaaggtgtatgaagtttttttttacatatggataatgaattgttctagcaccatttattgaaaagattattttttctccattgaattgtctttccacttgtatcaaaaatcagttctgtaatataaatctaatacaataaaaatggataaaatttttatttgttgaattttgtggaatcagctttgcagataaattttaaaaaggtaatgttttgaaattttcacttttttatcatagcgtttctggttaaactatcaactgtttaggaatgaataagtgacgtattctcttccgtttattttataggcttttacgttttattttattttattttaatttttcgagacagtctcaccctcttgcccaggctggagtgcagttgcatgatcccagctcactgcaacctctgcctcccaagttcaagcgattctcctgcctcagcctcctgagtaactgggattacaagcacatgccaccacacctggctaattttttttgtttgttttttttcagtagagacggggtttcaccatgttggccaggctggtctccaactcctgacctcaggtgatctgctcacctcagcctcccaaagtgctgagattacaggcatgagccactgcaccaggccccatgacttttaaattttaaacaaaggatagtattctaaaaattgcatttaaggctgggcgtggtggctcatgcttataatcccagcactttgggaggccaaggtgggtggatcacctgaggtcaggagttcgagaccagcctagccaacatggtgaaaccccatctctacttaaaacaatacaaaaatcagccaggcgtgatggtgcatgcctatagtcccagctactcaggaggctgagatacgagaatctcttgaccctgggaagtgagactgcagtgagctgagatcacgccactgcactctagcctggacaacagagcgagacttcgtctccaaaaaaatgcatttaaaaattacatacattctaggtatttagtaagtaaaggttgatggttgtaatcttgttaagtatttgtattctgttatttgtttcaggtagttgatgtcacttggcgatattcctgcaaacatgaagaggtgattgccagaagaactaaggttaaagaagcattacttcgagacactattaatgggcttaataagcaggtatggtgtggctatcttttttgaaagaacagttgacattttttatgtaatcgagaatagccgtttattagcctattgaaattcttaaagtagtagcattgttttataaacaagaatattttaatattctttttgaatattaaagaataaaaatattctttttgttcattgaaaattttgcggactcattttaaatattatgagttattttggattaaactgtctcatttcaaagttctttgaaacaaaatttcagtattggtagtacctgacaaaaaatgtgttgtcttatttatcagtgtaactgtgccttggatatgacacagactcatatttatgtattatgtatgtacatacacacacacacacacacacacacacacacacacacacacacacacacacgtccatgtgaggaaatttctgaagcaaggcacaggaagttattaacaatgactacttctgagaggaggaactggagttccaagatgaaaggttcaatttttgttttatacccctttgatagtattgaaatttttaactctatacatgtgggtttttttcataaattaaaaaataagcagtgaattttgctgtagcaggcagttagaacagggcagagcacattaatccaatcagtgataatgattccaggtgaggtttcagtctattttgaatctgcacttactcctaatgtgtagcccttcggagatctctacctgaaaacctggattatttgctagatccccttgcattagaacactctgaccctcagtttatttttaccccagcactgtgattctgctaaaaattctgctttgatttccagcactttagtcactattttgtccttggcttctcagcctcttctcatgccacttaataattgacaaatgactggaagggaaaagaggtgcagtatgtgcccttcacctcaattcttttcttctcttggaatcttgacttctcaagttctggctgcctttacagctttctgttgcactcaaacaggtgtttatatgtgagtgttctgtttgtgtgtttccactagcttttctagcttttctcagtaagacattctgacacaagccagtctatcatatccagaaacagaagttgctaccttcattataaataaatctaggacagtagagctcatggagagttggaaataggtgttaaatgatttcccaacataaaatttataaaattatttaagttttccacagtgtcctttttattttctgaataatatatgtttgaaaataaaattcagtacttgtttcaagacctcttaaaatgcaagtgttttaagtatattcttgcttagagatggacctatacattcccctaatcttaacaacttttttaaaaaacatgaattacagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacaggtatttaattcattctagcatgatgatccttttactttcctgcttcatatactatgctcttcctatactatcctccaactgcattgactatgacctttcagttaacttgagagtaattattttaaaatgcaaacatttgaagagaaccagtaattgatttacatagcattatcgtgtaagagttagcaaagcatttttaaaatgggacttaaaattttttttaccttatgtaaatttttagtgcagtgtaacttttactgaagaatatacaggaaaatgcacaaattataaatgtacagcttaatgaatgtttacaaatttaacacccatgtaatcgccaaccagaataagaaatagatcactggaaccgtagaaacaagcgtgagtttctttccccactgccttacaccctcgaaagtaatcattattctggcttctaacatcatatattagttttgcctgttattgtgctttataaaatggaatcatatagcatgtactgttttgtatatagcttgttttgtgtaactttgtgtcagtgagatacatgttgcaacgtgtatggtatgttctcattgctgtataatttattgtatgaatgtaatttttcactgttgatggctatttgggttatttctagttttggctgatataaatggtgctgctctgaacatttatattcacgttttcagtgaatatgtttaggcattttgttggatgtatacctaggagtggaattgctaggtaatagagtatgagtatattcagctttagtacatattgccaaacagtttttcaaaatggttatgccagcttatactctcaccagcagtatatgaagtttttcgacatctttgtgtacacttggtattgtctatcttttcattttagcagttctggtggcgtatagtagtatcgtgattttaatttgcattttggtgatgactaattatggtgaatgcctgttctttaaacttttggatatcctcattctcttttgtgaagtgcttatttaggtcttttaaaatgagattctaatgcatttaaaagaatgctgttttacgtttttcctctccagatgaaaactttatggagtggagaaaatacagaatttggggaattcagctgatgaaagtgtttatttcttggtatatgcttgcatatatctgatattggctagaaattgttggtggcatgattactgttatattaaaatttattttaagataccacatgattaatcttccaaaattaaataacaatggaaatataatttccataggtaggtcctaaagttaagggactaggtaaaaatcagtgtgctaggctttgtaacaggcattagggcagtataatagactgtcctttgcccttagggagctaaagttgagtcactggagagcatttaataaaatgtttaggaaatatgcaatgaaaaatgcttgaaagaaaaataactcatcacaatatcagtatcaagcagttccaaacaaattaaagttgtatttatctactttttctaaatttgccattgttacagttcatttctctagtaacagaatatgttttaaaggagtgaattatcactaataaattttatgtttgctttttaatttatcccatcgtctgtagcgggcagttaaaagtgttggttcagccataggattacaagatccaaattcaacaaataattcaaatcactgccaatgcagtgtgttacaagtataaatctaaatacagccagttaaaaagagctaatttaattcgcagctgtgttcaatttaaaacatggatattatttaggtcttcatttctttttatgcatgggtgtgctatctcttgcatggcatggaagttgattaactttaaaaatatgaattgggttgcataccacattgttttcccttttgaaattttttttaagtttcttaattgctggagaccattttagggccatggatttaaaaagaaatcattttttcctttagaaatggatgtttgttttaaaagtaaatagaaaaacattaatcctaaatacttttggaattaatcttgcaatcaattggaaacagaagaaacattggtactatcatttccagaaagaaaagttttattttaatcttagaattaaaatattttataaaatattaatgttattttggactagaatgcaaagattgcctgggattttaaggttaaaatacaagcttttgtaataattttacacatgcagaagactgtttcatgctatacctctcagctgctctcctagcttagggaactaggaaaggacactgaggaaatggttgaggactcaggatgagaaagaatccagtatgtggagagtagaaaacagcatcctagacaaagtaagcagcatgtgtcaaagccgtgaggcaaaatgagctggacctttttgaggaactaaaggaaaagtaatgtgatgtgagtgtagaaatgaaagggaagagtaacagaagatctggctggagaagcaagcagggtgaaccatcacataaggccctggtagccgtggtaaagagcttggagtttaagtcactgaagtgagttaagcaggaaagtgacatatcctagtttacattttttgaaaagtcattttcattgctatgtggagcatggataggagaggtaagagttgaaagctgggagtcagcttcaggagacaattgtagaagtccaagtagggggatagtggtggtggtagaaaagaataaaaattaatgaattcattgaatgcaaaatcacaaaaatataagtcagagctcatacttcttgtttttctctctagtaatgtttagagttataataacatcatactgattatatttaatttataaaataatttccaaattttccaatggcactaattttttcttttcaattttgaaggattctcttaccactctgcttagtaatttctcttttttcttttttacatctttcataatgttgaaaaactaattctgctttctttttaagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtaacttaatgcataaaaccatttaaaacttttgtcattgtttaaacaaatatagattggcttcatttttcagttgtgtaaaatatgaaaactgatatatcaaacttattttcagtaatcctataacctggaaaagaaaattctgtccccaatatgtaatcaaaagtccactagaaattcttgcatttatatcaaggaagtatctgttttcatcaaagaggatgaatttaattctttcatgggaaaaaataatcaaatgtatgatcaatccatatgactgatttttgcatgaacatatatacatatatattctatttgatactgtatatataaatacattatattgtgaattaattccttcacagatgtgtattgattgcccattaaatacaggctatttagggagtataatagatttagttcaaagtttcagaaagctaaacatctaacaggcattcacttcaaagaatgtggatgattgagcagcaatattggttatttcttctctgtatcttaaaaaaataattaagtagaggttaggactatagcagttcatttataccaagttgcatattatcgtcacatgctatcagtaacaaataagaggctttgctttaaaactgcctgctccttagaaacacaccaaaataaacttaaagctattcacatgacctcagtagatctgatcatattcttgatagattttcataggaattaattaacttataggaagcttttaaagttaatttaccaagatacttgagtgggaacttgttcacttgtaaaatatattggatagattaaaaaagtgagtcacatataaacagctgctagtgtttatgagcatctgttacatgctgtcactgtactaggcattaatcaaattaccaaaaacatacagagataaggtctctgcttttctctttttcaatcataagtttttgttcaaaaacttatcttgctgcttaaacatagaaatactccatttatatcacattgtctaatactaaaaaagttgaggtatttttgtattagtaacttacaggattattctaaattttggaattttcttctttagctaaagaaatgcataaaaatagagataaaatttaaaatttcgagatacctgtaattagttgtacagttgatgagagaggatgaacatcttctagaagactatccttagcctaagaatttctctgaacagaaagcaagatagaataaaagggttttttatcgaatgactagtctatacttgctaaaatggagaaaaatcatgtgtttcctcctaaccagcaatgttagtaaagtagtaatgatggggaaaatagtgatgtgttacagaagatgtgatatgccaagaaacagaactactgtatggagtatttcttctttgtcttatacactcatttgttcatcagcaaacttgtactgttgtgccaggcattattctcagctacgtaaacaaaaagatgattcctgacctcacgatctaaaaggggaagccaaagcataaaccgccatcttaaccatgatgcagagtgctataataaggatatcaacacattgctatggaaacagtgaggtgggagtaattagctttggctgtaggagttgggcaaagctccactgagcagacgacatttgagctggacactggaggttgagtaggtgtttatcaggcaaggaaacaaaaaggcatggagtacgtggcgtatttcaagatctccaaatagaacattttagccagagaggggctatagtgtgagaaagatttaaataatgtaaatgatagacaaaggccattaaatagaaaacacacccctattcaagtaaagcttatgccttgatatacttttatgaagggtaccattttttttaagttgagtgaatttctttctagctacatgtatttagtatcaaatgaagaaaaatactagaatctttacttgtagagagtgataactcggaagtaacaattgtcgttataacttaagtattccatctaaatcagtatttctggttctgtactagcatgcccccagttagggattttctagctctgttgaatagtaaacctatttctcactaccgtttttctcagtaatctccaaccaggtatcatgacagatcacatgcagcctgctttcagagttttagaacagattctttacctctcaaagaggtatcctcccaggagcacaaagattaaaatttgctatttagcaaataacattgttcagtaatgtctgaattgaaaagcatataaaaactaaatcaagaagaccagtacgctttttgggaggcaagtgataacaccttgataaaagcagtattaatagcttcctaactaatctccctctgtcctaatcctttcaaagctgtgatccatgctctcgctaaagaaacatttacaaaaacttaatccttaactgagtgctcttagagtaagacatagctccacgtcttttccaaatctggtccttgccttcttctctggctttgccttgcactgtgctaccccttgctctctgcattgcagatatattgtcccttctcccttcttcacagaacctcctatacttctcttttttgattaatttattcttaaccttaccacttggcccaagcctcactccctcaggtcccagcaaattgaatccatttccctctttatagattcattgtaccatatacctctctttcatgacatgtattcaacaaatagaaatgaaaataaattatttgtctctctctaataatgtttacattagattgtaaacaattcttagggagagaccttgtctttttctactcacttttgtactctcagtattcatatatctggcatagtacccgatacatagtaagtgtttagtaaagattggtgaatgtaaaaatgtacgtggcataaattctgcatcaccctagggctatgtagagcactgtaagaacctcactttgttgagtgtcctttggatggtcttagatactttttggttttgatgagttttatccctctctttgtcactacagtcattttagcattttggcggggtgagggggcgggtgcatggcattatgtcaagaattcattcagcactcagcaaatatgcacattgtcaaatattgtgcttggcagtctgatgtaatggtgaattaagaggcaagcctcaaggtgcgtatcagctggtaaagtgaaagacatgtgggtcaactgtttagattaatgggggtaaatggtagaagagtatgtgtttgtttatgatactgagagaaagaagacagaaacaagagccactaacaccctgaatctgagtgaaaaaaacctcatactccaagtattttgttttgttttgttcactctacaagtatttttttttttctgttctctctacaacaatcaactcagacctctgaccaaatatgtggaggggtgggttcccccaaataagcaagcaagcaattctgcagcagaaccagctgagtgacctctaatccaatcaattctaacatgatcttcctggagataacattagataccaaatgttgagggtttagtccccaagactctcccctccccacttcagatgccaatcacaagctccagtttgttttacctgtgcttctgaccaactggctataaatcaggttcctatgactctctccttggagtcagttaatttgctagagtgactcatagaactcagggaaacacgtttactggtttattataaagaatattacaaaggatgcagatgaagagatgcacagggcaaggtataggaaggcacatggagcccctctgccctccccgggtgtgccaccctccaggaacctccatgtgatcagctctccagaagttctccaaaccctgtcctgataggccttttatggagacttcattggattttcataaccatgacaacaatgtagaaatatgattggacaaaaagggtgtgatctgatactaatagcctgacaaaacccagcaaagcctgtctgttcagattcttcttggtctctctgtgcagcatttctacctccagggtatggaacaggacattttctgaaataggggttttatgacccataatcagacaaggtaggtcagataaattatttatggtcagctccaagaaagcaagttgtggggagattagagtatatttttagtttccatagcctgccttagaaataataaaggctatgggagttatgagccaggagccatgaatgaaaatctggaggtatatatacacatatcataatatcacactgagtcagagaaggccttgcagaagaagtaatatctgagttggcttttggagaggaggaagagggaaagtttcttagtatgaggacaggatatggaaggggaggttgtttggggacatgagaaatagtgtcttcaaaagcactgaggtgagagacatctggtatattcaggaaaaagtgagaagtagagaatatggaggagaatagtgagaaatgagactagagaggtaaataattgtcaggtcccagagactttgattaccttgcaattatgtaataggcaaccatgaaagtttcctattacaaatggagtaaattggaagtatacatggaaatcttaaaaattcttatccaaattctacaaatggaataaattggaagtatacacagaaatatttacagtgggaactacgagtggattcatgtttgattttcaacataaaatggaataaccaaaaacaagactcattgcaagtaccggtttaccagcaacaatttgagattccttgaaatacagctgctttgctgggtatctgtgggaatgacggacttcagggtgcttgctgtatggtgaactgaacttgagtgaatcttagcagcctcagtagaacaataattttaagagtgtattaaagaagagcttcaaacaatatagtccaaactgaacctctagggagccatagcagcctgacatgtagtaatcaaaaaatctttgagcaaaatcttctgtagaatattagttacataaagccaacatgcaaattgttctcagtcctgaaaatagtggttacagccacaacctaaagacaagttctatttttatatattgtgaatagtatggcttatgcctaaaccgtagacacacaggtcttgttctcacgcaaagggtgtatatgctcatatgtgcttacaacaaggagcaaggatgggtcactggtgggaggaggggttgggtggtatatatagaatacaggagaaaacctccatgatttctgactttactagcactcctgctaaagtaggatagcaacactcaccttttagagacctacacattacaaaaccgagcttacagaatgcacacaataaatttaaaaaaaattttttaaagccaacaggcaaaaatatgtctatcaaataactcacgatgttaggaacaatcaacagttgtaaaaaaaattttttttctctacactaaacaagtgaatgtttgcttttttttttccttttaaataaattatagttactgattgtgttcatattatacatagtgggatcagagttggaggttttttataaattctattgttgtggtacattttaatttactaaactgagtatacatattcttggtaactttctaccacctctaaaaatgagtctttgacagaatatattgtgcaaaaaaagatgataggaattttctgtataaatagggtgttttatctccatatactgttctttaacataagagaccttttttattttgctcatagtatgtttgaatgtttaaacatttaagtattaaatcatgaactctatcttattctttaactttctagagtcttaaaagctgatgatgcctttaggactgaaaattttaaggctttaataaatgctgtcagacatgttcaacagctactataaaccttctcttaaacagttaaaaccacagttctgacccagacccacacaatataattaaggcagttattggagtaagctagatttgaagttaacgtaatttcagcctatcatattttatacccacacttttgagggacatttgaatctagtgagctctgaaaatatacaagatatagaagtgcatattgagagataaatttgagtatatctgttaatgtttatgtcttaagattactttccttaagtcttttagttcttttaattcacctttcttccagtaacctctctgtttggctcttctttcccagatatccccctttgctagccattcctttaaaggagcagttaacctgtgtgtaacccagatgcctaatagtttaggatgggtgaaactaatgactcccggggaacactggtggagtcctgagtcccacatcctccttacaagcggctgtaagaggagcatgcagtaggaacatatatgaacaccagaggatgttatagtggcgttgtccaaacttgagtggagcaattgacagttccacatctaggtttgtcaacaacaaataacagttggctatacatatctactctgagtagtttaagaacattttctttggagagtgattgttcagttgttacataatctctaactcactgattctaaaaattttcagattaaattaatgggcatacctggaagaaaaatagctataggttggttgtcaaatagatggtgattagaatactattggcgattgatttttttacttgatatgagtaaagaccagaatacagaatagtacatataataggatattccatggcagatgtgttttatatggtactttcaactatttgcccctgagctagagtatgagttagatgtttctaaaaagatcaagtctaacatgaatatatatatatatatatgtgtgtatacagatctttaataatatttactaaatgtttttatttttatttttttttttagacagagtctcgctctgtcacccgggctggagtgcagtggcaccatcccgctcactgcaacctctgcctccctagttcaagcaatattcatgtatcagcctcccgagtagctgggattacaagtgtgcactaacatgcccggctaattttggtatttttagtagagatggggttccaccatgttggctaggctggtcttgaacacctaacctcaagtgatccgactgcctcagcctcccaaagtgctgggattaccggtgtgaatgactgtgcccggcactaaatgcttttatgaatccagaaactgtgcccccagagagcttatgatttgatgaagataggtcagagtatgggcagtataaaggagtatagtataaaaaaataaaaaggagcattggcaattcaaggtgggatgaaattgtggaggattttttcttttcttttttttttttttttttttttttttgagatggagtcttgctctgtcgcccaggctggagtgcaatggcgcagtctcggctcactgcaagctccgccccccgggttcacaccattctcctgcctcagcctcctgaatagctgggactacaggcgcctgccaccacgcccagctaatattttgtatttttagtagaggcagggtttcactgtgttaggatggtttcgatctcctgacctcgtgatccacctgcctcagcctcccaaagtgctgggattacaggcgtgagccaccgtgcccagcctaattgtggaggatttttaaagctaatagattagacttaatgtaagaaccaagtacttgctgtacatttcagaccaggcagataacataaagagagtgggattttaaaacattaatctgatcagagccaggcacggtagctcacacctacaatctcagcaactcaggagactgaggcaggcgttcaagaccagcctgggcaacatagtgagaccctgcctctaaaaaatttttttaaattagccaggcatggtagttggaggctgagacaacagggtcatttgaacccaggagttcaaggcttcagtgagctatgattgcaccactgcattccagcctgggtgacagagtgagaccctgtgtctaaaataatacacttgaaaataaaaatatgatcagagcaattggaattgtacaacagtagtcaattgcattaagataagtgtaaagttcaaactgtagtagtaagtgcagtattagtgaggaaggggtttctttccaagatttcaaacaaatacatagaattttgtgggaattcagacgtaagggatgaacgactgaagcgtcagagtcttaagagtttgagcatggttgaatagagtgacctgtgaaagaccaaggctgtggatgtcagttttcatggcaatgttttgaggagtgtagataaaagtatgagaggggatgagctggaagcagccagtaggcttagatgccttaaatagtatacatttaatgtgctaaagggcgttgatgaaggaacagggagcatgctatttagagaagtgagcatggatatcaccttttaaaccattagttagcagtggctcaggtattttctcgatttagagactatagcataccatgtcacactaggaaagcgtatatgaaaatccagacttataaaaattaaagagtagttgcatttaaaaggattcttcattttcagcaggattagtcataaaactcattttaaagagttgaacttcttaatataaaagaagatgatttaccaaaatttggttagaatgcagtcctttagaattgcactttttggggacatctgcattcaaataatacctgtcttctagggtaaaagatgccatgggaaaaattgccaaaaaaaatgttagcagtaagaaccttttcaacagggaaaagttagtttttaaataaccacttgtacatactaccctgtgacagtaatattcttcactaagtttgttttctatactatttcattttttctgacagttcctttctccccatccctactccttataggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcggtaagcatttgcctggagaattaatcacgaaatatatatttaccactctgaagactaattgtacttatttgagatgtagctctttttcgtacctaagagttattaatactatttcagtaaaaaaaaaaaaatttaataaaccctgtgtgatcccattgtaacagaaaggctgatgttttctgttgtgaaatacaaatgcaaggaaaaaatcatttctttgtttcaaaggatgcatttcttccataaagaataatttgtatttatttttaagggtttattttaacttatacatcagcctatataaaatacatttcaaaatgatctgtgctctttaaattaccaaaagcaaaatgttaattttttttttccctctaacagataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaatttgacattttctgatcagccattcatttcttcagaagtggttaaattagagtctcctaatatttttaattaatgtgaaagtacagtagctcataaattatataatgcatgaaaatttatatgattataaatattcaggcatttaagaaataaaatgaagtattttgccttacatctttttagtggttattttggctaaataaaaatcttttttctaaacattgaaaaatacttgaatagatatgagttatgaaaacatttaacattgacaacataaactaggatacattttaaattccataatacgtggacattttgaaaatgccttacctttgagttatatttttatctacctcattgaataaaatattcttgattttgaaactatgtaactatattatacagtatctatatgttgtatcaagaggttttgtgtatattctgtataacctctcaaatttagtgaacatttattaagcatttatgtacaaagcattgtgatagcactgtggaggaagcagtggtgaaaaagacatagccccaagcctccagattcctttgtgatattctgcaaagtgagttctcaactctttatacaagaaaaagacacactcaagagtctcaccctgtgccactcaatagaacgtgacatgtattataaaatatataataagatctggaaacaaaggtcttatatttattctttttttcttttgagagatgagatgttgctatgttgcctaagatgcttggaactcctgggcttaagcaaccctctcacctcagccttccaagtagctgggactacaggcatgagccattgctcccagctaatatttgctttataattgcagtaaaactctgttgagaatcattttttgctaaaaagttatatttcaaaagaagtttatgcatctgaaattattaatatgtcttgaatataagaacgttttctggaactctcagactcaaaattttaacctatagtggccaagtacttaagattggaagaacttgacacttacctgtcttgtggtgtctgctattggcacagtgagtattttgatgatcatatgggctaatcctgttaaccagcatgaaaaaacctagaacttttcaagcagttttataaagatggtaatagaatgtaggaactcaactgaatggatgcattctaacttttactgtggctttaagcagaaaacattattcgagttcaaatgttttatgttgttatagagttgaactgtcaaagagaaaaggtagttgcaccctttttttgggaatacttttcaatatatatacatatttttcattttactttaagttctgggatacaagtgcagaacgtataggtttgttacataggtatatgtgtgccatggtgatttgctgcacctatcaacccgtcatctaggttttaagccccgcatgcataaactgtttgtcccaatgctctcccttcccttgtaccccaccccccgcctggccctggtgtgtgttgttcccttccctgtgtccgtgtgttctcattgttcatctcccacttatcagtgagaacatgcagtgtttggttttctgttcctgtgtttgctaaggatgatggcttccagcttcccccatgtccctgcaaaggacatgatttcattcctttctatggctgcatagtattccatggtgtatatgtaccacattttctttatccagtgtcattgatgggcatttgggctggttccatgtctttgctaatataaataatgctgcagtaaacatacatgtgctcgtgtcttaatagtagagtgatgtatattcctttgggtatatacccagtaatgggattgctgggtcaaatggtatttctagttctagatccttgagaaatcgccacactgtcttccataatggttgcattagtttacattcctaccaacagtgtaaaagcattcctgtttctccacagcctcaccagcatctattgtttcttgactttttaataatcaccattctgactgggatgaggtagtatctcattgtggtttttatttgcatatctcgaatgatcagtgatgttgagctttttttcatatgtttattggccacataaatgtcttttgagaagtgtctgtccatatcctttgcccactttttgatggcgttgttttcttcttgtaaatttaagttccttgtagattctggacattagatctttgtcagatgggtagattgcaaaaattttctcccattctgcaggttgcctgttcactctgatgataatttcttttgctgtgcagaaactctttaattagatcctatttgtcaatttttgcttttattgcaattgcttttggcgttttcgtcatgaaatctttgcccatgcctatgtcctgaatggtattgcctaggtttaatcagtgtataaaaatcacaagcattcctatacaccaacagtagacaagcagagagccagatcatgaatgaactcacattcataattgctacaaacagaataaaacatctaggaatacagctaacaagggatgtgaaagaccgcttcaaggagaactacaaaccactgctcaaggaaataagagaggacacaaacaaatggaaaaacctaacatcctcatggataggaagaattaatatcatgaaaatggccatactgcccaaagtaatttatagattcaatgctggtcccatcaaactaccattaacattgttcacagaattagaaaaaaattaaatttcatatggaaccacaaaagagtccgtatagccatgacaatcctaagcaaagagaacaaagctggaggcatcatgttccctgacttcaaactatactacaaggctagagtaatcaaaacagcatggtattggtactaaaacagacatatagaccaatggaacagaacagagacctcagaaaaatacacatctacaaccattgcgacaaacctgacaaaaacaagcaatggggaaagaattccgtatttaataaatggtcctgggaaaactggctagccatatgcagaaaactgaaactggtccccttccttatacaaaaattaactcaagatggattaaagacctaaaacactttactttttttgttttgttttgttttgtttgtttgtttgtttttgagaccgagtctcattctgtcacccaggctggagtgcagtggcacaatcttggctcactgcaagctctgcctcccgggttcactccattttcctgcctcagcctcccaagtagttgggactacaggcgcccaccaccacgcctggctaattttttgtatttttagtagagacggggtttcaccgtgttagccaggatggtctcgatctcctgacctcatgatctgcctgcctcggcctcccaaagtgctgggattacaggcgtgagccactgcgcccagccaaaaacacttttcataaatatatttcatgagattttcaaccctgagcctacccaatatatgttagtagatattttattattcagaaaagtttggaaatggtacagaaggtatgggacaacacagttcttgatgatgtgaaaagttaagtgacagtaaactggtaaggcaaaagtaacttaggcaaagaatggccgatagtacagacccctcagtgagcgaccaatattaaggtacattttatttaggatcttctgattaataagctttccactgccattgcacattatttaaaaagaatctataccctggtttcaggtcagatcccatcatgatgaattccacagacactgcttgttgctgcagtgttttatttttaagaaagtcctttgctggaaaccacattctcatggtgaacgagaagtacatctgatgctttgatcaattcacaaggaaaatagtgcttctgattaaaggagggccagagaacactttgtcatagaacacttctgagatagaaagggttgttagagataatttaacccagatttcttacttttccaatgaggaaaactcaagcccagagaagggaaatgacctgtcctgacaattcaatgaatcagtggtgtaggcaagattcatttctacatctatcaagttgcaagtttatagaatcagagacctgtaagtgggttgctgttttaataggtgttatgtgaatatagatactttaatagaaatgttcaagttgagaaggtgttacaattgaagttagaagttattaatattgaaatatagaaactttaatagaaatgttcaagttgaggtgttataattgaaattgatttttctaaccatagttaagcttttctaaagactttttttcgtctacaacaataagttgtgttttgattttatagtaccagcagatacactcttcataaactaataacggatccaggtagcacaccttccttaaatacttttgggagaagaagaggaaaccaatacaggtcatgattggttttatttctcttagcatgtattcagttacactctgcatattgaccaaaacagttttatttctaataagagatttagaatagacctaaaccaatagtcaccactttttgagtttttcctaagtgccagtgactttcattgtctcatttgatcatgatggcattgtacagtagatactgtatcttatccccattttatagatgatgaaactgaagaattaagtgggagccagtattttaatggctgtgtgtccaacacccctttcctatttcttaagccacagtgaaaacagacttagaagttgcgaccttgctctcttctctcttagttttctgaagacttgctctgggcataacgaaattgttttaaaacgatataacaaaatattataaagtaaaagtgctgcctccacttcccatgctctacattattttccaagttaactgccaaaaattttacatgtgtccttctaaaggtttcctgtggattttcatgtctatatatgtatacacagaaacatatacacacacacagttttcatgtgtttgcttttttatgtaaatgaaagtatatccttttcccgcttgttttttaactgaaatcattccttggtcagtcatggttctgctacacttatttttaactgcttcacagaattccgtaatttatccattctattatttacagatatttagatttttccctttttttggttattaaaagccctgctacaatcagcatccttctacacatttctcttacataaaatacatgcaaaggtatgtgcattttaaatctgactagctactgtcaaattgccctctaaagataatttacacacccagcagtagtggttgagaacaccgatttcctcccattcttaccgaaactgaatatcgcagctgtggtagccaaccaccagagatccccgccgcttagcttccataccctttgggttgtcccttttatactaaattagagctagcccatgtgtccaatagaatatagtgagtaataatgtggtatttccgaggctaggacataaaagcctcggctttcttggactgctctctcagaaaaagccagttgccatgcccctaggacactccagaagatctgtggagcggaaccgaggcctgcctccaatcgcaagcaccaacttgccagtcatggaagtggtttctcctgccccagtcaagcctttaaaaactgtagcttcgagggaatgagacaccccaagtcacaactgcccagccaaagcactaatgaattcctcatgcatgcacagaaaccatgagagataataaatgatttttaaaagacattatttctgagtgatttgtttatacatcattagatttccaaaatagcagttacttttgccattctgaactgtgaaaagtatctagttttaacttacatttccctgtttacttgtgaggttaaacagtttttcaatattcattggccatttttgttttgtatttaaattttctatgtatatgtattatatataattatatgttaatatgtttacaatatgtaaaattgaatttatgtataagcacactcatacctttttctattggatgggttctttgttttgataatcatatttaatatccgagtctttttttttctttttttgagacggagtctcactctgtcgcccagcctggagtgcagtggtgcgatctcggctcactgcaagctccgcctcctgggttcacgccattctgcctcagcctcccaagcagctgggactacaggcgcccgccactacgcctggctattttttttttttttttttttgtatttttagtagagacggggtttcaccgtgttagccaggatggtctcgatctcctgacctcgtgatccacccgcctcggcctcccaaagtgctgggattgcaggcttgagccaccatgcctggccaatatccaactctttatgattgcttttctaaacatcagcttgcacttgatgattgtattatcttctctatctcttgagattactaattagaactattctagaagtctcttgttactgaaatatttctgttttctcttgaattatatcacattgttcaccttggttctcttttatgttttccttaaatgtttgatccactatattcataattaaggtctaaactgataataacaggtaaccggcctgggtttgctcactgatgacgtatttttttgcccgacccttcccttgggtgggagggctgactgtgggacagtataagtggtgggcgtggcatgccaaccatgagctttaccatggggttcctgggcatcagttatgcagaccctcagaccctcactccctgctcaatacttaggttcatttgttttggtgattttctttttttacttatttcttatataaagcacacacacaattccaaagtgaaaactgtatatcaaagtgcagaagttttgcttccaactctgttttcttccttctgtgtttccttcttccacccatcccaccctcatgggtaactatatttattagcttggatttattcttccatctttcccattttgaaaataaaagcaaaaagcatttctccccctttccatcactgtagacactattctatactcagacaccattttgcactttgccttttttacttagcatttcatggaagtcatgctacgtcagtattttatgagcttcctcattctttgtacatctgtgtaatatttctttcaatatatgataattcacagtttgacttatctccagtttttttgacatttaaaaattagtagattaacataaaatctggatttttttagctaatatcgaaaaatcggatcatataacaacactgtggttcataattcctgtatggaagcagttggctagtacccatgccccctttaagacaggaccagtataggaccggtacttcctgttcaccataaaccccacatccctgtctctggcttcagtgctgaagcctagtgtcagtcaccatttaccccaagacttacaccagtgttcctagagaaatactcctctgttcccttgtctaccaaggttataaaatccaagatggactaaattggttgaatttatttacacattaattcattcattttcacttgtaatcactttactcatgaaagttacctacctgtacatattagagtttgtgactgcctctaaaggaatgtactgttttgtatatattttagtcaagtttaacataattgtttcatattacaaattcttaagatgatttgacatgtcgattagcttttggggaagttgttgactttgaattggtagaaacttagactccatcaataagctacataagattgtaggaatcattactcttatcaaatacaaaatataggagactcagcaatttgtatgtcttaatttctataacttgtacattttctcaactttcaattttctgtgacgcaaatattcccaatctttgtagttgtctttggattcttgcaatgagtaattctcagaatgctttgtaaatatcaccactgcattttgtgaaactagctctgcagagctggctagctccaccatagcactctcatagtttaaaagaattgtcattagtatttttgttttttcccccagttatttcctgctattatttattttagttttaataactaaaatacaaagaagtacaaagaataatatgacataaaccagtgcactctccactcaagtaatatatattagcactgttttatttgcttcatcttctaatgaaaaacgaaacacagcacatgtaaagatgaaatctcctatggaaccttgtattagtccattctcacactgctataaagatattacctgatactgggtgatttacaaggaaaagaggtttaattgactcacagttctgtatggctggggaggcctcaggaaacttacaatcatggcaaaaggggaaccaagcataccttatgtggcggcagtcgagagtgtaaaaagcccaaagggaggctgggtgcggtggctcacgcctgtaatcccagcactttgggaggccgaggcggatggatcacctgaggccaggagtttgagaccagcctggtcaaccccatctctactaaaaatacaaaaattagcccagcatggtggcgcgcacctgtagtcccagctgctccggaggctgaggcaggagaatctctcgaacccgggaggcagaggttacagtgagccaaaatggcgccactgcactccagccggggtgacatagggagactgtctcaaaaaaagagaaagcctaacggaaactaccatttataaaaccatcagatctcgtgagaactcccacactatcacaagaacagcatgaggaaactgcacccatgatccaatcacctcccaccaggtctctccctcaacacctgaggattacaattcaagatgagatttgggtgggggaacaaagcttaaccatatcaaccctcttcctcttttttttttttttttttttttttttaggcagggtctcactttgtcacccaggctggagtgcagtggcacaatctgggctcaccgcagcctcaacctcctgggttcaaatgatccgcctgcctcagtcccctaggcagctgagactacaggcacgtgccaccatgctcagcaaatttttgtatttttctgtagaaatagggtttcaccatgttgcccaggctggtcttgaatctccccaaagtgctgtgattacaggcatgagccactgcgcccagccggaccctctttcagtcccatttctcctaccttccacagaggcacctgtaatcaggaattctgtttattctatgatcttttgctatatacatatgttaataatatacaatgttgattcgtatggttttaagtctacataaatagtatatatagtacataaggttctgcaacttgcttttttattcattttctatgtccatgttgatacatataggtcttgataactccttttaacggctgcatagattccatcatttaacagtaccccagtttatttctcccttattgacttgatggacatttaagatattcttagtgtttattacaagcagttgttagtatcacagctaatgctttatctccttgtgcataagtgcaaagtttctctaggatatattcctagaaatagaactgatgggtcataggatatgtatattttcaaatgtattgccagttgttctataaaatgtttaatgctatttactcaaatcctgcttctctacatcttggccatatgcagtattgttaaactttataatctttgccagtatgatctgtgtaaaatagtatttagttacttactttgtttttttttttctgattatggatgagtttgagtatcttttcacattt

SEQ ID NO: 713 - DNA, 2141 bp, Homo sapiens
gcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaa

SEQ ID NO: 714 - protein, 577 aa, Homo sapiens
MGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 715 - DNA, 22312 bp, Mus musculus
  misc_feature (1)...(22312): n = A,T,C or G
acacaagtgtctttacacctacccgccatcacacgcatttacacacgccatatgtacatgtgtcaggtcggttagtttgtcactcttcatgaccatattcccacattccatctgcaagcgcgcattcgctcaagacacacgtgaaatgtataaacaggtcattagcgtacgttggcgctattgaaaatattaggaacatccccccctacagcccctgagcccaactatgagttctcgcataaagtactgatggactgagtagcccttagccctggccgcacacgttacacgctcgatcacacacaacgtcgcactttattcccggcatctaagcgatgacacaatctcttgaacaaagacaacattgacaaacccaacaaaaacaaacagccgcgtctgtgtggggaggggcagccaagccagagtcaaggcatgggggagtgttgctgggggggcggggggaggagggggtcacgagagagtgtgagaaggcgagtgcgcgggcctgggtgtgaatctcaggaaaggtgtggttatatccccccacctcacaccctgacaagattggcgccccgcgctgcaaagccaagtcctgaagccactggttcccagacccacacgtataagttcttccatttttccagcttgctatggctttcagtcccacaaagccaacagagcctcacatagacacccccacccccacacccgtaagtgagcacacacagctatgggaggatctgtgcagaccccggagcgctctccgtcgctgagatatgggagtccttcctcccagagtctttttcccttcctccacctccaacgtagccatcaagccctggggcagcgcgcgtcgggcggggcgagggcggggctggtgttggcggcgccagcccaaaaggcggagtcgagcagcgaagaggccagatttgtgatcgtggtgcctactgtaccgtggagaagcctgtgggaaccttacactgcagagctctcgtcctggcctggctcggcccggccccgcgctatggagttcctttgggcccctctcttgggtctgtgctgcagtctggccgctgctgaccgccacatcgtcttctggaacagttcaaatcccaagtaagccctgagactccctggcagcctgggtgccgggttggcaatggcctttcgcagggtaactgtccctgccaacccctggcctgcgcctaggagaggtggccagggatgggttggactctatagctccccacctccgtctgtatctccccttactacctggcaacagccgaccagggcagaaacctgctcatgcctgctcgcacaggcgctggctgtttcagccctctctttctgccctctggcatctcatcactctaaagtaaggctctcctgctgggcactcctgccttgagaattggaacgttggccctggcctccggggctctctaagtccccccatgaaacttctgtgcactctcatttttgtgtgccacttgggcgtttgtatactaacaggcacctatggacgtcaagagtaagcacagcgctcagggagccttggaaagaacctccgtaggaatctaggttttgggcattagatattcattctgtgtttaagatgaccctgaagagtgcctccaaggttggggggggcataaattaggcacatgctgtgtatgggtcgaccgagggagtggctgaggtggtcacactaagggactggtaagaggagtgtcgctgggaagcttggggaggagcagagtggggcttcacagggctacaaaggctgtaacaggaaggaggtaatttctccggagcaggttttagggctatgaagcaaatggtattgagaggaagacactgtcgggccctttgttcttgcccttgagtttcttcaagttatgagaagagtgttagggccaaacctaagagggggatatggtggaacaagaagaggtgagaagtcgaggccacagaatgccactaaacccctccctcccagatccagtgagcctgcctccccttcccctgagagagatgctgggccagtttcctctggcactgcctattgagggtctgttgtctagggcatgtcggagggcaagatagagccagctgccaccctaaaggcactgtcttcctggccctggagtgctgctgcgccccaccagcccttgcgcctgcccttgcgcctgccccttgccttcctgacctagtcctgccctagtagtgggaaagagcaaagtccctgtttatgcccatgccaggtgtcggctgaaggaggaggaggggacgggaagtcatgagtagggaggggggaaccctggccttttccgttcccaagctcccaggtttcctctctttcaggaaggagcctcttccttgcccccctccctgtctactccaccactaatagagcccccttttccaaatggagacttaagtgtcacaggcaggttaagtgtaggagatagtacgctaagtatagcttcagccctggccctctggacacacacataaccctgtcttatttacagccacaggaaagccagtctagagtggaggtcatgggcggtctagccaggcccagcttgggggaagagatgaggtggcaatgaacagggcgggtgtagggttgcataggtgactcagggtagtgggcattaatcctgggctcaccaggctccaggcaaaggcagtggcagagaaaggtgccactgtgagctaggccctggtcctggagagacagatactcagctatcagatttctctgccgcttttgcccggaggccaacactggggcaaaccagtcctgggctgccctggggtcctgggggctgctcacttttgacgaggtaaaatttcacaggctctcaagagcgcctgggcgggtagcgaggtggatgaggcacgagtgagtcagtgcccatcacgggaataggggaaagacgccaggcccagagctgaaatacctgttctgaaatggcttctatgtttatctctccagagaggaattttaaaagcctccctctgcttctctctctctacccccccccgtgggggaggggcccagaaagtctcattttagaggctgcaagcagttgcaaggccaggcctctaaggggtcatgatgactgggtagtgggtggccaccgtggaaccccaccatcaccatgggcaccacccatgccaaggactcgggttgaaagcaagttggcaggcagctctgctgagcctctccctggcagagcttgggggaattcagagaagctgcctggctttcagtgggaggggggaagcactttcctgctgctgagaccctacccaggctggagccaggtgtctggagctcagtgggaggggccggtgggcagtcaggctggagcctgcagggcttggggggaccaacgggggagaggaactggctccacctggggaggagggaagagctggggcagcctcaggtctaagaaccacagcgtttcatcaggggaaggcgaaattgttactcttggagataaaatcacagagattttcaggagtgagaaagtggaacgaggagatcaggacacaaatccgagtaacaggaaagggaggtttgagggacactgagagagtttgattatctgtgaatctgttggtctaggcattgggatgctgaagtacactgggaatctgagggagactcagtgtgaggggcgggatgggataagacagggatgtgacagggctcagaaggatgggaaggagaaagagacctgggctcctaagcacagaccagcccagagtgcagtctatccaccagcatttaaagaagtccccggggaacagtcgtcagtagaatacagaggaaagtgggctatggaaatgtttagaagcccttgctcgggcgaatgcctggagagttctagaaggcacttcgttacccgagagactcttggtggatgttatttggataatgagtaagagatcggtagtgagggaatgaagaagtcaagatcagtaaatgcaggagttgaggttctggaaagcctttgggactccagtgtgagaagtgaaggacaatgtaatgcattggaagttcaaggctctgggctgacttctgactgactggcttcctcctgctttgcccgggctcaggttccgtgaggaggactacacggtgcacgtgcagctgaatgactacctagacatcatctgcccacattacgaggacgactctgtggcagatgcagccatggagcgatacacactgtacatggtggaacaccaggagtatgtggcatgccaaccccagtccaaggaccaggtccgttggaattgcaaccggcccagtgccaagcatggcccggagaagctgtctgagaaattccagcgcttcacgccttttatcttgggcaaggagttcaaggaaggacacagctactactacatctgtgagtgcacaagggccaggcctcagagcactggtggcctcatgcttagtggggagtcaagtagccgagagcttccccttcagagtctaaactcagttttctcccattcgcatcagggatgtggtgtgagcttcaggtgtcttaggcactctgtttggtaaatgggaacaaaggtcaaaaacactcctagcccctgtccttgaggaagctgggaaggatcccgaataaatcagcagggcaggagagcagtgtatgatagacatgaacaccagacattgggaaaatgtatatgagagccctgtcttcagacacaccagaagagggcatcagatgccattacaggtggttgcgagccaccatgtggttgctgagatttgaactcaggaccattggaagagaagcctgtgctcttaactgctgagccatctctccagccctgacacttgggaaaatgacccatgtgcctgcccgaggtcaaagacagaaaaggccaagtgggtccaagacagaaaaggcggagtccagaatgactggaacaggagggcacacgcacaaagggagggtgacagctcctggaaagagagtacaggaaatagagagctgtgctcactcagaaagtgggtcggacagcttcttcaggcccagatactagtaagagttcagactttgtcctgagggcagcagaaacctgttgatgtatcccgagaccgagcaggccaggggctttgtgaagaccagatctgggccttagtcttctggctgagtctagttcagcatggtagaaaatggtccagggaaagggggcttacacatgaacacctcacccaacttcaggtggggggtgtgagatgggctgtgtgaaggggacagtgtccacggccctgtcactccactgttaaagctgagcgttgttgcagagaaagggagatggggctgcgcactggtcagaacgtaggtaacaactgaaaataaatgccacgggtagctagctaggcgtgggctcacctgtaatcctggcaccaagtttcaggtcagtgtgcgctagagcaagaccgtgcctaaaatggatttaataggaatgtccatcagtgaagagcactggtcgattcctagccccacatagcaatgacaagtctaatagatctcccgttccagaggatccagtgtccttttctgacctctgcaggcaataggtacacagcacagtactcagacaaagcaatcaaatgcaaaaagttaattttaaaacattttaaagatttatgtattatatatatatatataccattgctgtcttctgacacacaagaagagggcatcggatcacaacggatggtggtgagccaccatgtggttgctgggaattgaactcaggacctctggaagagcagtccgtgctcttaactgctgagtcatctctccagcccctttaaaaacatttttttttaagatgtatttattgctgagcagtggtggcgcatgcctttaatcccagcacttgggaggcagaggcaggtggatttctgagttcgaggccagcctggtcttcagagtgagttccagtacagccagggctacatagagaaaccctgtctcgaaaaaaaaaaaagatttatttaatttatataagtacaccaaagctatcttcagacactccagaagaggctatcagatcccattacagatggttgtgagtcaccatgtggttgctgggaattgaactcaggacctctggatgaaagttagtgctcttcaccactgagccatttctccagccctaaaaacattttaaagattaaattttaaaatcaaatgcagacaggagaaaggaattgaagtgagcagggacaggtctggtgggacacacctacagccttagccctggggaggccaaagcaaggagagttgggaaggttagtttaaagctaacctgggctaccatattagagaccttgtcacaaaagggaggggggcactggagagatggctcatcggttaagagcactgactgctcttccagtaattcctgagttcaattcccagcaaccaaatggtggctcacccatctgtaatgggatctgatgccctcttctggtgtgtctgaagacagcaacagtgtactcatatatattaaataaataaataaataaataaataaataaataaataaaaaccagagagagagagcgcgccagtgagatagctcagcaaataaaaaggcgcttgctgccaacctgacaacttggatttgatccccagctcccatgtgactgaaggagagaatttgctttcccaaattgttctctgacctctaaacatggaacacacacacactgaataaatattttatacagagaaggagggagggagggagagagggagggaggtgatgcttgcctataattccagcactcagaaggtagaggcaggagatcaggaattcaagagcatcctcaactgtacatagcatgttcaaggccagcttgagctttatgagatcctgtcatcccaaaatttaattaagtttttttaaaaaagcagttactgcacaatcctgacaacctaaatcttgtccagagcccacataaaaagccagatgctgttgtgcacatctgtaatcgcagcactctgatagggagatggaaggcagagacaagagacttagccttagtggggtgtgatggtgcacacctttaattccagcacttgggaggcagaagcatgtggaattctgtgagtctgagaccagcttggtctacatagtctgtcccagagcaggctctgtaaagagaccctgcctcaaataaataaataaaaattaagcagggcagccgggtggtggtggcggcacacgcctttaatcccagcacttgggaggcaaaggcaggcagatttctgagtctgaggccagcctggtctacagagtgagttccaggacagccagggctacacagagaaaccctgtctcagaaaaacaaacaaacaaaacacaacaacaacaacaacaaaaacccaaaaaacagggcatcgagtcagacaattttgagctcctatcttagcaaaggctctttccttaccatcctatggatttattttacagccaaacctatctaccatcaggaatcccagtgcttgaagctgaaggtgactgtcaatggcaaaatcagtgagtgtcaggccctgtggaccacttccttccatctgtgctgggcgtggtctagtggtctgggatggggatggaagttgcctctctgtctcctggtgcaaaaagcctgatctacttccattcttatttttcagctcataatccccaggcccatgtcaacccacaggagaagagactccaagcaggtaggtagtagcctgagacagtttggtctgggtcacaggaaggggtttgcttaaagagactgaggagtaaggtggctccctagccacatacgggctggctaaatcctgtgtggctggaagccgatgcaaacacttaccatgtctgtctttgccttctcaccttgcagatgacccggaagtacaggttttgcacagcattggttacagtgccgccccccgcctcttcccactggtctgggcagtattgctcctaccactgctgctgctgcaatctcagtgagggtgtacgcttgccctggcttatggattggaatgggactaaggggcagccccagccctgggaacctctcccactacacccacaagacgccaccatgaagcctcaaaaggttcagtattaagggttttaaccgaaaagagtttaaccagcccaactgtgccatccctgcctccacttcagagggatggagaaagaagtggagaaggtccttaacctgcagtttctgcctttaagccaaagaaacaagctgtgcggacctggcccattaagaggcctcagtgggagaagggctaaaaagagcctgaggtcatgcggttggacactgaacttggtaaagacgtccttccccaaggaagccataatgtgcagatgaactgaccgaaggaaaagcttgagacagcttcctgcgggggagccaggtacagaagaggcagcttgggctgacccagcatctctgcaagatttccacctgctgggctgccagagaggtttgtagcccggccctgactgcatcctccccatccctggggcaacattccctggagctgtgccaacaggaggactgaagcagcctggttttagagtgtagctgtaagggcagtgcccgtgtgtacagtctgtggagtttagcttaacgggcagggcccacatgtacagtgtctgtatataaatgtgctgtatctgttcatttctatgactgcagggtttttttatacagtgtttttggattcataataaattgatggttttttatggacatgcttttctgccccaccatgttgatttgtgaccagtgtccccattgtgtgttaggctctgtgctaaacagaagcaatggggggggggtgtgggggggggcaggtataatgcagagctccttttgcggctgaggtgggaaggttaaaaacttgagactgcatgagtaactcagaccttgcctcaaactcaaaaataaaaggctggaaatgtaccccaagaagtagagggttacctaacgtgtgtcagccctgagttcagtcctcaggagcacaaaacataagtagccaggcatggtggctcctgcctgtgaccccagcactcagaaggttgaagcaatgttgccaaaattccaatgccagcctgggctacagtgtgagactttgtctcaccaaaacaaaacaaaaaaagtaaataaaagacaaaataaataaatggctaggatcagtcttaccaggctaaaggagtttactcctgagggttctgcacaactccctgcaagagtgggctatagattcctctccgcacccactctttgttcttcctgtccaacttcaccagcctcgagcgctgggctttggcacaccatgcaggtactcatgctgtctgggtgagtcagggagctggatgccagctgaagcatgtgcgctgccccaccagcagagccgcctgggaggctgggagggaaagttcccagcagcaagtatgttggaacagggggccaggggtaggcttgtccttggatagggcaggtcgtgtaagagaggacatctgaaagaggatggcaattcctgcttttgggggacagactggaaagaggtttcaataacctccaggaaaaccctcccaaagctgggtaaccaaggttctgatatgaattgggggcgcgttgaagacctgtgagactaaatttgaggtttgtggtccagcacacaaaagcatacaagaacccagaagttgaggctagtggtctcgatgatgcaaggggtgcgcagtgtgaggaggggtcggatcggggacaaatgcaggggcactactaaaaccactaaacgcaatctgaacagcacgatcaggacccaggcccgcacattacagcaaaccacccggccagcacgcggcgctggtttggctgggtccccagttccggtgaagttcgggcgagggcgggttccggcgcggttccacggggaagggcggagcttcgccttccgcagctccgggtctgagctactggaactccgcgctgggctagggaaccggctccggtgggatggaggcgggcggcgtggcagactctttcctttctagtgcctgcgtgctcttcaccctgggcatgttctccactggcctgtgagagtgtggatggactgggctggggcaggaagtcaagaaatgaaagcgggcaagagacgtggctgcaatatcttgctgcttttggaacccagaataatagtggaataggattggatgatttgaggtccaaggcgaggctgcctcttggcctgaggggggagatctgcttgtcgttcaggatgattggtaaacaccgagaaatcttttacccactcctaacaatttcctttggatcccttccagctcggacctcaggcatatgcagaggacacggagcgtggacaacatccagttcctgccttttctcaccacggatgtcaagtgagagtgttgttggctgtgatgggaaaggctgagggaggtgcaagagatccctggagacctgctgcaaccccagcagccccttggaccttaatcctccttccctcacagcaacctgagctggctgagttacggagtcttgaagggagatgggacccttatcatcgtcaatagcgtgggggccgtgcttcagactctttatatcctggcatatctgcactacagtcctcagaaggtagaggccctcccttgcactcacctccaccccacacctggccatgttggcagagcatatagttctatttcctggaagattagtgggatggcattaattccctttcctagaaggcccttctggttctcctgcccatgaagtcaaccctttaaaatgcacacagagccacccaccctccccttgttcgaaatgctggtggcttacccaaccccgtggtgtcaagatatcctgtgctcccccaacaggctgggggaagagggctatactgtctgatagttcctttagggttaggaccagggccaatggctaagaatggccattcgctctgcttccccactcagtcacactaacatttattggtctcttattgtacatgtatgtgaagctcacatgaaaaggggagggatctaaaaatggctctccccttccctggggatctccagtgttgtgtggctgagatttctctcaaataactgagtggtgagaggctgacgtgaaggccgggataaaagttgatttccccattagagcatggcagaagacaggaggaggcaattccagcagagagatgagtgttctgggtacagatgcatgtaagacgcctctcccctgcagcatggtgtgctcctgcagacggcaaccctgctggctgtccttctcctgggttatggctacttttggcttctggtgccggaccttgaggcccggcttcagcagctaggcctcttctgtagcgtctttaccatcagcatgtacctctccccactggctgatttggtgagtaggggtggccaagaggtaggggagatgcggagaagggctaggctccctgagccagggactggctaatactggggcgggggcggggcccagctcttggaagaagtcaaggtagcagaggtgagtgggatgcaggaaaagggctgaatgaaagacgcaccacagggattgtggtcttttttccgcgaggaaattctctggcgaggactcaggaatggttctatgaacctgaaccaggcacatttttgccgtaggccaagatcgttcagactaaatcaacccagcgcctctccttctccctgaccattgccacgctcttttgctccgcctcttggtctatttacgggtttcgcctccgagacccatacatcacggtaagcagactctagattgggacgttgggtctacaaagcagagtctggtctttctagcagctttttgattgcaggtgcccaaccttccaggaatcctcaccagcttaatccgcctcgggcttttctgcaagtaccctccagagcaagacaggaagtaccgcctcctgcagacctgaccccaggcacccgagtgccaactggataccaaacagagctcctgtttctgctggtccttgtgaccagttccatggatgcaataggttgtgagaaaaagatgactttgaaactaaagggaccaaagatctttccttagatcagataggacctgtgggatgaaatcacatttttacaggagatcatcttttctcatttcggaggctgaggtggtattagaatgtgccttaaaataaactgttccccacccctgcctgcagagtgatgtgttcttcgccattcccaacctgcctgacttgacagacagagggcctactgcctggggggcctgtaggattggctcagaaaagggatttgaaagaactagaagttaggactggagagatggctcagtggttaagagcactgactgctcttcccaaggtcctgagttcaattcccagcaaccacatggtggctcacaaccatctgtaatgggatctaatgccctcttctggtgtgtctgaagatagctacagtgtactcacacacataacataaatattttttgttgtttttttgtttttcaagacagggtttctccgtgtggccctagctgtcctggaactcaccctgtatacccggcaataaatctttaaaaaacaaaaaacaactagaagttagaaagatccaggaagtccttttaaaaagaaaagaaacctggcagtggtgacacacgcctttaatcccaacacttgggaggcagaggtaggcggatttctgagttcgaggccagcctggtctacagagtgagttccaggacagtcaggactgcatggagaaactctgtctcaaaaaacaaacaaacaaaacaaaaaaacaaccaacttgaaagctgtgaagaatggaaggaagttagggacccatgcttcctgcgcagccttgtatgggaagcctcgcagcacttccaaggttgaagctgaagcgggaggaccacaggttgagggcagcctgggtagcacgacagggttggttgtaagccaggttgaactacttattaaaaccatatatattaaaaccatatacacaagtaaacaaacctgttttggggatatagttcagttgtggacttccaagtttgaagcccagcatgacataaactagtctagtcatggtgggtttagcctgtaattagagacgttagaatcgagataatccacagccatatggctggggtcaaggccagtctagggtacatggcatcctatttcaaacagaaaaaaaatcttgagaagggaacagaacaccatcaaaatgcaaagctaagtaaggcctggtaaggtggttctcctgccccctcacctcttgacctctagtatatagaatccccatcccaccccccaccccaccgctatcctccatactcaaaactacacaagattagaaaataaaactgcattttaatgcggaatgaggaaagatgtccagactggaatgggtttaggtgtcagaagcgcagccccctgcgtgctaaatcagctcgggcctccacgatctggctctgcagctctcgggcagcgtcctcgcagtcgtgaaatgtagctacgcgatagcccaccgtgcccagggcatagcagccagcggagaccaacaggtaggcaggcagtggccacaggacctctcggcaggggaaaggcaactccaagcccagtgctcccatggtcagggcagcccaggcagagcccaggagagccagtccccaaagccactgtgttaacttcgtcatgttggctgcagggagaaaaatcaaagctaagggttctttctaccgatccccgctctgcatctgacatttattcccagtctccgccacccatttccgtctttccactctgcccgccacctaagcgtacctccgtgtgccgcgctgacaaggcccgcatcagcatccggaagtccctttctactaccgccctttttccgggctgccttctgggaactgtagttcttaggacaatttcggccgcgctcagatccaggttggttatacactgctcttcgaaaatctgagttcagaagagtttttgccgttttgttctggagacccacatcgataccggctggaacttgtggacaatcggaggataccccgaaacgctgcgttaagatgggaatgttacatcgccccccttaaactagattctccagtgcagaaagcccactcattcaattattcaagcattcttccaacacacccatcaatcagcaaacatgaacaggccgcctcacacctgctaggcaagttctcaaccactgagcccttttatattttgaaacaggattttacagagtacccggaataaacttgaactccagtctgagatcctgtcttgaagaaataggctggtcatgtcaaattgaactgcaaatcacaggcccatatacctgtgattccagggcaattcaacagaagaagaaagaagaccatgaccattacaggatatgataaagggttggttgctaggggatggagaggtggctcagcagttaagagcactggctgctctatcagaagatcctagttcaattctcagcacccacatgacagctcacagctgcctgtaactccagttccagagaatctgacaccctcacacagacatacacgcaggtgaaacatcaatgtgcataaaataaaaaaaaaattttttttaataaaaaggggttggttgcctttaggtagcaataacagtttaaataaaacaagggggttttctttggcttgatttttggtttgtttgggttttaaatctttatttatgtgtgcatatgtgtgtctatctgagcgtatactggatacatttaggtgcctgcagaagccagaaaagctggagttacaggtagttgtgagctgtctgacactggagctaggaaccaaactcaggtcctctggaagagcagcaagcacacttaacagctgagctgtttccagcctggttggtattcgttttgttttgagacagagtctaatgtaatgtattccaggctggcctagagcatgggatgtagctgaggatggccctgaacccttgttactcctgcctctgctttcccagtgctagaattaaatgtgtgtgttaccaaaccttccttaaagcaattctgttgttggaaaaacgagtaaatgaggagtgaaaaagtcctgaggacatccacatgatcccaaggctcaggaggcagggctgctccaagttcaaggccaacatgaactacataaggaaggccctgatttaaagggaaaaaaatctagtctgagtggattgagggtccacttggaaatcacaaagcggggacagaagtagactgtaactccaagacctcacacagactcacgtgcaggctaaacaccagtgcacataaaataaaaattaacaaatgttcaaagacccattgttcaaagctttgtagctggattggaaatttagtttactttggtatgtcaaaagggaatccagaggggctggagaaatggctcagcagttaagagctctggcagctcttctagaggatcctctgagctccattcccagcacccacatgatgtccttaaccatctgtaactccagtttcagagcgtctgacaacactttatgacttcccgaggcaccagacacatactcagacatacatgcaggcaaaacacccatccatgtaaaataaaagagaaacaaaccaaacccttatttcctcaaagccttcaatgttaatcaacaattattatttataaaacaaaaacaaaaaacatgttactgagacaacagacaagagtaaaatgtgccgttttcttttttcccctttctttcctttccctgagacagggtttctctgtgtagccctggctgtcctggacctcttgttctgtagcctaggctagcctgaaactcacagagatcctcctgcctctgcctcctgctgggttcaaaggtgtgcaccaccacatcctggcctcaattaaaaagtcatttattaatttttattttacatgcattggtgttctgcctgcgtgaaagtttgtgtgagggtgtcagagcttggagttacagacaagggtgaactcagccagctctccagcccttcagaatttttaatcataatttaaatttgttttgagagtataattatgctacttttcctcctccatttccttcctccaatccctcccttgctctctctcaatgtatggcctctttttatttttttagatttatattctccgtgtatcaacggtatgcctctatgtatgaattcatcacacgtgtgcctgctacccaaggaggttaaaagagggtgtcagatcccctggaccagagttactgatggttataagcaaagtggcagtgactggacctggatctgttacaagaactgtacatgatcatggttttgttgttgtgatttttttttttcaaaacagagtttctctatatatccttagctgtcctgggacttagtccatataccaggctagtctcgaactcagagatcagtgttcctctgcctctgagtgctgggatgaaaggcatgtgacatcacatgatcttaacatctatatatagagagatttgaggcctcatgagttttcccccttccaggttagcatgtccattatgtctcttagtgtggtggtttagccaatcgtgttgatgagacttcatgcaagtagcttctacatttctagaagatgaaatctcacagctgattcactggttctctctctctctctctctctctctctctctcataatttatttatttttcatttacttgcattggtgttttgcctgcatgtatgtctgtgtgagggagtcaaatcacttggaactggagtttcagacagttgttagctgctatgtgggtgctggaattgaacccctaatctttcattagaagaactgccagtgctctaaaccatatgagccatctctccaacccctcaaacatctctcttccttccttccttccttccttccttccttccttccttccttccttcctttttttttttcttttaagttttctctctagccttgctttgtggcctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtggtggccgacgtgcctacaaaatgctcaaaactgttttataccgtgggacaagggactgggatgcatattttgcacatcaaagcagaattgacctccaggttctcccagcatccctcagtccctacctggcataccctgtcttccaacccaggagctgggctgcccttcccccagaggctcttccctatataatgcagacatcttggtctcctctctccctccctcccttaccctctccttcttttcttctctctctgattgcaccctttctctccctccactccaacctccccacggtaacttgcctggcctcagtccttggggccagtgaacttacctgagagcagttttccaataaacctgcatttaatataatctaatctggcttgaattgactcacttcactggctgagaaataacctatcaataaccataaaataaaaataaatctttaagaagggagaagagggctggagagatggctcagcagttaagaacactgactgctcttcctgagttcaattcccagcaaccacatggtggctcacaaccatctgtaatgggatccgatgccctcttctggtgtgtctgaagacagtgacagtgtcctcaacatacataaaatacataaatctttttttaaaaaaagtggggggggggggagaagaaattaaatgaacagtatcctaattcatcacatgttagaggtgggatcctaaggaatatggattgttgggagagcctctggagggccagactggctgagtgcagaggaagggctgagggttcagtcctcagcaccaaacacagaaaacagaaaaatttgcaactagtttgctgtttaaaaaagaaaagttagatttcaacctcataccttataccaaaatagctagtctgcaggctggagagacagctcagcagttagagcattagctgctctggcagaggacctcagttctgttctgttcccaggcctggaggcttcacaacctcttgtaacttcagttccaggagattccatacctccctctggcctcagagcattgtacatatgtgacacagacagacatgaaagtaaaaataaggggctggcgagatggctcagtggttaagagcactgactgctcttctgaaggtcctgagttcaaatcccagcaaccacatggtggctcacaaccatctgtgatgagatctgatgccctcttctggtgtgtctgaagacagctacagtgtgacttacatataacaataaataaatattaaaaaaaaaaagaaagtaaaaataaaaccttaaaaaaattacctagtgaagagactccagacaaccgagcattgcgccagggctctgtcaggcctgctcttctcacccatcccctcttccttactgaaaactattagattatgttcctaaagctagccaccaagatccattccattatttgcccactttctcctcctgaggctgactaccaaggtccaactatcaaagaactgaaatctagcaagcaaaagccccctttggctcatccattcaacctgtccaatcaaaagtaaacatcttaattcggggaggtgcgcatctttaatcccagaggcagatggatctctgtgggctcgaggccagcctggtctacagagtaagttccaggacagccaggggtgttacacagagaaaccctgtctctggaaaaaccaaacaaaaaaagtaaaacacttcatcctaacacagggggtttccccttttgcctttataaaccaccatttgcccatgaggccctgtctgtctcctctctattcagaggcagtcctttgtcctctgggacaaacatttctctcccccccccccccacttgctgccttccccttctccttcctcctctatctctaatctttgcctcttattccccccaccctttgtccctctggggcagtttatcaccatggtgctgagaatgttgctttgggcgccctgagccagtaggaggtccttttcacctgtacatttttaagtaaatacaggacccagatgtgatgactcgggcttgtaatctcagcttttggaaaggtgaagcaagaggaaggcaggtctctgtaaattcaaggccagcctggtctacatatcaagttctagaacacctgggctacacagaaaaaccctgactgggaagacaaaagaggaggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaagaggaagaggaagaggaagaagaagaggaggaggaggaggaggaggaggaagaggaggaagaggaggaagaggaggaggaagaggaggaggaggaggaggaggagtaaccgcaactgcaataacaacaactatgtggaggctggagaattggctcagcagttaagagcacatattgccagcggacctggattcaattcccaacacttacatggtggctcacaaccatcattaactccagttccaggggatttgcccacggtacacagtcatacgtgcagtcaaaacacccatccacatagtaaagatagtatccgctaaacacttaccaagaacccacactgccttcaccgacctttcactgttcagaactgtctgagagaaattccttctgcttgtggttgctggcactttctacctttctagcttaggtttcagaaggaaacaaagtctaatcctgagggctccttctcctagccactgaagagtgaggaaggtttcctgttagccagaacacagagaagcaaggttggattgctgaggaggagatgctcagggatgcccaggaacccgactcgactctggcaagatgagtaagagctgtctaggtcgggaggcagcgtgcagaggcagcttgcaaagctgaggaacagcttgaacaaaggcttgaaggtgtgacagatcatgctgagtaattcttgtggctgtctccagaacgatcacgatcacggggtggaaatggcaggagaggctgggaaaactggtcaggaccaggtgactgtggacccctgtaaagcatttgtgttgtgctagggagctggagagatggctcagtggctaagagatacatactgctcttttgaaggacctgagtccagttcccagcacttacatcagctagctcacaattgcttataactctaacccacaggatctataaccctcttctgatcttcacagacagcagtgtacataccatgcattaatttttaaaaatctatttttttcctggtttttggagatgagatctctccatgtactcctggctgtcttggagctctctatgtagaccaggttggcctcaaactcatggagatctgcctgcctttgccttggagtgcttagattaaaggcatgtgcctccacacccggtttaataaagaagcaattattataaagcactcctggcagcaggcaagagcacttaggacctgagtttagttcctggcacctccacagagttcacaaccatctataactgcaggggatctgatggcctcttttgttctctgcaggcactaggcacacacctagtgcacatacattcaggcacgcaaagcacagacataaaagcaaataagtcaaaaggtattggtacagggccgtacagctcagtagtaaagcgcttgcttagcatgcacaaatcctagggtcagccaccagcagcttgaggagatgagtttatggtgaaggtaagggcttggtcaggggttcacctacatacaggtgcccacgggtgattactgagtccttcaggagggctccaggtagtcagactctgtccatccctgccctcgaggtgaggtccccacagtttcctgggggtaacaacagccatacatataatcaacaaaacacatactgggaaaattacagacaggctttcctgggaaatgacaaatcaaagatgtcgtcctgattagggaaagggttcaggtgaatcagggttctcagagaaattgccctaaagcatccagacaggaaacgatggcagccttagggaggaaggacccagaaatagagctgagcagttggcagaaacatggggctcatctgagttcagtgttttcaaactgcctcaaggcagaagctgtttccccgaagagcccagcgtgctgtggtatgctactgg

SEQ ID NO: 716 - DNA, 1009 bp, Mus musculus
ggttccacggggaagggcggagcttcgccttccgcagctccgggtctgagctactggaactccgcgctgggctagggaaccggctccggtgggatggaggcgggcggcgtggcagactctttcctttctagtgcctgcgtgctcttcaccctgggcatgttctccactggcctctcggacctcaggcatatgcagaggacacggagcgtggacaacatccagttcctgccttttctcaccacggatgtcaacaacctgagctggctgagttacggagtcttgaagggagatgggacccttatcatcgtcaatagcgtgggggccgtgcttcagactctttatatcctggcatatctgcactacagtcctcagaagcatggtgtgctcctgcagacggcaaccctgctggctgtccttctcctgggttatggctacttttggcttctggtgccggaccttgaggcccggcttcagcagctaggcctcttctgtagcgtctttaccatcagcatgtacctctccccactggctgatttggccaagatcgttcagactaaatcaacccagcgcctctccttctccctgaccattgccacgctcttttgctccgcctcttggtctatttacgggtttcgcctccgagacccatacatcacggtgcccaaccttccaggaatcctcaccagcttaatccgcctcgggcttttctgcaagtaccctccagagcaagacaggaagtaccgcctcctgcagacctgaccccaggcacccgagtgccaactggataccaaacagagctcctgtttctgctggtccttgtgaccagttccatggatgcaataggttgtgagaaaaagatgactttgaaactaaagggaccaaagatctttccttagatcagataggacctgtgggatgaaatcacatttttacaggagatcatcttttctcatttcggaggctgaggtggtattagaatgtgccttaaaataaactgttccccacccct

SEQ ID NO: 717 - protein, 227 aa, Mus musculus
GTGSGGMEAGGVADSFLSSACVLFTLGMFSTGLSDLRHMQRTRSVDNIQFLPFLTTDVNNLSWLSYGVLKGDGTLIIVNSVGAVLQTLYILAYLHYSPQKHGVLLQTATLLAVLLLGYGYFWLLVPDLEARLQQLGLFCSVFTISMYLSPLADLAKIVQTKSTQRLSFSLTIATLFCSASWSIYGFRLRDPYITVPNLPGILTSLIRLGLFCKYPPEQDRKYRLLQT

SEQ ID NO: 718 - DNA, 23171 bp, Homo sapiens
  misc_feature (1)...(23171): n = A,T,C or G
cgtgggaggtcgacacccaggtgtcctcctaggtgagcaaaaggcgcgtgaggtgccgccctgggagcagtcggcgggtggacttcgtcctgggcgagaggagcgggccgcacctcggacaaacgcttggctgggcacgtcgcctggggcaggtgcccgagggagaggggggtggcgctggccgtgcgcaaaacccggccctgacccggccacggggttagaggccgttggtactctatgtttattgtaaacgcagcgaatacggcctccagcggcctcagcgcacgtggtggtgcagtggggagccggctgggccctccccagctccaggctcctccccggcggggtcagcgccagacttgctgcggcgtccgggccccgcgtaattacaggggctgtagccaggcctggccgtaaaataggaggatgaaacggcctgggaactggagaagctgggccggagctggccaggggccccgggtccgtggcttcccgcgatgcgcagccgcagggaagggccggctgaggatgcgcacacacactcacaacaccaacctggcgcgcacacagccacacaaccacacacgtaaaccaccaaacgcacgcagacacacagcattcggctctcccactccaggctcactcgtgagcctaatcaaacacctgcccgccctctccaccccaggagctgacacccgcccgccaagccctctccagacggcagcagatccaggcggggagaagagccccgagaggcaaattccagtgggtttgtttacacagcgcgggggagggggcctgagccgggtactggggcccgactgactgggagccccagctcagactgggccagctccagctgtgcagcctgaggactgcgcacaaacgcccctccgttccaccccacccccgctgcacgccggtacgcgtctcccctcctcttcacacgctgttcacaaacattagcatacgtctgtcaaagagtttcacacgcttccacacacgcggctgtgatactactcacaaatgctttcatgctagcgcgccatcacacgtatttcatgtgtggttacagtttgtcacccttcatgcccagattctcacagtccatattcaagagcctgttcgcacggtgtacgcgtgtgttgttacatatactcaggttattagcgctctttgacttatctaaaataagaacggccccctctcgagcccagggtcccgcgtgtcgctcctgcgggcaggcactgatgtgatggacagaggcgtccttagccccggccgcacacgttacacactcgatcacacaaagcgttgcactttattcccggcatctaggcgatgacacaatctccagaacaaagacaacattgacaaacccaacaaaaacaaacagccgcgtgtgtgtggggaggggcagtcaagcgcagagtccgggaaggggatgggggaggaggagagtgtgggaacgcgggcgcccgagcctgggcatgcgaggctcagaaaggtgcggggcatgtcaacaacctcgcaccctgcaaggtccgcgcgcggagcagcaaagccgtgtcccgcacccccgcgttcgcagactcgcacttgcgagttcttcccttctcccgcacgcgactgcgcccagggacgcaagcccaccaccgggacaggctcacaaagctccacgcagacccacaagtgagcgaacacacatctctgagcagatctgcgggggcagaggagcgcgcttcgctctttcctgcacccccagcctcctcgcctccccaccccgcccctcctccacctccccagcccccaagcccccgggcagccgcgcgccgggcggggcgagggcggggcggggtgtcgggcggcgccggcccaaaaggcggagtcgctaggcgaaggggccagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagtaagcctcgagactcccgctggcagcctgggctcccggctggcactaccccaccgggataactgtcccggccaaaccctgagctgagcctagagtagatgaccgaggtaggagggcggctgtagattttcctcccctcacttctccgtcatatctgggagcaccccaccccggggcatgcttgtgtctacttgcatgggcttatatctgcccttcccttccttctctctggcacccctattactctaaagtgagggactcatgctgggcagttcctgccttcagcatagacttcgcccctggcagccagggcccttgttccaggccccccacccccccactgtgaaagcctccacgcctctccttgtgtgtcctttgggtatctgaccacactgacagatacctggtgtgacatcaagagtgcacagaatgctcaaggtaaccctggaaggacctctcaggagagagctgggctgtaggcattcattatgcattcaccctgtatttaaagcaaacctggaaagtccctcactaggggtcttttggggtggcatgagtgaggcacatgctgtgcatgggtaggctgagggaatcacctgtttatggggctctcaagtagtaaaagcgaagagctgggagagggagatcatgggaaagcttcagaatgaacagaagaggttaaaggggttacagaaggttctgggcaggaaggagttaatttctcctgggcaggtttagggctgtgaggcaaatggtactgggaggaagactctgtcggcccctttgttcttgcccttgagttttctgaagttatgggaacaatatttgagggaatacaggagagggtggtagggaggagcagggagagaagtgggcagcttggtatcacgaaagccatctcaccggcttagccactctcggccctagcaagcttgccccccactccccttgagaaatatgttgtgccagcttcctctgaccccgtgtcatcgtctggtgaggcagtctgttgtctgtggcttgttagggtgggggagagaacagccagctgccaaccccagagggcaatgccctcctgcccatggacgctggggaggctcagccagccctccgccacccgctccctgtgctttgcctccttgacctgatgcatctcgccctagtatgggagagagcaaagtccctgtttatgcccatgccaggtgttgactggaggaggaggaggggacaggaagccatgagtagggagggggggaccctggccttttccgttcccaagctcccaggtttcctctctttcaggaaggagcctcttccttacccacctccccgccttccctgacgccgctgcccccctttcccagatggggagcaagagtcaaatgaaggctaagtacagcagactgtacccccaggagagggggctgatgggtgaccctctggccacacacacacacacacacacacacacacacacgcacaccctatcatacccaggactaaagagacgccagtccagagtagagtccgtaggcagccaagctgggcccaagcgtgggggcaaatatgaggctacaatgaacggggtaggtgaggctggcatgggtgactcaggccagtgggcagcagccctgggatctccaggcctcaggcgggggcagcatgctgagaagggcgccagcctccctcatgctggagggcaggcccctcattctgacctgccagctccctttgtttggaggacactgttgggggtgagtgggcgctgtgccctcctggggtcctgggggctgtgcacatttgacaaggtaagttttcacaagttctcatgagtgctggggcgggtagcagaggtggatgaggaatgagtcagtgcccgtcacgggaatgagggaaagacgccaggcccagagctgaaatacctgttctgaaatggcttctatgtttatctctccagagaggaattttaaaagcctctctctgctcctctcttttccccagggtgggggaggggcctggtaagcccagtttgggcgctggcacgctgctgcaaagcctggcctctcaggggtcatgctgattgggcagtgggtgcccacctccgagtcctctctgcctgactccttcctcgccctcccagccgtggccagggctttcagttcgaagcaacttagcgctaattctgctgggtctctagctggcagtgcctgggggaattagagaaactgaccagcttgcggggtcgggggaagcacttttccccctactgggaccccacccaggctggagccaggtgtctggagctggtggggaggggctggtgggcagtcaggctggagccggtggggccagggggaatgaactaggggaggggtgctggctccaccttgggaggaggggagaggaggggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcaccatattggccaggctggtctcgaactcctgacctcgtgatccgcccacctcggcctctcaaagtgctgggattacatgtgtgagccaccgcgcctggcctaggagtagtattaagtggcccaggcaagaggaacatattcagactcggaggaatgaaggatgaaatgtggggaggggcagtgtctatgctgagggttatttccaaagaatgagaggctgggctgaacattgggcaggaagttagcaaaaactaaggagggtaggaatcaaggttagagggaagagaagaatgaaattgagtagggagctgagaaagcagggcgaggggcatttggacttacattttcttccagcaaaggtttcttatttaacccctgtgggcttatcttgcagccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgtcaatccacaggagaagagacttgcagcaggtgggtagctggagcaaactgggcctggggcacaggaaggggtctgcttgaagaggttgggtacaggaggtggctcctttaccaggctgaggctgagggaatcctgttgggctgagagccagtacaaatagtggagccactcacactggtggcctttgccctctcaccttgcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcggacatgcttttctgccactccatattaaaacatatgaccattgagtccctgctaagtgcgaggctctctgtgctacaacagtagcaactgggtttgaatttctttctctccaaagaatgtgtgcccctcacgaggccaaaagggtgggatgtttcctcctctgagggctgtccaggaccggagtgctcctgacagctgtctctcgggttctgagctgcactccactctggaagttcttcctatccgacctctaccccactcccactccgtcaccgcagggctttggcatactaccattcaggtactcacgctgtttcggtgagtcagggaagctgggaacgccagctgaggcatgcggccccgccccacagccacactagcagagacgtgtgggaggctgggagggaaagttcccagtaacaagtgggttggaccgggggtcagtgatagaggcgtcagtggattggccacgtcatgtaaagttgacccgagagggagggcaaaagaggaaggcttggtgattcctggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaaggcgcacaggcctgtgggaacacgagcgttgagactgggggcgtctagatgatccaaggggtaggcagagtgtgagcagcggcaggtatcggggacacacccgcggagccctaggaaggggactgaccgggacatggaagaggtctggaccaaggtactgggaaggcgctcggaggagaggggcgcgagttccggttcggcgtcggagggagggtggggcttcggcgcagtttccggagggacggcccgagcgtgcgggggcggagccgagtgcgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctgtgagagtgcggccgggctgggttggggaggactaggcagtcaggaaaggagagagaggggacagagacgtggccacagcacctggctcgtccggaaccgggatcaaagtgggatcgggtcgaggggaccggggtacaagggcgaggctggtcactaggcctgaaggagaaggcaggatagctggcgggggggagaggggggcggggtctgcggtggtccggaaaggatgacaggcattgggcatccccctctagcactctgcttctcccttcccacccccacccctcccttcggggccccattacagctcggacctcaggcacatgcgaatgacccggagtgtggacaacgtccagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagaatggcgtgaacccaggaggcggagcttgcagtgagccgagatcgtgccaccgcactccagcctgggcgacagagcgagactacgtctcaaaaaaaaaaaaagagtgaaagaccctttgggtcctcctctcacactgaaccctttgagccatgtccatcccctccaccctgcagcaacctgggctggctgagttatggggctttgaagggagacgggatcctcatcgtcgtcaacacagtgggtgctgcgcttcagaccctgtatatcttggcatatctgcattactgccctcggaaggtagaggccctcccttggacccacctatctgctgcacgccctgccttgctggcagggcaaacactatttcctagaagactgtaacagctggcactgccaccttttccaggaaggcctctccagccttgcaggtccccttcctctatgaagccagccttctgagatgaacacattgcccccatttaggcaaggctggtagctctgcctagcctgagatgcctatgctgcctgccctgggcttcagccaacaagctaaggggaaagggcttttgtctctgatatttctttcagagccagggcctgtgggtgagaatgagatgattagctctgcgtccctgctaaatcacacaagcatttatgaagctcctactgtgtgtgccaagcacacagaaaaaaacacatatttatctcccccagaagtctccagtgttgtgggtggataagactttcctatcaagttggtggtgggaaagaagctgtgacagtgcagtgctggaggcctagacagcttggcttccccattggagcactggagaaggcaggatgaattaactctagcagggaagtcagagtgcacatctggaagtaagggtactctctcccctgcagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggtgagtgggggtgtccaaggaggtaggagagataagagtcaggctctcatagccaaatactatggcttacagtcccgaggaaggggagatccaaaccctggaagaagacaaggcagtagaagtgggcgagtgggaggcaggaaaggttgggtgacagatcagggagggtgtctgacctttttcttgaggaaattcttaggcaagtgaagctttacgatgtgcttgggccaagagagtcttccattctttcccacaggctaaggtgattcaaactaaatcaacccaatgtctctcctacccactcaccattgctacccttctcacctctgcctcctggtgcctctatgggtttcgactcagagatccctatatcatggtaagcacaactgggatggggtgacaggggtgcaagatggaaaactggctcctctcctcatagcagttcttgtgatttcaggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgcccacgatggttcattctctactcataattctaaacctgcctggtttggtgaaggatagatccacagttattctcaggttggtagggtaggctcagaaaaggtatctcaaagaaccaaaaggttggaaagacccaggaaggccttaaaaataacaaaacttggatgttatgaagaatggaacttaggcttcaagaaagtacttctggccgggtaaggtggcttatgtctgtaatcacagcactttgggaggcccaggcaggaggatcacttgagcccaggagtttgagaacagcctgagcaacacagcgagaccctgtcactacaaaaaattaaacattagcctggtggcgtggtggcatatgcctgtagtcccagctactctggaggctgaggtgggagaactgtttgagcctgggagggtgaggctgcagtgagccatgattgcaccactgcactccagcctgggcaacagagtgagaccctgtctcaaaaaaaaaaaaaaaaagaagtagtacgccgggcgcggtgactcacacctgtaatcccagcactttgggaggccgaggcgggcggattacgaggtcaggagatcagaccatcctggccaacacggtgaaaccccgactctactaaaaatacaaaaaattagccaggcgtggtggcaggcgcctgtagtcccagctactcaggaggctgaggcaggagaatggcgtgaacccgggaggcggagcttgcagtgagccgagatcacgccactgcactccagcctggacgacagagcaaggctccgtctcaaaaaaaaaaaaaaagaagtacttcctacagggttgaaaggaccaggaaagtgaaatgtcatttccatcctgagaaatattgagaaggggtctttgcctccttgggagcaaaaatgggaacaccagcaagatgcaaagataaaggctgagatggcctcaagaaggtggttctttcacattcacttctcgaccgttagtacatagaatccccaatacccgttttccatactcaaactaaacgaagttagaaaataaactggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctgaggagcagaaaggaaaagcggaccaaactcaaccgaagcccgcccacggagagcattaaaaccagccctggccagaggggaatcgccgatcccagaggtccgaacttgagtgcccacaaaaggtggaagggccccttccaccttgctaccccctctatatttgagacccactccccatctctcgccctccccattcagccttcaacctacacttacctctaccccacgtctccccttccccgcgcggcccggatgttggcgtccggaagtcctccctggttcacgttccgcttccgcgcggccttctgggagttgtagttcacctggcggcgcctggtgtactcctggccagcgcctcaatctaggcgggggtacagtgggctgtgctccgcaaacggggagcaggccgggtctggagaggcctcggcgctgctttcccaccttgggctacgctccaggctggcgtggggcttgaggacatccttaaatgttgcaacaagatgggaatataataccattccccttaaactcaattctccagcgctgaaatccattccttcattcactagttcattcattcgaagatttctttctttccattcttgacagggtctctctatagtgcctaggcgggacagaactccttttttttttttttttttttttttttttgagacaaagtctcgctctgttgcccatgctggagtacagtggctcgatctcagctcactgcaacctctgtctcccgagcagctgggattacaggcgcgcgccaccacgccgggctaatttttttatttttagcagagaacggggatttcactatgttggccaggctggtctcaaactcctgacctcaagtgactggcccacctcagccttccaaagtgctaggattacaggcatgagccacagcgcccggccagaacatttcttgattaccatgatagactttggagatacagagatgtcaagagactcgacccctttcaggtggagggggaaagcaggagtcagtgaagcagttgcattgacaactaaccatgaaggcttgagattattgttagaacagaggtagtcatatttttacaaggacaacaaccaatataacttggagccagaggaagaagggctccaggagtctgggtttcaaaaaaaaagaaaagaaaagaaagaccagaagaattacctgaagtggtgaaggcattgaaagaaagagtataattctttagaacagttttggggatgaatttattatgtatagagagaaagagagagagagaacaaagtaagagaaaaggttaggcaattatcaacttcagaggaaacaaagagttatataagaaaggaaagacaattgataagcctgtcttataaagaccacatctgtagtttgacagttaggtttattaacttgccacaacagagagatcacacactagaagaactgtggggcaactcattaaaaaggaagaaatatggtcattcagatgatatggtttggctgtgtccccacccaaatttcaagttgatgtgtatctcccagaattcccacgtgcgagggacctaaggggaggtaattgaatcacgggggccagactttcccgtgctattttcatgatagtgaataagtctcacaagatctgatgagttcatcaggggtttctgcttttgcttcttcctcatttttctcttgccaccgccatgtaagaagtgcctttgtctcccgccatgattctgaggcctccccagcaatgtggaactgtaagtccaattaaacctctttttgtttgcagtttcgggtatgtctttatcagtaatgtgaaaatgaactaatacaacaggatatgggaaaggcttgactttaaaatttatattttaaaatttatttacttatttatttagagttgaagtctcggtatgttgcccaggcgaagctcaaacttctgggctcaagtgatcctcctgcctcagcctcccaagtggctgatactataggctagctaaaatttaaatgaagcagtgttttgatcggttcgaggtaagcataactttaagtgaagggatcaagaagtccaagctgagggaccacttggaaattacaaagtcaagataaatatagaatatagtgtccaaaaacccactatctaggctgggcacagtggctcgtgcctgtaatcccaacactttgggaggccaaagtaatccacgtggctcagaacttctggcaagagtaggatgttccattcgcactgactgatttcaaatagcaaagtttgtgactatgattttagaaaatgaagtttctcagccgtatgtcctggatgttaattaacaaaagcagtttttacagattcacagtcttagcacaaacacaaatggctcagctgtgaagaaaattttcacagccgtaacgatgtaaacactaagtattgatttaactaaaaattggagctggggacagtggagctgtgatcccagaactttgggaggcctaggtgggagtgttgcttgaagaaatgtacagataagtaccagaagaagcagcctagaaactggagcgtagttgtatatgtaggttgtatatgtaagggttaaagaagaggagcaggggatggttatttttcattaaaagccttgtagagttacagctctttttttttctattctttttctttttttcagacaaggtcttgctctgttgcccagggtggagagcagcggtgcaaacatggcttactgcagcctcgacctcctggactcaagctatcctcccacctcagactctggagtagcagggactacagaagtgggccaccaccaccacgcccatctagtgtgtgtgtgtgtgtgtgtgtgtgtgtgtgtgtgtgtgtgtgtgtagacggggtctccctatgttgcccaggctggtctcaaaatcctgggctcaagcaattcatctcagcccccacaaagtgctgctattgcagtcgtaagccacggcgcccaccgaagttacagctttcagaatttgttgagcaggtttcccggttttcacttgaaaatgccccgccaccccgaaaaatatttgttgaactagttggcttttaaaactatacaaattcctttgttaaagtaaaaattaaaacaaataaaaacttttctttttttttttgagacagagtctcgttctgtggcccaggctagagtacagtggcatgatctcagctcactgcaacctctgcctcccatgttcaagcgattagcctgcctcaacatcccaagtagctgggactacaggcacgcaccaccacacccagcaaatctttgtatttttattaaagacagggtttcaccatgttggtcaggctggtctcgaactcctgagcttgtgatcctcccacctcggactcctaaagtgctgggattacaggcgtgagccaccgcgctcagcccaaactttttttttttttttttttgagccggagttttgctcttgtcgccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagcgcctccttccctagattgatggaacataataaaaagagaaaatagatcaggcatatataccaatgtagcatatgatagaggcaccatcttgagtgagtgaggaaagatggattgtttgaaaagcatttgcaactagcttaccatttgaaaaaaaattaaggtagatttgaacctcacatcttataccaaaacaaagacccagagcaataaaaacaattttttctttttctttttctttttttgagacggagtctcactctgtcgccaggctggagtgcagtggcatgatctcagctcactgcaacctccgactccctggttcaagcgattctcctgcctcagcctcctgagtagctgagattacaggcacacgccaccatgcccagctgatttttgtatttttaatagagacagggtttcaccatgttggccaggatggtctcgatctcctgaccttgtgatggcccaccttggcctcccaaagtgctaggattacaggtgtgagccaccgggccccgcccaaaacaattttaatgtaaaaagtgaaactctaaatatgctgcaagcaaatgtggtgcatgtttctctaatgctcagctcaagtatcatgtctcccaggcagccttcctgcgccttgattctgtcctgcagggttggcccccatctccctcctcctgctctcactgactttcttttattgactttcatggcaataaccatgttgagctgtaggggttttctttctctgcctgtcctgcccccaggaccattgtattcccaagatcaagcacagtgtgggaaatgtagccgggtttctataaatgtatgatgagtgagcgagagagagaaggacagtttggcattagatggtctccagaaaaactgagctagctttcctggtcccaggaaatacaactactccagagaccccagtctgccagacacagggtgtttggccttggatagcactggacaagagacagaatattcttacagtccaactcctttctcttcagtctttctgcagatcattacccttccactaccacctcaggatgaagtacatgtgattacaataggatatgagaggcagagcagcttgggagttaaaaattggggcttttggggaacatgtcatcaggacctcctgaggctgtgtcatggttaaaaaaataataataattttttttttaattggggcttttgctgggcatggtggctcatacctgtaatcccagcatcttgggaggacaaggcaagagaatcgtgtcaggccaggagtttgagaccagactgggcaacatagtgagaccttgtctctataaaaaaaaatattaaaaatggacgggcatggtggcttacacctataatcccagcactttggggggctgaggtgggcagatcaccaggtcaggagttcgagaccagcttggccaacatggtgaaaccccatctctactaaaaatgcaaaatttagctgggtgtggtggtgcacgcctgtaatcccagctactgaggaggctgaggcaggagaattgcttgaacccaggaggcagaggttgcagtgagccaagatcatgctactgcactccagtctgggcgatagagcaagactctgtctcaaaaaaaatttttttaatatatattttatttaaatatgtatctataaaatatatacatatttaaatatgtatctattaaatagatacatatatatgtatctattaaatagatacatatattatatatatgtaaattttagctggcatggtagagcatgcctatagtgctagctactccagcgcctgaggcaggaggattgcttgagcccagtcaaacaatttggaagacaaattccaaatctaagagcctctgtactgaagataaaaggatatgcaaagttaaacagaacacagagaaggaagggactatctggagggaaggcttcatagaggcccagaagcctgagttgatactggaaagatgagtaagagttgtttaggtgaggggagggggcatgtaaggccaagggaacagcttgaatgagaggcctgaaagttcatggtgggcaatcttttgtggctgtgtctgagacaaagaatgtttcatgggggcagtggcaaggatgaggttggaaaagctggccagggtcaagtgattaaagaccccttaaaagtatgtgtgggctgggcgaggtggctcatgcctgtaaccccagcactttggttggtcgaggcgggcagatcacttgagttcaggagttcgagaccagcctggccaacatggtgaaaccctgtctctactaaaaatacaaaaattagccgggcacagtggcatgcacctgtaatcctagccacttgggagactgaggcaggagaattgcttgaacccaggaggtggaggttgcagtcagccaaggttgcaccattgcattccagcctgggtgacagagcaagactctgtctcaaaaaaataaaataaaagtatttctgttggacgcttcacctgtaaagatacatataggactgaaaataaagggaaaagatattccatgccaatggaaaccaaaacagagcaggagtagctatacttatattagacaaaataaatttcaagataaaactgtaagaagagacaaagaagctcattatgtaatgataaaggggtcaattcagcaagaggttatgatcattataaatatatatgcagccaacagtggagcatccatatatataaagcaaatattattagagctaaagaatagaagaagaagaagatacaagaatgacccccagaccgacccgcgtgcccagcgcctacatcccgtcgctgttgccaccaccatgcccaagggaaaggctgaaggggatcctaaaggagataaagccaaggtgaaggacgaaccacaaaggagatccgcgaggttgtctgctaaaccttcttctccaaagccagagcccaagcctaaaaaggcccctgcaaagaagggagagaaggtactcaaagagaagaagggaaaagctgatgctggaaaggaggggaataaccctgcagaaaatggagatgccaaaacagaccaggaacagaaagctgaaggtgctggagatgccagaggaagtgtgtgcatttttgataactgtgtacttctggtgagtgtacagtttgaaat

SEQ ID NO: 719 - DNA, 1233 bp, Homo sapiens
cggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatcaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccaccc

SEQ ID NO: 720 - protein, 190 aa, Homo sapiens
MEAGGFLDSLIYGACVVFTLGINLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 721 - DNA, 41540 bp, Mus musculus
  misc_feature (1)...(41540): n = A,T,C or G
gctaagtgagactctgtctcaaaagaacagaaacaaacagaaccattatttgagatacaagtccatttagaagtgacacttaactgctagaatctacaccaaattgctaacaatgactggcttttttataaaggcccacttggcagcaaggaataataaactcacctgtttgcccctggggctgtgtgaggtcctctgtggcaatgtatgggcaggacacaaggggcaatctcctgatgcttacaggcaaattcaggaaagctacctcctggggttttcaggagccaactgtcccacaatagcttctccctcactcaagggcggagcttagcctccctttagttctctcatttacctacccaacctgatccttatcacctgccgccagacccctggcttttatgatcagaatagatcaatgcatttcaattagaaatccctctaggtctggggaaatggctcagcaggtaagcatgcctcccgtgaaagtgtgaggaccacaaaaatgtggttcccttcctggcacccaggtaaacgcagcagtgtggtcttggtagcgggccatcactgagaagcagagacctgcgatgcccagagaaatccacagctcttgtaagagaccgggaaaacacaaaacatctgacatcagttcatcagttctcctgtctctccaatctctccaatctctccaatctctctctctctctctctctctctctctctctctctctctctctctctctctctctctctctctctctctctctctccctccctctcccgcccattgtagcctgatggtaatactctcatggagcatgcttaagaccttagaaaaagtagtaaccacatttgaaaggaagaacagtttgttatcaactctcagcagcttcattttcaaagaaaataattctcaaaactcctaattctcctatactgaattatatttctgggagcagagataatatttttgccatagtttctgctcagacttaagtagatgtatacattttgaaaggaatgtctttctatatccagtattctggataaaatacaaatgtaatatttagcaacaatggcttcttgggcagtcccttatggtaaccacaacatgtccctggttttgtcgttggccctgggatgctattgtggttgcttctctggatttaacacgctgatctcttttgccatcatcagatgctcggcaggacttacagaggaaggggccttgcccctagttgaatgcagatggttcagttttgggtggcaatgcagagagctgcttctttgaggcaccacactcccgttccaaattttaagaaagctggctggcataagactaccataggaatcactaaaagaaaagttagtgtatataaaactccacaccaacactgatgtatcacgctacatggacattaaattaaaagtgaacacagaaataccgcttcaagaatttacagagacagcagcggtgaaactttaagcactatattttgtatagaagccatttggggaaatgggcatattgattatatttttctctgtcttccttttacaaacacctgcagagcttttctctctctctctctctctctctctctctctctctctctctctttttacttactagcagaaaataaggaggcctttgtctctaacagtttaaaactctgagcactaatccaaactaggtacaaagtagtattatgtgaggaaaccctaacactgagcaaagtgtaatcttagtctacttcatcaagctgcacacataaacaaatagaacagatgcaaggcggccacatggcttacttacttactttgcttttaaacttctctgcacatccaaaacaatttggcaatcagaattatcagcccaataaggaacgaggagtctgattggttgatttctctagctttacctaattgctgtggggtgaagtggctacagagggaaagtagggcctaagactggcaggaaagctttcagaaagaattccagggttgggggggggggggtacttacaggtgagagtgaactgagcagcccccaacaagaagcagagagcatctgtgcctgccaggtctactagcattaggcctggcatggtggtgcacaccgttaatcccagcactttcaagacaaacgcaggcatatctctgtgggttcaagacctggtctacatactgagatctaggctagctagagttacatggtgaggccctgtttttaatgaaagaatgtgttttcaagtgctggggtcagaagtatacccttatgttgatggcttctgccctgaaatacttcctaaattctatgactgtggactttgtgccctacaatacggtttctttagtacaggtgtcttcagagcctgtttcagtgcttcgttttcagataggatccgagaaccacttttaatctgctcagcagacattgatacagacctatgttaatacagacattaatacatactgagctgagtagtaagtgttcaatagccatgactgctcacaacaggtagaggagcacagataatctcatttactagtaaatgtcctggtgaagcttgaataaaacaaaagcagccagcacggggacggggaccaacagctctgttccaggcacagtctggcctggaaacctgtgtttgcttctgtgccttgtgttggcttcagccaactttgaaggcttgtagtaatttagatagtttagtggcctctgtcttgcctctgtatgggaacttctgaaattaaaaatgcttctaagaatgttcggaataatatgaagcaaaatgtacatttactgtgcatgacagtttgaggtttaagttcatatgttgttgttgttgttgttgttgttgtttaaccacgttaatttttacagttttggaaaacttctactttagagaacgaagaattctttcttcaagtctggcagaaaccttttatattagtgcaaactaattgttaatgaaagtctggtccacagagaaataaatctttggtttgtttaaccatattctggaaagaacatcaagaagcaacggagtcagtcacccgaggcggtgagagcttgaagaccatccagttacgcagcggccccgacaagattagttctcttcttgtggggataaatgcgtttacttttatctactggtttttagactagttaatgtgttgcaccagataaatctgtttcctgagtccatctttcagcttgttctcccctctctggtgctgacaaatggttggagtttgacacagtttatcagttgagcccctgctgggggctgcctgtcactcactcggcttgctcagactgccgcagagtaaacgagagagttatctgcaatattttgcccttactccctagagacagattcgggttgctgtgagttttcgcctcctgttgctcacgtgtcctcagccagaggtgggctcttggtgattttccaacagggtcactgtagaaatgaggcacagttttaaatttatacgaaaagggaagcctcaagcctgtttcatgacccgacgcatataggaagggcactgaaggagccttgtttcgcaagcactgaaaaagactttctccaaagtaattgcagcccgaagactcgttcttttggtgtttgctgacacagcaggcaaagaaagcaagcaccttatccgcctcagaattgaggcttctcgggtgaactctctcttcttgtctgtttgtatcagtacacatcaactgcaccggataatgggttttattgtggtatcttcacatatgtatacactgcactctgaccttatttcaatttaacttcccaccatgcaaatacaaagtcgacacaaaagctgagctttgagtgggtctctaaggttctctggcattccaaatgctcttgttgggcagaactcattggaatgctggatgaagcgaacctttgctctgagcagcggctattagcacaatcagtgagacttcagctatatgcagaatcattgggaccatgcacgcttgggagctggcagtgggatcctaggagtgcttcgtgccacttgttgaacctactaaagcaaaatgcagtgtaatcgctgaccagcccaaaagcatgtttagctgttacctattagtgcagtgacggggccctccgagacactgatttgaatgcagcctctgccctcttcccaccaccctttactgtcctccttcacattcaggccagggggaagaggggcatcgtagaagagggaacagggtccagatgggaagaaacggaaggctgggaagatcgtttcggaaataggtcaggtacttgggagattagacaagcttgcttcatccctgaatacaattaggaggaattagacctgcagcaagtagcttggatttatcagctttaattgtctattgtcagagcccagctctcctctggaggatcctggtggcagtgtacactctaatacttttaatggccctccgttgtgggcttagctctcctaaaaaccagtgtctgctcttttcaaaggagctctgggaagcctacctacaaacaccaagctgttactttctctgtggtggatcccattctaaggtccccacaggtgcaccttcacggggaaggaagatggctattgaacattaataggcacctagcttccctggtaggccctttcaggaaacaatgggctgtagatggtgagcagataagtccaggctgatggcttcagaatctcccactctctttgtcagggctgatgggtcaaagccccctcactctcttcctgttaaaagggttatcaggcttatatgcagccaatagtagaaaggttttttcagaagataaggtgtctattggacgaggcctgttattgtaatactattgttctctgtttcctctattacccctcagcctctcaggtgggaaaggcagtatttgaagaactagtcagttgtctccagactccaggcctaacgtaaaaggacttccttcctgctctctaagcttggtgtgatagtcggaactcttgagttttggcctccacaagttgtaaggttgttttcctaggcagtaggcatgccggtgagctgccatcccccaagggtcatggttgcaggtgagatcttgtcaccatgagcagagccaggaagcatgtgcgtcctaagcttctgcaaagctggtccacagcttacctggcagggaaatggggttttgtcttaaatctgatattcagctcaggtaaagaactacaccccttggagcagaatttatgtgtgggacaggggtcagtgattctagaactcatgactacttctttagttctctttatctgcttctaactcctggagaaattgagtgcacatatgtactatcaagcaaatgcatgcatacacacacagagacacatcctctaccatctgcaatcttcccttagaaaggatgaggcgtagtcatcacacacacacacacacacacacacacacacacacacccttttgcctccatgacagagcctctatgctaggctaacctgctttgtagctgaaaatgaccttcaattttttatcttcctgcctcaacacccccaggtggagattataggcgtatgttactttgtttgctttgtgctgtgctaggaattgagcccaaggctttgtgtacaccgatgtctttttctctccactgtgagcctttctccttgctgtgaggcctctcctctcactgaaagagagaggtgtactttggtcccaggctctcactgatgtggaagctatccttcctccctcagactctgagagaagatttttcaaggaaagtgcccatgagcgtgcacctgccctgctgcctctctctccctaagcatccctgccctggctcgtcttagttcaggctcattccttttcccaccaaattcaggatagatgtcttctgggttcagaaatgattgcttttcccacagcctttttcaggagttaagatccctctcatgtctgaatcactataataaaaacatagttagaaaggcaatcagatcttagaaacccacagtggttttccccgtttgccagggacacgatggttactgttggcactatttgttaagttggtggatgttcaactgaataaataacttaaaagtatgtggataatcagataaaaccagaactgtgacaggaccaaaatatgctgaggcatcctgacatggcagccatcttgaaagtttttaccgaccttaggagagtgcttatctttgttacattacgagaagagagctctgctttaatttacttaatctttgtttctcttctttaggaagtcaaaacagtgacatcatcctctaccatcccacaggccgctaggatcaccattcccaagtctaggccctgacaatgtttgtcctagttggggggaggggtgagttatgtgtcacgcaaaggaagcttatgctatttttagattgatttaacacaccattgaaacatatcatacacatatcacacccatgacacacacgcggcgttgtaacacagcatgtgtcatacatacattctctctcactcacacacataacttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcagatggttgtgagccaccatgtggttgctgggaattgaactcagggccttcagaagaacaaacagtcagtgttcttacccactgagccatctctccagctcctagaaggaatattttaatacttaggattccagaccatggccacttcagttctttgtgctgtgcacaggcactagcacctcctggtctcctagctttagtgtccacatccgggagtgcggggctccagcctttggagggtgctgggtggcgctcagcccacagtcaggccctgcttagctgttctgctctggacgctacctaagtgctataatatgaatttgcccttcatcttagcttataccactatctctccttaactaccaccgtcagcatcagaacttggcctggaactgtttgttttgtttccccctcatctcgtgttcgtttgtcctggagcaaatacttcaaggatattatactccaatgatgctctatccctttttttttttttttttgtttttttgtttttttgtttttttgtttcctgatggtttcacctatggctttgtccagcacagctggaacacctggaactaattttagggttgcctggatgagcctcacactgatatttgatgtttgcgtcctccctagactcaagcctatttcgccacctcggaaggtgagcccaggctgatattaattaaccatgagttgattcacaggcatcttccagtcattaaagcaaacatttggcttaaaatagccctcttcccactctgactgccaccctttgcttctttctttacaccacagtggtggaatcactgacacttacatggtatctgtgccccaagagcaaagtttttcatgaaaggaaagcagggtaaaccgtgttaactgctgtgcagtggagacagctagcagcaggccagcccctgagatgactacattgtttttctgtccatagtggtgctgactcagcatcggttaataaaccctctgcaggaggctggatttcttttgtttaattatcacttggacctttctgagaactcttaagaattgttcattcgggtttttttgttttgttttggtttggtttttttgggttttttttttttttttttttttggtttttggagacagggtttctctgtatatagccctggcacaagagcaagctaacagcctgtttcttcttggtgctagcgccccctctggcagaaaatgaaataacaggtggacctacaaaccccccccccccccccccagtgtattctactcttgtccccggtataaatttgattgttccgaactacataaattgtagaaggattttttagatgcacatatcattttctgtgataccttccacacacccctcccccccaaaaaaatttttctgggaaagtttcttgaaaggaaaacagaagaacaagcctgtctttatgattgagttgggcttttgttttgctgtgtttcatttcttcctgtaaacaaatactcaaatgtccacttcattgtatgactaagttggtatcattaggttgggtctgggtgtgtgaatgtgggtgtggatctggatgtgggtgggtgtgtatgccccgtgtgtttagaatactagaaaagataccacatcgtaaacttttgggagagatgatttttaaaaatgggggtgggggtgaggggaacctgcgatgaggcaagcaagataaggggaagacttgagtttctgtgatctaaaaagtcgctgtgatgggatgctggctataaatgggcccttagcagcattgtttctgtgaattggaggatccctgctgaaggcaaaagaccattgaaggaagtaccgcatctggtttgttttgtaatgagaagcaggaatgcaaggtccacgctcttaataataaacaaacaggacattgtatgccatcatcacaggatgtccttccttctccagaagacagactggggctgaaggaaaagccggccaggctcagaacgagccccactaattactgcctccaacagctttccactcactgcccccagcccaacatcccctttttaactgggaagcattcctactctccattgtacgcacacgctcggaagcctggctgtgggtttgggcatgagaggcagggacaacaaaaccagtatatatgattataactttttcctgtttccctatttccaaatggtcgaaaggaggaagttaggtctacctaagctgaatgtattcagttagcaggagaaatgaaatcctatacgtttaatactagaggagaaccgccttagaatatttatttcattggcaatgactccaggactacacagcgaaattgtattgcatgtgctgccaaaatactttagctctttccttcgaagtacgtcggatcctgtaattgagacaccgagtttaggtgactagggttttcttttgaggaggagtcccccaccccgccccgctctgccgcgacaggaagctagcgatccggaggacttagaatacaatcgtagtgtgggtaaacatggagggcaagcgcctgcaaagggaagtaagaagattcccagtccttgttgaaatccatttgcaaacagaggaagctgccgcgggtcgcagtcggtggggggaagccctgaaccccacgctgcacggctgggctggccaggtgcggccacgcccccatcgcggcggctggtaggagtgaatcagaccgtcagtattggtaaagaagtctgcggcagggcagggagggggaagagtagtcagtcgctcgctcactcgctcgctcgcacagacactgctgcagtgacactcggccctccagtgtcgcggagacgcaagagcagcgcgcagcacctgtccgcccggagcgagcccggcccgcggccgtagaaaaggagggaccgccgaggtgcgcgtcagtactgctcagcccggcagggacgcgggaggatgtggactgggtggacatgagagaggcttatctcagatgttggatcttctcttggaaaaacgtgtgggtacgaccttggtaaggaaccagattctgtctttaatacgatttgaaaccttttatccctttttctttcttccttttttttttaacttttcttttctcccccctcccccttttaaaaaaaaaaaaagaatgaagcctcagtagaaaccagcgcttctgttttagtacgcggagcactgtcaaacatttagaagacttttttcctccgtatgaatcattaaccctttcagttctagacataattgtcaattcactgaaatttcagtagtggttcttgtccgcttcgccactcgctgcctttacattactgtaactatcccgggttgacttaggttttcacttgtatttaacatcgtttgttccacatgaccttacatgttggaactaaataagaatgagatagtttaagttgtacccgggacaaggacaagtaagcatctttccccttctcggagcgtcctatctagggacgaattgtaaagaccagctccggagagggactcccgctgtactgtgtttacattttcacaagcgcgcgttctaacatggttatccttattcctaatttttatctgcggcgtctatgtgggaatacgttgcagaggctgttttatctttcttgcttttcctctttggaaaggactttttccgagggcagataagaggaggatccccaagtcttctgtataactttagttacagtaaactgtgccacttcagtgacttctgggaattcatgcactttcacatttaaatagaaagtgctatttgtggctgagggctcctaaaggaattctcttcagggaattctattgactttttttttaatatgttttgtttttaatttttctatctggctcgagatgcccacggattaaaaaaacaaacaaaactgctgggtgtttccctcttccccaatttttcttttcctgtggtccatgggagctcgggaaggctggtactcaaggatgctggcaggatgcaacccctctcaggcttgcctgctggaggatgaaagagactgaacgcgcgcgcgcgcgcggcagagggaggggacctagttgttttgaaagttgcttcgctagggagctggtgggaaagttcagttttccccatttggaaaaggcagactgggttccgctcctgcaccacacgtgttttccatttttagcttcattcagacgcaggcagcgcccctgcctcttcctccccttgtttgtgacacttctctgagacagcttttccacagctctgagggtctggcggccatgaccccgggcgtcccgggacacaggacgcagcagcgcccacaacacatttctgccttgagtgataaagccaaggattgttcaaaggtagctgttctttctctcccgatgaggttaacatatacatatacgctttttttttttttttcagccaaaggctgcattttaaaaccgtgcttcttcaaggcagtctactttacacggctttggactcttactcaactgtacaagtactccaagcttttaaagtcttcagagcaccgtgttagtcatagcctctaagagggaggcacaggagcgccggacaatggggattaaaagcctttcccttctcttccaggctgcccccaagtctagctccggctccgtgaagtttcaaggactggcagagactgggatcatgaaaatggacatggaggacgctgatatgactttgtggacagaggccgagtttgaagagaagtgtacatacatagtgaacgaccacccctgggattccggcgctgacgggggtacttctgttcaagccgaggcatccttaccaaggaacctgcttttcaagtatgctgccaacaacagcaaagaggtaagccggctgccttcttgaagtctgactggcaattgggccagctctcctactactatctctgagaaccgtgagaatttatatgcattggcaaataattgatcgctccagtggctgttttccttgctttctcttcaaaccaattcctattcatttcttcctcccttcagctgtcctatactaattagtaaacagttaaattttttggcaagttgacatgtcttgggaaagctaactggcagcactggtgggcagcatggtaaagggctcagtgcttcaccccctggccctcttggatgacagttttaaaggaaagaaacttccttagaaaaagaagtttttcctctgctcatgagatggctttattcttttaacgagccagctttattagctgggtttctaaaattattctcaaaaccttgacgtgtttatgaactgaagagatggcattaaccaggaagagggtcacgtaaaagtgtcctctgtcaggatgacttcactaaccaccctttacctgtggcagctccctggcctgggccaggccggcaggtccatgttttatggcttctgaagtgggtacactctttgtatcaaagacacagaacacctgaggagcacctgatttgtgtttatataacaattagagtcggctgtgaagtgatttgcaaaataactccttgctctgagaatctggctgctgcagttgctctcctgatggcttaagttgctgaggctagccctcaggagacttcccaccatcaccattgcccacagtgctgtggtttctgatccttgctgtctttggggagcagtgaaaggagggattctgtgttgtaaggattccagatttgctcctaggactatgcattatgaaagtgccaggtcactttcctccttccctaagcgacaacatgggaaagaaactccagagttggggaaacactgtctctttcctgtttgtgtgtctcagttcagggtttggggggggaaggagggaggtggcaaagaccgagagctaaacttaaagagaggaattctaccttgtgtttcactaaagctccactctttgttctatttctgatgggagacttatttgttttatgaaaagcaaattttaaattgtagtttgtgtataaataccaccaaaaaaaattgtaaccccagaggtcacccttaattatacctctttctgaaaacaatgttcttctcaacagaaagcctctgagtatgtaacccgtggagtcaatgtggcgtttgtttgggtatttgaggtctggctgtggctttaaaaggtgtagtgtgttctccccccatcagatttgcctaaatattggtcccttcaaaaagggccattcatgtcctgttgtctctgtagcctgttgggatagaaataaagactcctggttttttgtcatcggctctgttctccttcagagtccttctcagctcagccctataaagtttttcaatttttgttgttctactgaaaactatggctgaacggagttatgctattagatcatttagttcaaggttcagatagtcaacttccccgaaggctagagttacagccaggcccagactgggagcaaagttctctgattgctccaggtgtttctagatcatgctactctggtccctcttggtgtcactgtggctttatttatcttagcataattcaggcacagcttttcactaagcctgtttgattctgtttcttttctgctgaattccttcccatctctgtatgttaagcaaccagaaagaggcagctcttgtgtttctgacagggtgcccttcacaacacacagaaagtcagggttctttgagcctactctatgttttaccgaaagaaaagtcaaatcgttgtggtagcacctcttcggtcctcaatcatgaaagccaccaggaaacaaaatttaagcatcatcctatcctaagcatacaccaaaatgtgggcctgtttttcccttctctccagcgccttctgttttgaactttgggacaggtcccttggggtggtgaaagagaaggacagaattgagccattgagggtgtgatagctgcaaaccagttccaggccagaagcatctaggatggaggaagtgtttacattaccattgttcagttagttctgtgagttccatgagctgtagaaacagggaaaggcctttctacgtgtagcttttatctgactgatctggcttgcccatctttaaatgttttcattaaaatagcaaaagctgttactttatgtactgtgtgctgacatcctggggactttttttttaaaaaaaaaaaaaacaagatcatttttcattatgaatttgtgctatgtgtcagcaccttcccacccccacccccacccccttgatttaaaaacaaaacatgcaaactgtatttctgatcttaacatcaatttttagctctggctcagaatcattctgttcttttattggggccgtttgatcattcttacttcctatttccagatctaaaaccaagtacaagcacactcttcaaaacttttagaacgtttaaccgggtgggttcttcttccgtgggatttccccctcgtcctcctgaaataatctctgaatatttgactgcattaaaaaaaaatcagttttgacattgggagagcagtatccaggacaactttctgctgtcagctgaggtggcttgtcctcaggcactgtgtggctcctctgactctggtctgaagttgagtggtgacaaacatcaggcagatctagggacatggtgtccattctgattgaagtccattattaaattgagccatctgtatggaatctcagcacaacatgcaattccacctccggacttttttatttggtagtatgtgccagagtgccaccacatctcccttcacataaagataacacgaagcaggagacctttcaaaaacacctgctaattcctttgaaaactggactgaagtacagacttgatatctcggtctatacccttatagtaaaaatacaggaaaggaaatctaattgttgggcgagatttggggaggggaaaaacagcaagtaattaaagtaaccttaatttgaagtgaggaaactcaggccacttttggaactgaatagtgtctcctttcaaatccccctgctttctactgggctcctatatcgaacactctctaaatggctgtttgttttgaaagcaaacaaacagacctatgctgcccttatcatccgactttcattctgtactcccactcccactcactccatcctgcactgtaggaatctttcttttctaaagttaaaaagaagctctgctttttgtctctgagctccagtttgtgtcctatagccaaagccactgacagagacagatgtgcccaggtggcagaggggtcggctccgcaagtcaagcaagccatgaagagcttccgtggggctgaagcatgggcagcctaaggaggcctctttctcttcctgatgggtgtagggaaggcacacagcagccagtccccaggagtaattctttaggaccctggtcagttccagtgaagtttctttcctcagttaggtgagcacactcttggtctttttagcagtgtgcaactcaaagcacaggtcaagtttctctgtgccctctgcttgttcctagggtagggcactgtaaacaatgggttaggaagatgggttgggctaagacactcatctggatcagtttcctgctttccattaagaacaaccctggctcttacccccatcctaagacaccccacaatcaccataaccttagagccgcagtttctatgtcttctttgattaaggaatcagacatggattagacgtgaaggtgtttattgtgtgttgttagcatgctgaacttgagatggctataggtggtttatttgatgttcttttttctgagatagaatcttgagatgtctgtagtcggaatgcaggccacaagctgctgatcttcctgcatgctatgattagaggcatgcaccacaccacacctagtgagacaggtgatttcgaagctacagggttcctctaacctcagaatgctgaattgtgtgtctctgtttacctatcagtgtgaatttcctcgtgttcttcagctctgtgtatagtaggaattttaaatatcaaggtcctattgtactcataaaaacaatctaatattgcattttggtctggttatatttcccagactgaccttggactcaataatctcttgcctctgcctcagagtggctgggacttgaagccaccccagaatttctggttactcctttttctctcattcacatgacttgtctgttgagttgcatttgtaaggttaaagatggcaggcgctccaaacactgacttaaacagctacagtgccaactccatagttgtgcctaaaaggtcctagatagcttgtaccttctttctttttctcccccccccccccaagattctaaataacttccttttggccacaggacaatgtgttttgttagcgttaaaatcggtaggtgaaaaccaagcgtctcttctgtagagagaatggcaatctggaagggaagctgtgacctcattgtactgctccttgttggtaatcaagctctgactcccaagaaactgtgcgcaggaggctataatttaaaacaaagttgatgaaccagtcgagtgcctttcttaaaattactgctttaaagtggatatgttgaaattatcagctgctaattattggctccctgacaaatggcattatttgtttttcctgcttggcattttaatattatggaataagcattcaaatgtaaatgtctaataatttgtgtattatagaagacaattccatggattttacagagtgggttcaataattcacccgaacaagcctgggaccggaaagtgtagtcaagcattctgtgtaaaaatttatctccagagtctctgctctgagatactcttgttcccccaaagctaggctaccagcagacaccaccaatgaggaggtgtcttggaagcatagacaggtgtgacgagggcagaggaggagacgaacatctgctttcttcagacctttgccacaaattcaaacaggaccaaaaataacacctttaactcaacgaatctgtttcgaattgtgctggatatagagaatttctcctctcccctttcctgtcttaagaatgccctgttaacatgtattgaatattaaattatttaacaaaatggcatctgacgataaaaggacacctgtcatgagagtggcctgtccccactcttcatgtgtgtttattccacactagacccgagttttaactatggatgaggctggataccagtgtgtatcacagtccaagtctcagatttccactcaaactacctgaagagacattgatttgcttctctgcacctaccattcaggaatataatcataggagaaccgtcaacaaaaaaagccaagtaaagataaatgctgtgcattgccttgccctggctcacctgccactgtgaaaggggtacagagtcactctgggctcatttgaattacttcctggtttgtgtctgagttgtgttgttattttttttttttttttgataccgtaaaaagaaagttatgctcaaggaagaatgccatagttaatgtgtttcttcagcaaaccccacagagtcagagtgtgtgaggccttcagtttgaaaaggtcatttcctcagatcttagaagccacatcttttagaacccacagtctcattacatattccatttcaaagagggacttctgaccaccattgagtagatgttggagaagaacaaagttacttgaaagatctttctagtaaagagcccttatgagctataagccaaaggggatggagatgtcaactggaattttaaaaaaacaacaaaaaccttaatgtgtttggtttctggttccctcggcctctatggaacagctaaagagcattattttggtttctgaggttaaaactcttgcattttcctcaagcatggtgtttatggtttgagggagaagactggaactagggaactgagggcagtaatcttgaccccctctctctctctctctctctctctctctctctctctctctctctgccttctgattctcttagaacggaacatcttctggtcttccaacatgagaggccatagagccgagtcagtcactagaaagcagtccgtccccgggactatttcagtttcagcacttggatgactgtaaacgatgactgtcacgaagcttacggctaactgtggaggcatggatggtgccgtgctgggttatcaattgacagttcaattcactcagctagctagcttgccatctcagagtctgactaatgacctcatattttttttttcccctttaggttattggcgtggtaagtaaggagtacataccgaagggaacacgctttggacccctcatcggtgaagtctacactaatgacacagttcccaagaatgccaacaggaagtatttttggcgggtaagtaagaaaaccttttttttaagacttttcactatagggggtaaatggagcttaaagaacaggctcagttccctttcaacacagcagggctcacccagggaaacactggaattctgagcaagttccctagaactggttaaacgctctgcctagaatattagctggaggtggttagatgtggactacctgtgaatctcaatttttgcaactcattgcatacaggtctgggagggaaggaaacagtttgccgcttgcttcaagggcaggctcatttgcatttctcttcgaggaagtagtaatgagtcacggagacttacatttcaccctttcttgatttcttgctgagttaacttcatttgaatggaagagttatcctgagtgaacttgatgtcgaagacaaatgtcactaagagaggtagatggtgggttagtggaactgggaaggatcatggagctagttttatttaaatccatctgcaccataaaacggttacatttgacagtatcatagttgttaagcatgaggaaaatcctcgtgtgcctatgagattgtagactcaggtagaataactattctaaaggtctggcctatgctatctcctttggagtgtcagggttagcgaggattctgaggtgacctgggagatgggattcatgggtaaaaattgttctctgagatgtctctggcatgttcagttttcctcagtgtagaaatgaagagctatttatacaaatttagtgagctgttttcctcacacagacatgaaatatacaccacccagagaaatggtaatatccacaactggattacatgagaaaaagactttggttaaaaaattacttattcctgagagagtctgtcttcagctaggaagtctttgtttccagaaacgtactacttctacaactgcatctgtagtcttgttaagtatttgttctcaatttttatttatttaatacttagttggtgttaaattatattgctccaagatcgcagtctgagattatgagcggtttcgcccttattgctgttctcagatgggagccaccagtggtagattaatcttggcctcagctggtatgaatgaagacaatccgacactgtcgttttgaaaacggtcaagaagcaccaaaggctctcccattactgtccccactgtcccatttaaagatttacaaaaagaattagactaaataactagaaggcttcccttgggaggaattatttaagtcagttgtccacatgcaaggaagacaggaatgaatcttttcacaggttggaagatcctgatttgtcaagcaggaataggaacatctctgtgttgtgaggaatgaaaggttgtcatgcaaattacacagtcagagatgctcaggttgagaaagcagtgacatttcttgtaactgtagtatgaatcagcttgtgtttagtcttcttgatactggatggaaaggctggtatcagtgtgccttttacaaaagcatgatgctagtttcttggggtgcgtgtgactttcacgacatccaaggtccttttttttaaaacaaggatacagtaaaccgtagccatgaaaggcctactgggatcggcacaccctctgctagctgtttccaccctggtgtaagggcgatggaaccccttgttcctggaagtttgcgcgtcagagtaaacaaacttgaaaacccctcttgatagcagaatccagtcggtcttgttacattttctcttaacaagatacaccgcggaagctctcgcaggctgctttgatgaagccacacgcaccccccacacacacacacacacacacatacaattcacaggaagtctctcttaaaagaaactgattctgctgtttactgcctgtgttaaagggacagagttccttttttatttctgataacgttagagggaaatacagaaacgttcacacagcctgtgtgtgactaagaatacagcaaatagccctgtagagcaaactccctgaggtgagcatggaagcgccgtacctcttggagactgtcttgtgtgtaaagagggctctctgctctgaaggaaggcggtggttcttcaaggagaggagcttttctggagaggatgaggagtgagtctttgaccccttggtttcagtaggagtgtatttctcccctgctcttaactatgcctttaaccaagcactctgagtacagctgtgagtcagaggtagcattgctgaagaagaaccatatattttctttctcttctttttccaaaaggccaaactcgtggctcttgtgtgtgtagaccgtgtatgccagcctcctcacagatatgggcaaatctctctactccttttcaagagagaggcacagggtggccgcctgtgtttaccaagaggaaaagttacttctcgataggctgtcaaactttggcctccgtgccagtgcctcactctgttatggcaggtgaagttcacctttgccccacccagtgtttccacaaaaaggcagggttccaagtattcatctgaacaagtgttactgtgggactcagggttgggggtggaggatgtttgcagagcctaagccccgggcgggcggaggtgtaggaaacacaagtacagaggccatagaaaaaaggtgagactcagtttgacgcagtcctctcggctgctgtgcccagtgactcaaagcactagaagtcagcagagttggaactctgggctgagcagagtcgcctgatcgatattcgctactgtagcaagagtacctctttatggtagtttcacccactctcggctgttgttaattggaatattattattattattattattattttgctatccactgccctccccaacatgagaagaccataaaattgaaatggaaaggtaactagcacaatgtgccctgtttcctcccccatttctgctgattcagcgtgagtcccaccggatcagcaatgaggcctggagtcatgggtacagcgttggttgctcgcctgtgttccttctgagccattcagggaagcttcccggtcgctttgggctggccggctgtctttcacactgcatctatcctctccttttgaacagatctattccagagaggagttccaccacttcattgatggctttaatgaggagaaaagcaactggatgcgctacgtgaatccagctcactctgcccgggagcaaaacctggctgcctgtcagaacgggatgaacatctacttctacactattaagcctatccctgccaaccaggaacttcttgtgtggtattgtcgggactttgcggagaggctccactacccttatcctggagagctcacagtgataaatctcagtaagtggattacagaacaaaaaaaaaaaaaaaaaattaaaaatgctagtaatgtcagttctgcccctgtgagctaataacatgttgtctaattatacggcttcgtcatgtgttggactaagtaggtggctttagctaagacgaggaagaggaaaaacattctttaatgtccctacttcttattataaaacataatcatcaaagatatacatattacatatattgtataaaataaccagtacagaatgttgttttcggaaagttgcaggaagaagtatatttccgattctaatttatgcaagcggctgtaggcacaatcccaatgggtatggacctgtggaacaggccagctgcagtcccttcctgctgtgctgggtcagagctttgagttttcactgaaatcttgtgaagatacgtgtgcctgtaaagccatgatctaatgtggaaagctgttttctagaaaaaaaaaaaaaaactgtcataattgttcaagtagtctaagtgaataaccctaagagatgtcatatctgagcttccttccttatggtaaaggggactgatctcatctttcaatcaggcttacggtaaccgcctatctctttatcttgacaaattcttgcttccttgggtttataagcttttactttttcttttcttctttttaaattttggctaaagttactgtcatgccctctagcaagctttccctcttcagtcagtctcaggtagctttaggaacaatttaagaataaaaaaaaaaaaattctaacttctattttaactcagggtgtgtgttctgggttatactgccgaatcttacagcactttttcaaatgaccatcttcccatgaaagctaaatgttgaaggtttaaaagttttcattttaatagtctctgaaatttgagtaaacatttccagaaatctatagagagttccaagctagactttacccagtttctactcttcagtctcatttgctttccctggagactaaatgtagttcatattttaccactgaagcactagaaatattaattttagtattttaacttttaagaccaaggacagtgtctcgctagccatgttcattctacaatgcttgtgctctcaggaattttcagttttctgaaaatcttagcttcagtacctttcctgtaggctcacaatatagtgtttgtgcccgggccctcagctcagcaacgtacacccttgagctaagcatggtgggtaggtacctgcccaatagcagcaagccctctcctcgtgtttgggtttgctttgggtgtttgtttgtttgtttgtttgtttatggacaaggtctcgtgctgcttaggttcagttcagacttgatgtagtcagggaaagccttgagccactgtcacctccaaaatgctaggatcacaggcctgtgccctccccccacccctgcctcccaccatccccccaatgcctgttccgagtgtttactctttgtgtccagaagtaagtttcattatgctatgaaatgacagctttgctcttcagacacccccccccccttttgactgatgcaggagtcttctgagggtcacaggaacacctcctttgtctgacattcctaggacagaaagagagttaaccattcagctgccgtgcaaggctcttgctcctgattgtgaaacctgttggcccaggtgtggccactgatgactgacactctgatcaggaaaatttccagcatttcatcaggcctaataggcagatcgagtgtccaagatgggctgtgctagatttccaggcttaaagcacaatagaggtctgtccagaatctccgtaaggacttccatcatggggtgcaggggatggaaacctaatgaaagaatgtaagtccccagaaatcacaaactgacaggaaagagaagggagagaggaatgtggaaaagaactgttaaatttagctcctggccctcccaacctttttggtaatttttttttctatctatctaactaacccatctagaaatcagttgaccaaattatagacttctgaatgttaatctgctttctcggtttcagttgaaaacagactttgttttgcctactgcagaacttctaggttctttcttgtagtcttaggggtgcttattatagatcgaaaatgtgagtcggcataattaagccattcagaaccttccaaagcagctcactcttgaaatgactctgtccgcctacagccatttaagatttaagaacaaaaacagatcttgattttctttttcatgttaactcaagctgctaagtgggagagttagaaatgatatcagctcctgtgattagtcagctgctgaaggatgagtttttaaaaatgtaccttcatatacagtctataatttccagctgtaaagtattttagagactgacattttgctgcggatattccttcaggataagttctcagcctggttgtttgtttgtttgtttgtttgttttctgaagacagagccaccaaacgctaaattatgcatgtcacggagaaaatgaaaagctctgacttcattgtttcttggttcagtcattagcttcacagtagttcagtaactaaagtgcttagcaagaagagagccgattaaacctgtgctctacactggaagaaagcccaattctttatacttaacagctttcatttgttaagtttccactgtgggactactacaaaaacattatgagtctttgatgtgatttgccacattaaaaaaatggcacagacaggggtgtggtggcacacaccctcaatcccagtgatcgagaggcagacgctggtggatctctttattcttggccagtccaatctatataacaagttccagacctactgagactgcacaataagtcttcccccagaacccccatcaaaaaaagagcagagttaggaaggccgtacacaagcaggcttgcacactctcacgcgctcgctctcgcgcgcccacacacacacatacataggcatacgcacatgcgcacacaacttcttttctcttaacctgagggtgcttctaaaatcattatctttttgtcttacctccagtaaatcccttcctgtgactgtgggatgcctcgcctgtcagccttccagcttaacctgtctctctcttcctttaccattttagctttaaaaaacaaaagtgacaatttgaacttcctgcctgctgggcctcacccgaaggactgatattgggctgataaggggatatttattttggttgagaggcttgagaaattgctctcccccagaaagctttctgtcactgaccccatcaacatctcccctgatagtgttgtccacggtgtttattctggggctctggcttacccaggagtaactgataacagccagcaggagataacgtcctgtaaagcgctttccgactggcatcaaatccctccagcctgtcagcctggagaatggatctgaaagctttagttctgggcttccacagagttcatcttcagacctatcaggtagcaagcttggagttccttctcagttaagcccaaaagggctgttttataagagcacaaaggatacttctttacattgtcttaagtgtcattccaaacctgccagatcttggaggtcaagaatcttgtttctactccgagcatgtgcaccccccaactaatgatgctctcagcatcctggggagaagtgcctgtttgaatgagcatcccagaaacacaactcagcctgtgcatcggatgtgttttatctttggcccaggaaagctgagctgaggcttttcctgcgaaatagggctacataactatggacagtttaggacagtattctccttgtctgagcttgaccagggcatatatgctgtctctaggagtaaatgtttgtctcttagctgcctctgtcttctttggtgctgtaagtaattgaactagcttgggaagtacctgtcgtggtttggcagaggtgactgtcacacctcatgattccaggagacagcccagatggtagtctggttagaccagaaccttggtgaaatgctcgcactgccgagcaatggctagaaggggcagccgccatgcccttctagttgatacaggcaattcgaacagggctcatgaagttcctatgtaaagagaatcgagttggaaattgatgacagttcattacttaaaactagtcttaatctttcatctaagtttgcacagcattctgatttcctctaggtaaactgcgaatgacttattaacccgtgacaaccccccaccctgtattttttccaccccatcttagtgaacgctctgcccgttccagtttgaacagcacttttctatcctagttctcactaatggaaaggagatcatccaaggggcactgggctctatggaggctggcattgtcccagggtttgatgttattcccgatccccccccccccgccccccggaggaagtggagcagtgtttctgagtgggtggcccagagccctccctccggagtgagaggcgttaggggccaggtgtctagcctttgtatttgctgctgctcagggtttctcaagaagagagaatggctttctgatttcacttcagttctccacagccctgtgagtaaccgccctttcttcttcattttagcacaaacggaaagcaacccaaagcaatacagtagtgagaaaaatgaactctacccaaagagtgtccccaagagagagtacagcgtgaaagaaattctaaaactggactccaatccctccaaaaggaaggacatctaccgttccaacatttcacccttcactttagaaaaggacatggatggctttcggaaaaatgggagccccgacatgcccttctaccctcgggtggtttatcctatccgggcacctctgccagaagactttttgaaagcgtccctggcctatgggatggagagacccacctacataactcacagtccccttccgtcttccacaactccaagtccccctgcgagcagcagcccggagcagagccttaagagctccagcccccacagcagcccgggaaacacggtgtcacccctggcgccaggcctcccagaacaccgggactcctactcctacttgaatgtttcctatggttccgagggcctgggctcctaccctggctatgcacctgccccccacctcccaccagctttcattccttcttacaatgctcactaccccaagttcctgttgccaccgtacggcattagttccaatggcttgagcaccatgaacaacatcaatggtatcaacaacttcagcctcttccctaggttgtatcccgtctacagtaacctccttagtggcagcagcctgcctcatcccatgctcaatccagcttccctaccgagttccctgcctaccgatggagcccggaggctgcttccaccggagcaccccaaagaggtgcttatcccagcaccccacagtgccttctcccttaccggggctgcagccagcatgaaggacgagagtagtccccccagcggatctccaacggcgggaactgcagccacgtcagaacacgtggtacaacccaaagctacctcatcagtgatggcggcccccagcactgacggagccatgaatctcattaaaaacaaacgaaacatgactggttacaagactcttccttaccctctgaagaaacagaatggcaagatcaagtatgagtgcaatgtctgtgccaagacgttcggtcagctctccaacctgaaggtaggtctccagacccccgcgggtttctgcccacagacccgtgctggtttgcccttggctgccaggcagtgcattgttgagtgcacttgagccataggagacccagcttgagcctgaactggggtctgctgaatactgaaaatacagggtttatctcagtgtctttcctaagaggcttgcatctgcattgtacatacctggctctgggaaacttagcaggcaggcaggcctcattgcaaccccagagttcacccctgtggtttcttcccaggtccacctgagagtgcacagtggagaacggcctttcaagtgccagacctgcaacaagggttttactcagctcgcccacctgcagaaacactacttggtacacacaggagagaagccacatgagtgccaggtgggcagtattctctgggtagaactcttgacctctgtggaaaaatagctgtagaattgtcttcctgtgttgtttcaacaatacaaaaaatatggtcttgtactaggctgctggccctgcacagctcctgggtactctgtgactactcacaggctatactgaggatggctgggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctccagctgcaaacaattaatctggtcttccctgtgccctttctctgtcttcccttgccctcacactttaggtctgccacaagagatttagcagcacaagcaatctcaagacccaccttcgattgcattctggagaaaaaccttaccaatgtaaggtgtgccctgccaagtttacgcaatttgtgcacctgaagctgcacaagcgactgcatacccgggagcggcctcacaagtgtgcccagtgtcacaagagctacatccatctctgcagcctcaaggtccacctgaagggcaactgccctgcgggcccagctgctgggctgcctttggaggatctgacccgaatcaatgaagaaattgagaggttcgacatcagcgacaatgcagaccgtcttgaggacatggaggacagtgtcgatgtgacctccatggtggagaaggagattctagctgtggtcagaaaagagaaagaagaaaccagtctgaaagtgtctttgcaaagaaacatggggaacggcctcctctcctcagggtgcagcctctatgagtcatcggacctgtccctcatgaagttgcctcacagcaacccactacctctggtgcctgtaaaggtcaaacaagaaacagttgaaccgatggatccttaagattttcagaaaataagtgtttcgtgttgcttcttagggtatggcttggtgaatcagggtgcctttagcaaattgcttgtacatgactccagatctgcaaagctccgctggcaccgggtgcttccctgcacctctctggaattaaagaaggactccaatgttaccaaaatctcagggcataaatgaggcaaagactcactatatatacatatatacatatatacatattataaatatatatatacttatttacagccatgtctatatatttgaacctgtgtattttgaatatttgtgtggatatgtttgcatagcgccttcctattactaaaactattgcctagccataattattttttcaatgataattcttcataatttattatacagtttatctttcaaaaagcaataattaaagaagtttacaatgactggaaagattctttgtaatttgagtataaatgttgtatctttgtcctgtggccattctttgtagataatttctgcacatctgtttaaatgcctgagacttagaagatagctctgtgatttcaggcaacctttctctatgataatgctttaaaatgaggttttgatattgccaaagtcatgtggttggtgtgttaactcagaagatcacacaatctgagtgacattctctaagttggggatacatgtgcagaattgctcagcaataatttgaggggaaggaagaagaaaaatattttatgtttcagaatgatggtttggttttcctcctcctagtcacaattttaccaaacagtgacaggaaggctttgccaacctgtctcccaatgtcacatgaccattctgagtggccatatgactttggcatccctgggtgttatctgaaaatgtgaagaagataaaaaagccgtgttcagaagatctgtcgtaaagcacagatgttgtgtgtgtgtgtgtgtgggttggggggtttgagtctggctgtcattttgctgttggcttgtttttgtttttttaatatcaaaattgcacaaagctggtgccctaccaagaaggatttgatatagaaaggctcaggccacacttaaaatacaagcaagcaaagagaacagaaaaaaataaaagtaaaaacgggtattcttatcatcttaggttaagcgggtaatgaacattcctgtccccaacgcatcaactgtattgtatctgtaaaactcagcttttctcagtatttgtgtttttgcattgtataattaacttaattaaagatgaaagggcattgcaaaagtgttcaacaattacctcattgagtgtatccagtaggagtgcaggaattaatgtcgtatctcatgagttgctacccagctgagcgtgtgtgcttccaaatggtaggctgggtggttcggtcctgtattctcctaagcccaaaggttacctgttggtgttcaaggtgtaataaagaatgctgtatatttatgaacctatttataccagtataccatgtgtatatatgatatatttataaccacttaaattgtgagccaagccatgtaaaagaacctatttttcctaagagcaaaaagaatctctctgaagttttgcttaaaactccatgacctcgctatgactttggtgcttgggcaccaccctgcctactaccagagagcagagcacctcagtgcagaggtgagggtgtgtagcatcttgggatggatagaaacaccacaccatccagtcgcatttgatggccttgctacatgtgtgtcagttgggtcacagaataaaaatcatttttctatttctgctctcctcttcctcttcctcttcttcttcctctttctctccctcctctagaaccctgactcatgctcactgctcagtctgatgcttaccttagagttttgtatatatagatcaacttacaaagagggaaaacttcagatcctctgggggaaacccaagagccttactgacctgttgctgtgactagctagatgggtttctctttaccttccaaggatcaaaaccagagattccacacatgctagcaagcaagcaagctgtcactgggctgcagccccaacaagactgacatttctggatgcatctgtatttgagaaaaatactcacttaattgtaggttaaccaaagcatgacctgacattgacaccaaatacaaatacgatttctttgcagtgaacttgggttgttttcctcctgtgcttttcttgtgttgggaggatttttacaaggacaattgcttttcttgccatctgtcttcctcttaggcctcttacatgagagtgttgagcccacaatgaacagtggttggttggttggttggttggtttgtttgtttgttttttcctcagagttaaaactgaccaaagttattggctttttactttgctagaacaacaaactatcttatgtttacgtactggtttacattgttatttatgtgcaaattgtcaaaatgtaaattaaaatataaatgttcatgctttaccaatgcttgtctagtgtcttgaaagatgttcctgtgttattgactaccacagggtcactgagccacgtcgccaagaattttcagtttgtctctctctgccccgccccctttttccagcaatatgacgtgatgcccaatatctcccctttctgtgggctgtcctaggaagcgagtgagcatcactgacctgaactatctcatgctcccattcaactactaaccaggccagacgctgcttagtttccaagaccaagtgtgttcagggcgctgtgccatcactctcaatagtgtgcagttttcccttccttatgagttatggatgtgtatcagtatacctgaggtcatagtgaggaactaaggaagactagtgtctatttcagaaatgtcacatatgtactcacagcctgcaggtgggtgagggcttctgggaagctggggtcagaaacctttcttgctgttgacattagtattgtttctgtggtttgaagctaacccaaaatgtgccacaaaaaatgccctatgttcctccaccaccactccaaacttgggactctcattggcaactcgggtacttgatgtgaatttccaaaaggctgactaaccccaaactagtgtgaagatcagggttcctggtggcatggctcggagcctggtggatcctatggtgagactgagactcctttcttcttcatggatgtttcagaacctaacctgtccccagagagagacagcacaagtcaaattgattccctttggaagataaaaataggagatgggtcttaaaacgtgactgctctctcgagaaggttctggaaccccctttctgatgcttttcgtggctcccatttcaccatggccaacttgatgagtccacgctgtatgttgagaaaacaatactccttatacttcggccctccagactctcttgtgttttcttttgctttcagggtttcatcctaattcacttaaacatcttgaaatgctgccaacatataactgtgcagttaagaaaagcagaaccctattatcctaatgtgccaagtggtgctgattagatgcccgagttctacagaaccattgtggtaatatatatatttaaaacctccttaatatctagggtgtaacaattgctaacataaatcatcattctttggtagatgaggtcttgttttctttagagttgcccatctcaggaacaactatgcatagagttgagtgggacagtaacacccaccaggagcctaagcgcctctgccagagtttggactgttagatttacatagtcctcagtgggcaaagcaagtctcaagaagtcactaattcttttttaaatttccttaattacataaaagctatacagaaatattccctatcatattacaatatagagactatacgtggtgcatcatagaagtttatgagcacaattcttgatggcctttcattgggggaaatgaaataattttgttctcataaactgatgtaaatgatgttattctctctctctctctctctctctctctctctctgtgtgtgtgtgtgtgtgtgtgtgtgtgtgtgtgtgtgtaccaagtgtggtagcacatacttttaagcagaggcaggcatatctcttttagttcagggccatcctgctctacataaggaattccaagcaaatcagggttatatagtgagagcctgtctccccctttccccccaaaaggaaaaagaataaaaaaaaaaaaagataatgagaaagggccaggtcagagggaggaaaaacaataggatgcacatggagaaggctttctaacaaaaccaggcctccagggaggttgtccagagaggagggcagaggggcagctaaaagatgctcaatgagaggaaggtttcaaggcgctccatgagccagtccgcaaaggtggagcacttttcccataatacattgatttcattgccttcagctagaccattcttggaattagctacctcttaaaatccacttccagctgtgtgatgatcctgagtttctgagaccatggagaagcctcccaccacatcccttttcaagacctcaaagaccccaaagtccaagtgttcaaagtagtgctgacagcttaaataagcgagaagtgattttaatttcaatacagccctaatcggtgtgattcagacgaaaactgcagcaagattccagaaggttatttttaaccagatttatgcaaatcttctctgctgtggcccagcttctcagaatactataaacttaacgaaccttctcctagttggctccttccaggcttgccaagtgctgagtcaggattggccctgtacacatttccctctctctgtgtttaagatagaaggtgttattcagcacaagtgtgacatagtcatctttgagtttttcctctgccctatcgagaaagaaagaggaagtggcagataagcaccatcgggtaattttggtaagagattcttcagtgtgcttacaaaatgtgttttcgtgaaatgataggaaaacgccccatctttgggcatcaggaaaactcacctgtggacaaaggaaaccagctgctctccactatgggtggggaacaaataagatcacagcagaagagtttaaaccagtgaccccatcctggaggtcgcgcatcagatacattacaactcataacaacaaaattagagctatgaagtagcaacaaaataattgtatggttgggggtcactacaacatgaggaacttcattaaaatgttgcagcattaggaaggctgagaaccattgatttagactgagactaactatctctgaggtttataagacactggggttctcctcaggcagggacagagttttccgacttgtaggaattaaggaagagtcaccccacttaaaaacacaagctcatcccaagatatcccagcaagcccctctatgccaacagtccaagcatctgtcaattttatgtgcagccgaggacctaaaccaagacatgttcaagactttggtggagaactttagtttccttaacctcctgagactctttagaaacaaagtatgtatgacctaacaaactagaaaagcctgcctaactctgaggaagagtccatgattctgtggaaaggaagaaagaaagaaagaaagaaagaaagaaagaaagaaagaaagaaagaaagaaagaaagaaagaaagagagaggggggaaggagggaggcagggagggagggagggagaagaaaggaaggaaggaaggaaggaaggaaggaaggaaggaaggaaggaaggaaggaaggaaggaaggaaggaagagaaggaaacaaacaaagaaatgaagaaacaaagaaaggaagaaaggaagaaaggaagaaacaaagagtgtcccaccttgcagttcccaggaatcatgaacagcaatgaaacaaagagttcccctggccctgttagagaacccccaccagtgcaggaggtactcaggaagaagggtggcctctgccctcccctctccctcagtatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagggaaaggttaaagccaagacagaaactgtgagtagatagatgtgaaaggggctgaaaacgagtgaaaagtgaaaaattgccttatgaataaaccgttgaaagacggtgactgaaaaagcaagcgtgcttccagtaatttctgaatcacgagctgtagcagagaggctggcctgagcagcccgaccccctaacctccactgctgcactgggctcggcgggcctgtgggcggacagttttctacttgactgttcagtttcgttgtgattgcctccagcacagatgatgtgggccattttaccaccctgatcaccaaaaaacatgcctggtcatctctccaacctgctggcacgacaggtaggtgatagtccagcggcacccgatgggacgagccaagggacgagggcagagccataaagaagacacaaaggagttcaggagacccaaagccatggcctgtccctgtcttgccggaagtgacatggcttcgtgtccagtgttccttttcattcctggtggtatgttccctggtgaagccaggttggcctggcctcaagtcctgtctgtgttgacagccaccacatgacctttccctgaacacctttgggctcaggtgtagcaaggaagatgccaatcatagcaggcttccctcctccacccctttgcatagttggggaagtaagtacgggagcaccaggaagtagaccggttctaccagtgtgagtctgccctcctgtgagcctgcatgactagggatgttaaaggaggcactcaagtacacaccagccaggcctggtgtggtggaaaatggccagacgacacagccagttccccactgtggggctgtccccacacttacatttctaaatgtagtccacactcagtaatgcatacatcgaagaggtgggaagcaggtggccacctatcccaagcttagttgtagggatgtgttttctgtccagtgactggtgggcatcctccctccatgagcacacccttaggacaggctgaaggaagcaggtgcctctctagtgacctagggacgagggaaactaggccaaggggacatttgacctagatgacccaaggaactactaaccaatgcgtgcagcagggtggataaccaaaacatgagtcggctcctaatgcacttgtctcattaataaccaccctgtgaatgtagtcctgtccacaggccaaagaggcagaggctttcctaaaacctccccagggaccttggcattttttggattgtagaggtcctttgctttggctagtggggggctttaagacagtgtcctttcctcccaggggtttcccatgaaggaggtgacgacggtgttggacttggagtatctccagcccagagattcggagacggtcaagggagatgcccaagatgtttaacaacttcatgccggaactggaaactgattctgctcccgatgttagcagattagacactgctcttattgccagctgggcagaaccccaaggagctgctgctattgttcatacttttgggcacgtttgccaaacgtgagcaccttacagcacaaaacttagctctgttgttgttgttgttgttgttgtgagaactgagccagggtccttgtgctcagtaggtgagtgctctgccactgagctgtatcccaagccaaatggcctgaactcttaaccagtcattaaatcatgttaggaagaaacagacagagagtcctggagaagcacggcctgccacagtctgctgtggttctgaaccacctttcactcactctatggatggcgggtcctctgtgaggtaccacagggagattgtatttttgctgcttttgcacacaggcaggcgtcacatcaactgcttcagagaagaaagtggagtatcaagttaacccgtccctcagaggataatgcctcagatactgagtagtagacatggtgtgcatatttgctgtttagaaaaaaagagggggcagggtgtttatagatccttccacttttgatcatggaacctggatgctctccacagcagagggaagacatgtgattgaatgcatttctatttcaggtgcacagacaaggcctctactgcccctgaatttaaagtggtatattctgtcttaaatggtctccatatgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgacatacacgtgggtcccagactacaacttacattatctgaagcaaaccagcccatcgtgggtaagttacagctgtttcggtcctttctccaacttaagggtagtaacagaacctatcattgctcatctgcaacctgaagaattacatgctcttaaaagggttggctggaaagagagggaagaaaggaaggaaggaaggaaggaaggaaggaaggaaggaaggaaggaaggaaggaaggaaggacccgtctaaaatgtagagtcaagaagcacctcataaatcaaggtctgactcttgattcccatcagagacaggtgtaaaagtgagtggctttgctaggagagacctccctgagttctactgagggcccgctccaaagcagcaaggtcttctggaagatttagaagaaaaagaaaaaagagagaaagagagaaaaaagcctgctcaaggtacacagacttccttccggacttggtttttctcccttctcagggctggttgaaagcttttctgtgcttctaactgtgcagaaaccacatcacctcctctgtcatcgtctttgctcaccactggagaccccggtggttagagagggaaagtccctttgatggtgcatgtgaggggagagggtgttaaggacggggagaggggagcagagagggcctgactagactttagtcctgaggtcagccaagcatatcttttgggggagttcacgatactcctcctcaccttgggatgaggagaaatatatcatcaaacaaaggatagaatgctaacttcaagagctctgtggttctgcgaagcccaaacagtggccacaatgacttctgggtagcctaagaatagtctatgcttgactctttggcataggtactgatgtggacctagaagggcaacggtgggtgtgagcgcaggtacgtctttgattttagccattgaggacaaactctgaggtgctgcgactgtctgtctgccttttcttttctctactttttcgtttcttcttttgagaccgagtcgcatgtatcttgggctgtcttcaaacttgttagcaaggtagccaagagtgatcttgacttcttgtcgctctacccttgagtgttgggatctaggtatctgtgaccacacccagtttatgtagtgctaggaatcaaagccaagacatagcacgtgttaggcaagacttctaccaacttcgctacatctgtgagccctctccattattataaaaaacatgtaaagctaagcattcataagtgttcagtacagcggtgttgactgtatgccctttgttgtgcaattgatcttcttcatcttgcaaaattgaaactgtattcctcgtccccttccccctctgctactggggactgacatttcttgatcctgccacttatcacgggtacttttcttcagttatgtctatatgcttgatttccataccaaggcctagtttgagttcacacaccacctgccctgctggaggagccctgcagatttgctccttgtgaatagtcattattcacggcagatcacaatcgaaaatccatgtgctcagcactctggtcaggcttagcagtttatggagatgttatttgcaccagcacaccagtcaggaatgaaaataactatcaactcctcaaatgtttataagcctcttgggctattgcacatgtaatttagagttgccatcttgtctccttcttcttctcagtggaatggaatgtcctcacttcatcttggtagctgtagggatgtggggaggagagtttgctagtcaacccttggttgaagtcctcttccctctttggtagcaggttgtgtggtggcacttcctcatataagtcactactaagcaaatcctccctgcaggttgtacctggaaccagggcagggggcaggtaagtactctcacccaatcagagcaatcaacttgtcattccctgaaaatagagtcgtccctccagtctggcctgttccctcccccagcacgcttgactggtggggaagaagagaaggcctgactgcctttgagcaaggccgcattccaggggagtggttcctcccgcattcgctacacactgggcgtgctgtgcctcgtgcctgcagccacccttgaagggttattgttacacaatagtcatgaactctggaatgtttctggtcatttacagtgtgacatagtcacgctgccaatgacactgtcaagcttcaaggcccagaatgcagttggcttgtttttcaatagaacagagttccgcccagcacagaacaaagctcggaggttttttacaatacgcatcctactctgagacgcataaggagaaaccctagggaaataaactacaagaacatgttacaagtcacactccaagcgtgtcacaacccctgtaaagtacactgaactagctgaccaccctgcttactgatgagctttctagagattagcctagcagtccttggggtgcctttttgtccactcttgcctccccttctttggtttgtttcctgtatgaggtagatgaagaaagcaagagattaaggttccaaagagcgcctgattcatgaggcatgcctgttttgcctccgtagtattcattgaaaatggcacggttccagtagaagaaacagaaagtaaaaatgaaccttaactctggcttctgtgatcagcgataggaatgaacagcgtggctggcgttcgtgtctccgcacagatgccccttaaggtacgtctattatgtccatttcgcttgtacggtaaagagacccagaaacagataaataacttagatactttagggaaacaacaatggtgcatataaaaaaaatttatatatatatatatataactgaggattgaacctgagcctcatacatgcctgacaagtgctatttattttatctatttttattatttatttatttatttatttatttttgagatagggtcttgctaactgacctaggttggtcttgaacttaaaatccgtctgagtcagtagcccaatgtatcaccagacctgctcaaaataataataataataataataataataataataataataattggggggaggaggtggttgaagcatggtttctttgtgtagctctggctgtcctggaactcactctctatagaccagactttcctcaaactcacagagctcttccacagtctacctcctcagtactgagctcaaaggcacatgctaccaatgcctggtgcaaaacatttaaaaaaaaagatttatgtatttgaattt

SEQ ID NO: 722 - DNA, 5281 bp, Mus musculus
gggggaagagtagtcagtcgctcgctcactcgctcgctcgcacagacactgctgcagtgacactcggccctccagtgtcgcggagacgcaagagcagcgcgcagcacctgtccgcccggagcgagcccggcccgcggccgtagaaaaggagggaccgccgaggtgcgcgtcagtactgctcagcccggcagggacgcgggaggatgtggactgggtggacatgagagaggcttatctcagatgttggatcttctcttggaaaaacgtgtgggtacgaccttgccaaaggctgcattttaaaaccgtgcttcttcaaggcagtctactttacacggctttggactcttactcaactgtacaagctgcccccaagtctagctccggctccgtgaagtttcaaggactggcagagactgggatcatgaaaatggacatggaggacgctgatatgactttgtggacagaggccgagtttgaagagaagtgtacatacatagtgaacgaccacccctgggattccggcgctgacgggggtacttctgttcaagccgaggcatccttaccaaggaacctgcttttcaagtatgctgccaacaacagcaaagaggttattggcgtggtaagtaaggagtacataccgaagggaacacgctttggacccctcatcggtgaagtctacactaatgacacagttcccaagaatgccaacaggaagtatttttggcggatctattccagagaggagttccaccacttcattgatggctttaatgaggagaaaagcaactggatgcgctacgtgaatccagctcactctgcccgggagcaaaacctggctgcctgtcagaacgggatgaacatctacttctacactattaagcctatccctgccaaccaggaacttcttgtgtggtattgtcgggactttgcggagaggctccactacccttatcctggagagctcacagtgataaatctcacacaaacggaaagcaacccaaagcaatacagtagtgagaaaaatgaactctacccaaagagtgtccccaagagagagtacagcgtgaaagaaattctaaaactggactccaatccctccaaaaggaaggacatctaccgttccaacatttcacccttcactttagaaaaggacatggatggctttcggaaaaatgggagccccgacatgcccttctaccctcgggtggtttatcctatccgggcacctctgccagaagactttttgaaagcgtccctggcctatgggatggagagacccacctacataactcacagtccccttccgtcttccacaactccaagtccccctgcgagcagcagcccggagcagagccttaagagctccagcccccacagcagcccgggaaacacggtgtcacccctggcgccaggcctcccagaacaccgggactcctactcctacttgaatgtttcctatggttccgagggcctgggctcctaccctggctatgcacctgccccccacctcccaccagctttcattccttcttacaatgctcactaccccaagttcctgttgccaccgtacggcattagttccaatggcttgagcaccatgaacaacatcaatggtatcaacaacttcagcctcttccctaggttgtatcccgtctacagtaacctccttagtggcagcagcctgcctcatcccatgctcaatccagcttccctaccgagttccctgcctaccgatggagcccggaggctgcttccaccggagcaccccaaagaggtgcttatcccagcaccccacagtgccttctcccttaccggggctgcagccagcatgaaggacgagagtagtccccccagcggatctccaacggcgggaactgcagccacgtcagaacacgtggtacaacccaaagctacctcatcagtgatggcggcccccagcactgacggagccatgaatctcattaaaaacaaacgaaacatgactggttacaagactcttccttaccctctgaagaaacagaatggcaagatcaagtatgagtgcaatgtctgtgccaagacgttcggtcagctctccaacctgaaggtccacctgagagtgcacagtggagaacggcctttcaagtgccagacctgcaacaagggttttactcagctcgcccacctgcagaaacactacttggtacacacaggagagaagccacatgagtgccaggtctgccacaagagatttagcagcacaagcaatctcaagacccaccttcgattgcattctggagaaaaaccttaccaatgtaaggtgtgccctgccaagtttacgcaatttgtgcacctgaagctgcacaagcgactgcatacccgggagcggcctcacaagtgtgcccagtgtcacaagagctacatccatctctgcagcctcaaggtccacctgaagggcaactgccctgcgggcccagctgctgggctgcctttggaggatctgacccgaatcaatgaagaaattgagaggttcgacatcagcgacaatgcagaccgtcttgaggacatggaggacagtgtcgatgtgacctccatggtggagaaggagattctagctgtggtcagaaaagagaaagaagaaaccagtctgaaagtgtctttgcaaagaaacatggggaacggcctcctctcctcagggtgcagcctctatgagtcatcggacctgtccctcatgaagttgcctcacagcaacccactacctctggtgcctgtaaaggtcaaacaagaaacagttgaaccgatggatccttaagattttcagaaaataagtgtttcgtgttgcttcttagggtatggcttggtgaatcagggtgcctttagcaaattgcttgtacatgactccagatctgcaaagctccgctggcaccgggtgcttccctgcacctctctggaattaaagaaggactccaatgttaccaaaatctcagggcataaatgaggcaaagactcactatatatacatatatacatatatacatattataaatatatatatacttatttacagccatgtctatatatttgaacctgtgtattttgaatatttgtgtggatatgtttgcatagcgccttcctattactaaaactattgcctagccataattattttttcaatgataattcttcataatttattatacagtttatctttcaaaaagcaataattaaagaagtttacaatgactggaaagattctttgtaatttgagtataaatgttgtatctttgtcctgtggccattctttgtagataatttctgcacatctgtttaaatgcctgagacttagaagatagctctgtgatttcaggcaacctttctctatgataatgctttaaaatgaggttttgatattgccaaagtcatgtggttggtgtgttaactcagaagatcacacaatctgagtgacattctctaagttggggatacatgtgcagaattgctcagcaataatttgaggggaaggaagaagaaaaatattttatgtttcagaatgatggtttggttttcctcctcctagtcacaattttaccaaacagtgacaggaaggctttgccaacctgtctcccaatgtcacatgaccattctgagtggccatatgactttggcatccctgggtgttatctgaaaatgtgaagaagataaaaaagccgtgttcagaagatctgtcgtaaagcacagatgttgtgtgtgtgtgtgtgtgggttggggggtttgagtctggctgtcattttgctgttggcttgtttttgtttttttaatatcaaaattgcacaaagctggtgccctaccaagaaggatttgatatagaaaggctcaggccacacttaaaatacaagcaagcaaagagaacagaaaaaaataaaagtaaaaacgggtattcttatcatcttaggttaagcgggtaatgaacattcctgtccccaacgcatcaactgtattgtatctgtaaaactcagcttttctcagtatttgtgtttttgcattgtataattaacttaattaaagatgaaagggcattgcaaaagtgttcaacaattacctcattgagtgtatccagtaggagtgcaggaattaatgtcgtatctcatgagttgctacccagctgagcgtgtgtgcttccaaatggtaggctgggtggttcggtcctgtattctcctaagcccaaaggttacctgttggtgttcaaggtgtaataaagaatgctgtatatttatgaacctatttataccagtataccatgtgtatatatgatatatttataaccacttaaattgtgagccaagccatgtaaaagaacctatttttcctaagagcaaaaagaatctctctgaagttttgcttaaaactccatgacctcgctatgactttggtgcttgggcaccaccctgcctactaccagagagcagagcacctcagtgcagaggtgagggtgtgtagcatcttgggatggatagaaacaccacaccatccagtcgcatttgatggccttgctacatgtgtgtcagttgggtcacagaataaaaatcatttttctatttctgctctcctcttcctcttcctcttcttcttcctctttctctccctcctctagaaccctgactcatgctcactgctcagtctgatgcttaccttagagttttgtatatatagatcaacttacaaagagggaaaacttcagatcctctgggggaaacccaagagccttactgacctgttgctgtgactagctagatgggtttctctttaccttccaaggatcaaaaccagagattccacacatgctagcaagcaagcaagctgtcactgggctgcagccccaacaagactgacatttctggatgcatctgtatttgagaaaaatactcacttaattgtaggttaaccaaagcatgacctgacattgacaccaaatacaaatacgatttctttgcagtgaacttgggttgttttcctcctgtgcttttcttgtgttgggaggatttttacaaggacaattgcttttcttgccatctgtcttcctcttaggcctcttacatgagagtgttgagcccacaatgaacagtggttggttggttggttggttggtttgtttgtttgttttttcctcagagttaaaactgaccaaagttattggctttttactttgctagaacaacaaactatcttatgtttacgtactggtttacattgttatttatgtgcaaattgtcaaaatgtaaattaaaatataaatgttcatgct

SEQ ID NO: 723 - protein, 925 aa, Mus musculus
SVARSLARSHRHCCSDTRPSSVAETQEQRAAPVRPERARPAAVEKEGPPRCASVLLSPAGTREDVDWVDMREAYLRCWIFSWKNVWVRPCQRLHFKTVLLQGSLLYTALDSYSTVQAAPKSSSGSVKFQGLAETGIMKMDMEDADMTLWTEAEFEEKCTYIVNDHPWDSGADGGTSVQAEASLPRNLLFKYAANNSKEVIGVVSKEYIPKGTRFGPLIGEVYTNDTVPKNANRKYFWRIYSREEFHHFIDGFNEEKSNWMRYVNPAHSAREQNLAACQNGMNIYFYTIKPIPANQELLVWYCRDFAERLHYPYPGELTVINLTQTESNPKQYSSEKNELYPKSVPKREYSVKEILKLDSNPSKRKDIYRSNISPFTLEKDMDGFRKNGSPDMPFYPRVVYPIRAPLPEDFLKASLAYGMERPTYITHSPLPSSTTPSPPASSSPEQSLKSSSPHSSPGNTVSPLAPGLPEHRDSYSYLNVSYGSEGLGSYPGYAPAPHLPPAFIPSYNAHYPKFLLPPYGISSNGLSTMNNINGINNFSLFPRLYPVYSNLLSGSSLPHPMLNPASLPSSLPTDGARRLLPPEHPKEVLIPAPHSAFSLTGAAASMKDESSPPSGSPTAGTAATSEHVVQPKATSSVMAAPSTDGAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCAQCHKSYIHLCSLKVHLKGNCPAGPAAGLPLEDLTRINEEIERFDISDNADRLEDMEDSVDVTSMVEKEILAVVRKEKEETSLKVSLQRNMGNGLLSSGCSLYESSDLSLMKLPHSNPLPLVPVKVKQETVEPMDP

SEQ ID NO: 724 - DNA, 41685 bp, Homo sapiens
  misc_feature (1)...(41685): n = A,T,C or G
ttttggggaattggatggtgttgattatgttacatcagtcttttaaaaaacatgtaagctgttactttattagtagaaaaaaatgaagcatttttctctgaataatttaaaactatgtagcactagaaaaaaataatcccagtttaaatttattagatctgaattaatattatatgaggaaggcatactgcttagtaaaatgcaattttagactatattacttaagatgtacaactgtttcctacacacaaacaaatggattatatgcaaaatggttgcataacttatttatctttgttttaaactactctgcacatcctaaaacaattttgcaatcagaattgtatcagcccactaagcaacaaggagtttgttttgttaattgctctagttaaacctaattactgtgggtggagtggctttccgtgaaagggaggaaggccctaagactggcaggagaaaattttaggaagaagtccagtgccaggagtgcagatggctgagtggacaaaagcagaccccacaagaactgtgtaagtcactttcacttggaaaatctattacatttgtttttagtggatgaacttattttcaaatgctgttgtcagaggtaagttcttcccattcccataaacatgaacatcttaatgtctgtggctcctgccctggaacatgttttttgaagtcccataaacaaaggctgagcagcagtcttattttctctagaaaaacagaaagtacattcagagcccactacagtgctcccttcacagatgggagctgagaaccattttaattgattcattcggcacacattaatcaaccatcgatcacaccaccaggcactgtgctaagggctgggttttcagataccgatgattatgtatagcctggtaggtagaagaccacagagacagatcattgtccaggaggatgaatcacagttagagcatgagcaaaaaagtggtatacatgaggaaatggagcccaaggctccctgttttccatagacactgcctgaactggaagccaggtgtctggggccatgcctagcactgtcaccatcacccagcaactctgtagcaatacatgtacttcaataaaccaggactgcatgtggacttcttggctgtatctttgctttttgggacttctgaaattaaaaatgtttccacgaatgtctgaagtcatatgaatgaatgtttaatatacataacagtttgaaggataatttcacatgctgtgttttcattcctaatggcattttggaaaaccttctgtcttctaaagaatgggggaatatcatcactggagaaaccttttctttgtctggcagaaccttcttctattaatgtaaactagttgttaatgaaacagaggtcaataaggaaataaatctttgatttgtttaaatatcttctgcacagaacatcaagacaaatgggtgtcccttgtctgaggaggagaaggctttgggagaacattgagttaagcagtgaggtaactgtgatgagatctttcttgctcggtaaatgtgtttacttttttcactggtatttatactagttaatgtgttgctccagataaatctacttcctgcgtccatctttcagcttgttctcctctcttgggagttgacaaatggtttgtgtttgacaccatttatcagctgagtccctgctgggtgctgccagaggcttgctcagactactgtagagaaaaagtgagtacggtaaatttgtatttctagtccctctgtctagaggagggtgcatcgcgcaggaacagattcagatggctgcaagttttacctcctggaagacataaattttcagtccaaaataagctcttaatcttctcctggtgggatctctgtaaaatggaataaaatgagacccagtttagaatttcctcagaagggcaaaattaaagggtgactgctgtcatatctttgacaccctgaaagtgccttacatttggggaacactgaaaaaacatgtcccccaaaatgactgcaatcgcagagactgctgcttttgatggagcaggatagcagccagatgccttctttgtgttatatcagtgcttttgaatttaacattcatttatattcatgcaaagggaataaacttaagttaaacagcatggctgggcgcagtggctcacgcctgtaatcccaacactgtggcaggccgaggcaggcagatcgcttgagcccaagaatttaagaccagcctgggcaacatggcgaaaccctgtctctatcaaaaaatacaaaaattagctgggtgtggtagtgggtgcctctagtcctagctactcaggaggatcatctgaacctgggaggctacggtgagccatgattgtgccactgcactccagcttgtgtgacagagggaggccctgtctcagaaaagaaataaaataaaaaataaaacagcgtgagggccttgagtagatcatttggggtctctggaatttaaagttttattttaaaaaaattattattattatcattattattattattattttcagacagagtcttactctgtcgcccaggctggagtgcagtggcgcgatctcagcttactgcaacctctgcctctcgggttcaagcgattctcgtgtctcagcctcccaagtagctgggactacaggtgcccgccaccacgtgggcctggctaatttttgtatttttagtagagacggggtttcaccatgttggccaggctggtctcaaactcctgacttcaggtgatccacccaccttggcctcccaaagtgctgggattacaggggtgagccaccgcgcctggtctattatttttaacatttaaaaaaactgttaaaacaaggatcagtgagggaaaaaaaaataactgaagagaatggtataatgcacccagtacccagttcaacaattaccaacttaagacctgggttgtttcatctatcccaaccccacccaatgattttgaggcaaaggccaaaaagcatataatttcattgatgaatattgtatcttgtatttctgtaacacaaagatttattttaaaagaaaatcaacacagcagggtgcagtggctcacacctgtaatcccagcatttgggaagctgaggcaggcagatcacttgaggccaggggttcaagaccagcgtggccaacatggtaaaaccctgtctctactaaaaatacaaaaattagccaagtgtggtggcacgtgcctttaatcccagctactctggaggctgaggcacaagaattgcttgaagccaggaggtgaaggttgcagccagccaagatcatgccattgcactctagcctgggtgacagagcaaaactctttctcaaaacaaacaaacaacaaaaaaaacccaacacgtgattcatgatggttggaattgttaattccagtattgtattttaaaaggacaggttattaaccactctttaggctattgagcagggaagagtgggaagagatagctctataaagatttttcagcattaaaaacacacccaggggccaagattgaattgcaaagatgattttgctcctttcttggattctaggagattctggaaggagagcacatgcaggtaggcgccaaattggcatttaaagctctgttgtttagatagaattacatcctttggggtgttgggtgagaatgaaggctttactctgcctagctggtggtggcagcgtaattagtgagatgtcagctacaaatgaatcagtgaggcatgcactccccacacataagcacatgcagatttggcagctagcagtgatctagcagttggatcctaagtgtgcctcgtgccacttgttgagcctaatgcaaagtgcagtttaatcactgatgtgcccgtgagcatgattagctgttaaccgattagtgaactgtctgaggccccagagtcattgatttggactcagccttctgttccacgccccccaccgcagcccccagcatccttccttctcctcccctcaatctatgaggaagaaaggagaaggagaagaggagaaaaggtccagatgggaagaaaagaatgctgaaaagatcctgtaggaagtaggtcaggtactttggagattagcttgcttcatccctgaatgcgagagccaggcacaagtagcatacaattagaaggaattagaacagcaacaagtagcttggatttatcagctttaattgtctattgtcaggacagagctctcctcccagggatcatggtggcagtacacatcctaatacttttaatggacatccattgtgggattatctctcctaaaggcagtgcctgttctcttcaaaggagttgtggggatcctgcctgaaaagcaccaaaccgctccttccctgtgtttggtcccattctagggtaaagcagggttgcccttcagtcctccagaggtgcaccttaagggggcggatgcctactgaacaataactcctttgccctgcttccccggggtgcctgcttgaaggaaacaatgggctgtagatggagaacagataagccagggctgatggcttctggatctccaggctatcttcaggttaaaaggtttcccagcttttccttagtcaacattagagagttgttcaaaagataaggtgtctattaaatgaggtttgttattgtcttgcctttgccttctctttcctccctcccctctccacctctcaggtgggtggaggtgaaggacagtcatgccttcttccaaactcagacacgaatttggtttaggcgggttgaacttcttctggtgtcaccaccggtttaacatttaaaaggttctccaataagcgcagccccctcctcctcatttttaagtccatgtgtaccttaggtccagtaagtgcttaggatccattacagaaccctgagcttggctggaaatctgagaaccaagttctgattttgctccctgagctgcagccctgcctgtgggctggcatttcccaggttcacagttctatgttaagatccagttaccaaaaaagagtctgggagagatgccctttctgcttcctgacctctggtcctcagtttcctcagcaggaaaatgaagtgtagaaggggatatatggtcttcgacttagattggatactaaatcccctttggagcagaatgggagttgggggctgggggtggtcaaatgatttcactattaacctttatgattctgtctcttctatcctaacttaccttggcgtgaagaaagtcaagcctctacagtcttgttcttcccttagaaaggatgagaagaaatcgtcagtcccattttaaataaaatcacctgtgtcctttggttaatattctgtgatttcagggaagcacacggtggcaggtacaactgtagggtcccttttcctcttccaaggggactgctcctccctgcactgggtcttctgctgctgttcctgctcatcctccatagaagcctttcaccttcatttttaagccaactggtcctccctaatcttattcttggcgaccttccctttatttccaccttgagtcctcccctcttccagaatggcttctcctcccactgaaaggtgagagaagcaaacatttgacccacagtcttgctctctcatttgtgtggaagctactcttccggttctccaaataaagacaagagatgagtttcagagtggacacctttcctattgctctttttctcccttgttaacagttcaggttttgccttctgttagtttaattttaggattattccttttttcccaccagctgtaaggttaggaagtgtcttctgagttctgaaataatcttccttctcctgttctttcccacagacttctcagaaattaaaattcttctgtctgaatattcactatgataaaaatataattagaagggaaagcaaattttggaaaccccaaaccttggtttccccacaagtcatctggaaatgattagtattgctattatcatttattaagttggtagatgctgaactaaaggaatagtttaaaaaataattttaaaatcatatataaatgattagatgagaatacaactgtctttctgaagggagggctaaaaaagatattaatacttagatgtaatgatacaggtggttctataaatactctgagaccttggacatcctgtgggttttataaagtcctctggagaacacttacatcttcattcctagggtgggaagggagctctacttgtgttcttgaatttacttaatttttgtttcccttatgtaggaagtcaaaacactgacctcattccaaaacatccaacagcccctgaaggtcaccgtcccaatgtttaggccctgaatatgtttgtcaaaagtttttgggaggtgagctgtgtcatgagaaggaagcttgtgctatttttaaattgattcaactcatcatcgaaacatatcgtacacatatcacaccaatgacacacacaggctgcattgtaacatagcatgtgtcatacatatattctctctcactcatacacacatactcgctcttcttgtccggcttttaaaaaggaaggcagccagaaggccaagcccagtgatttgagttgaaaaggctgttaaagtttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgccccccccaatgggtgggtagggagtaggaagaagagggtgggggggttattctcttgatgtggttagcctgtcattgaccttgtttgggtatggcaggagttgaatgagaaaatgaaaacatgtttcatcttgggtacatttcatcccttttttttaccttaggaaaaaaaagttcctttcgaaaaaaaaaattttttttccccaagtggagttcaggtctccagatttggtgctcaatttcccttcattctacaatagtcctttccctatagagtcatctggccaccaacattgcaattcccaatccacccaggaactgggagaggaaaaaaactggcccagtagctgaaaccgaattaaaattggctgatggaactgttgtgatgatgccatccacgggaatagatgagaatttctgagaacagaactatttggctcattcatgatttgctgccattgtgaacacttttaatgtgagagctctgcctgagaaatgctgattaataaagataactgaggttcttttcggtgttctaacttggggggaaataatatagtgactaaaaatgcaccaagttattacttagaaacaaaccctttgagacataagattccagacagtggcagcctctgatagctctctctgcacagctgtactgctgccagggtctcccagctttagtcagcagtaaaaaggtgcactgctcaggccctctgggaggaccgagtgaagttcagaggtcagtcccttttattcccccttaatggttttgtgctggacaatacctaaatattacaatatggacatgttttttcctattatggagcaagcttcctttcttttatttcttcttcctttttggtagctttcattttaaatgatgatatccatcattgactactataatcatagtcaaaagttggtttggaggttttttttttcccaatcactttgagacaagaagcaaacatgtgaaggactttacattccaacactctgtgtctgaaaatttactttccttaaagttctacccgtggccttgtccagctcagctgggacacctggaactaattttagggttgcctggctaagccccacactggtatttgaagtttgcgtcctccctagactcaagcccatttcaccacctctgaaggtgagtgcaggctgatattaattaacagtgagttgattcactggcatcttccagtcattaaagcaaatatttggcttaaaatagccttcttcccacctcaaatatcaaactttttgcctattcccttactctatcatggttgactcaccagcagttgcatgatggtgtatgtggcctaagaacagagtttgattctaaaagggaagtgaaatactctttaacatctgcaagtgagactgtttgaacagcaggccagccttcagtatgactacattgtttttctgtccattgtggtgctgactcagcatcagttaataaaccctcttgagcaggctggatttctcttgtttaattatcagcttggagctttctgaggactcttaggaattgttcattcagttttccagccccagcagatctgccttctaaaagtcctgcttcctcttggtgctagcgtcccctctggcataacatgcaatcacaggtgggccacgcagcaagcagcgagtgtgtgctaatcatgtcccctagtgggaatttaattgttctgtactgagagagagattgcagcaagactttagacaccatttcctggcaaataatcttttgcctctccccctctcccctaaaaaaaattctagaaaagttttctaaaagtgagaaaagaaattttaaagataaacagacatattttttaggattgagttgggcttttgttttgctttgtttcatttcttcctgtaaacaaatactcagatgtccatttcattgtatgactaagttggtatcattaggttggaactgggtgtgtgtatgtgggtgtgtgtgtgggtggatgtgtgtgcacacgtgtatttaaaatgttagaaaagacattgcaggtcgaaggagaaatgattttaaaaaaacctacctatggtaaggcaagcaggaaaaatggaagacctggatttcaatgatctaaataataattgaaatggggtgtttgctataaacattgtttctctgaattaaaggattccttgctgaaggcacaagaccattgaaggaagtaaagcatctggtttgttttgtaatgagaagcaggaatgcaaggtccacgctcttaataataaacaaacaggacattgtatgccatcatcacaggatgtccttccttcaacagaggactgactgggctggaggaaaagctggccggggctcagaataagccccactaattactgcctccgaccgctttccacttgcagtgatcagttcaatattcctctgaactgtgaaacgactaatgctctacattttacttacactcctgggaagtcagcctgtgggttctgggaggagaggaaaggaaaacaaacaatctgtagaattataacttttgcctatttccctatttactaaatagttaaaagaggaaagttagttctgccaagtttgaacgttagcaggagaaacggaatgttacaacttttggggcggggggcggggaaacgtgcgttacatacacaacagcttgaggaccagacagctccactgtattacactagctgcaaaaacaatttaacttgctcttttgaagtaagatttgtgtcttttgtacctggggatttgagctgagaaatcagaaactgtgtaggtaaattttaagtttccttaatttaaggaacgtgcgccccctaattctgccgcgccaggaaggagggcgatctggagtgtttagaatacaatagagcccaagtaagcgttgaggttaagtgccttcaaagggaagtaagaagattccaagtcaatgttgaaatacacatgcgaagagaggaagctctcggcggctgtgctagcaatctgggggaaagccctgggctcggccaggtggtgttggccacgttggccacgcccccacttcgcgcagccgagtggctaaggaaatcttaagcagggaggggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggtaaggaacttgaattttttttttttaattctgaaattgatctgaaaactttattttcttttcctttattgttattattattaattttttttggctaatgtcgcagtagaaacatgcttctgctttagtgcacttagtgctgtcaaacatttgtgagactttccttatgaatcattaaccctttcagttctagacataattgccaattcattgaaatttcagtagtggttccagctcacactcgtcaaactattccgggttggctgaagttttctattttattttatttttaacatgtgtttggcgtcatgactctacatgttggaactaaataaaaataagcaggtttgcttaaatcataactgagggaaaaacaactttgcatccaacttttttttttttaagagcatcctatttagagaagtggaagaatgtaaaaacctccttgaaggacttccacagaatgttatgtttacatttgaacaaacacacattcttacatggaaatgatacccatattcctcatttttatcaaacatgtctatatgagaaaacccttacagaagttgtttacctttttttgcctttggaaaacagtttttttctgagtgtgagggaggattttgggggaatatcctcatcaatgtacaagtggaagcagagcttgtcctccaagtcttctaaatttgttataactttagttacagtaaactgtagtacatcagtgacttctgggaattcatacactttcagatttaaatggaaagtgctatttgtagctgagggctcctaaaggaattctctccagggaattttattaaacggttttatgttttgtttttgccttttcaatttggtatgagatgcttgcaagtcagaagacactgcaggctgttttccccttcacccatttttcctcctcttttcctgtggtccaagtgatttctaagaggccgtagctcagtgatgctggcaggatgcaacccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggtaaagccagggattgttcagaggtgattctttttttttttttccttttccccacagtgaggttgccacattctttttttttttttttttttaactaagagtagcatttaaaaaccttgcttcttttcaaggcagtttactttatacggctttttggctctttctcaactgtaccaagcactctgcatctgcttttaaagtcttcagactactgtattagtcatagcctctcagaaggagccacaggaacggcgggacaatggggattaaaggcctttcctttctcttccaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggtaagcctctggtttattgacaagaagattggggacctggtgccaaatctccctacttgcccttgaggccttgtatatctctgaaaacctctgagaatctgtaagtatcagtaaataattgattgctctattcaattcttgcattgctttctctttccctaaaccatttccttctcatttcttccagccttcaactgttcctcactaattagtaaacagttaaatattttggcaaattggcatgtcttagaaaagcaacttgcagcatagggtgggtgaaattgtcagtgaacttcaagaaagctctgggcccactggccctagtgtccctgttgtacaatatctcttaagggagaaaactttttcttggaaaaaaaagttttaatatttcttttgtctgtctttggtaattagttggctttactctttttaacaagccagctttattagctgggtttctaaaactatcctcaaaactttgacgtgtttatgaagtgaagtgatggtataagccgagaaagggggtcatgtaaaagtgtcctctgtctggatgacttcagagctaaccactgtttatctgcagcagctcctttgctggggctgggctggcaggccaattccttactggcctctgaagtgggtacactctttgttgtttcaaaggggatgaaaacccaaacttggaatgagcaactgatttgtgtttacctttaatataaagattatagctaggcgtgatgtttagctgtgaaataacttgcagaaccacctcttgttttcagaatttggcttactgtagttgcacttactagtctactactgggttgagttgaatgaaaggacccctcagcagacttcccataccaccattagcacagagcactgtcaattctattacttccttcagaaagtagggaaaggggatggttggccgtagaaatccagaatttgctactgggactattccttacagccgtgtcaaatcactttcccccttccctaaggaacagtatttgaaggaatccgggagactaggaaatgctttgtctctttcctgtttgtgtgtctgagtccagtgtttttggtgagggggagacacagctgtctaaaattaaatagaacaacgatgctcagtctttcttttttcccccactgctgcgtgaatggaggcagattttataaaaaataaaatttaaattctagttgtagttgaatgttaccaaaaaatttaaccccagaggtcagccttaattatacctcttcctgaaagtaatgctcttcttatagaaagtctctcaatatgtggcccttggaatgaatgtaggatttgtttgggtatatgaggtttgactatggctttaaaaagtgtagtgtgttttttccccatatcaagtttgaccaaatattcgtctgttcccaagcttcgtttgtgctgtgttgccctgtccagtcctttgggactgaagtaaaaatctccattctgtgggtcatctttgccttttaattctataatgttcttatcgtcagttcagctcttagcttaagtttttcaatttccgtcattctcctttaaaatcatagctaagtcaagtaatgctcttagatcatttagttcaaggttcagaaagacagtcacttacccaaaggcatataggtaaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaactaacctaagaggtgagggttctcttatcctatttccctatcttgcatttaactgaagctcttgaatagaggatagtatgtctttaaaccctaatcataaagtcaagcaaggagtaaacttgaatgtaatactgtcttaagcttactctggaatttgtacctgtttttctgtttctctcctttgtttttgaactttgggaaaggacagcttcctttagaaggtgaaagaggatggtggagttgagccattaagggtaggatagctgcaaactagttccgggacagcaacattaaggattgatgaaatgtttacattatctttattcagttagttctttaagttccatgagccattgaaataggaagagtctttctacatgtactttttatctgacttattaatcttgcccttctttaaatgttttcgtttaaatagcaaaagatgttacaatatgtactattgtgctgacataccggggaatttttttttttacaagaccatttttcattatgaatttgtaccatgtgtcagcaccttttttttttttttggttaaaacaaaacatacaaatcatatttctgatcttgaccctcatttttagattgggtttagaatcattctgcacctttaatgaaaaactgttcttacttcctatttccagaactgaaatcaaatatagacctactattcaaaactttgaaaatgttttaaactgatgggttattcttttatgggggttttccccttgtcctcctgaaataatctcttatgactacttgactacagaaaaatcagttcaagcatttatattttagaagcgttaccctgtagagtttctgccgtcggttgagactgcttgcactcaagaggcactgtggctctgtgagtctcacctccctgtatcgtggctgataaacatcagacagattgtgaggactcctttggtgtccattctgatcgaaatccattattaactcaagccatctgtaaaaagtatctcaccataacatgcaattctctcttcatgttgccttttatttgagaaatgatgtaccaaggcatcaccatgtctcctttaatagaaagataatgaagaaggaaaccttctccaaacaactttgttcacttcactccttttaaaaatggggtgattgccgggcgcggtggctcacgcctgtaatcccagcactttgggaggctgaggacagcagatcacctgaggtcaggagttcaagaccagcctagccaacatggtgaaaccccatctctactaaaaatacaaaaattagccgggcgtggtggtgggcgcctgtaatcccagctacctgagaggctgaggtaggagaatcgcttgaacctgggaggtggagtgagccgagatcgtgccattgcactccagcccaggcaacgagagtgaaactctgtttcaaaataaataagtaaataaatgccattgcactccagcccaggcaacaagagcaaaaccctgtttctaaataaataaaataaaataaaaatgaggtgattgcaggctgaaggtcttggtcactactgagttctagttctctcaagacaaatattcatatggtcaaaacagaattataatctaacgagtcattcttatagagtgggattcggggagggaaaacagatagctagtaatttaaatgatcttaatgtaatttggggagaggatgatcagatgacatttagacttggatatagtttctgcttcaaacccacgctgtgtgtgtctgtttgcatactctctaaagaaggaatttgaaaaaaaaaaaaaaaaacaaacctatattgtccttgttatcagccttccattaagcgctccaactcaacccatcctaagctgtcaaatctccttcattgtgtaaaattgaaaagaagccctgtgttttgtccggaagctgtggaaactgtggacggcggggtgtgttctgtaactgaggccacagacagaaacaaatctgctcaagtggtggaggggtctgcaccgcacataaagagcttctgtgggagcaggtgaagcaaggaggtattgaagccgggtgtcctcttgctgttgagtttatagaaggcacagagcggcctgtccccagcagtaattctttaggaccctggtcagttccagtgaagtttccttcttgagttaggtgaacacattctttgtctttttagcactgtgaagtttaagctacacaccaagttcctccttagtatttgcttggttcaaagataaactgttacaaactatgggtcagggagatgggtagtctaagatgcacattctggatctttctaggaccagagggagacttagtacttggttttttcacttccctttaaaaacaatcctggttcctgttccccctccaaagttacctggacaagcaccatagtcttagagtttcagcttttatggcgtctgtgtctcagacgtgcatttgagatgaagatgtttactgtatattagaacgctagacttagaatggatataggtggtttgtaagtgccttccagttttgaaattttatgattttgtatctttatctataggtgtgagtttatatgtgccctatagcactgtatgtaattgaaatttaaaatattagggcgctctgtccctttcctaatgataagctaatattgaagctctttaatttgtctggggtttgaggattatcatagacctctcttctaccacagagccttctctttttaattgttctcctgtcttgcctgttgaattgaatttgtaaggttagagatggcaagagctacttccggtgctgctttatagcttactagtgatgagtctatagttgtgctcaaataggtattgggtagcttatgctttctagttgacttctttttgggcacaagaaaatgtgtgtaagatggataactgaaaacctagaggcccattctgtaaaagaatggcaatttggaagaagaaccacgacctcagtgcagtgctccgttttggtaatcaagctctgactcccaagacaccatctgtaagagactataatttaaaacaaagttgatgaaccagttgagtgcctttcttaaaattactgttgtaaagtagatatgttgaaaatatcaactgctaattattggctcaccaacaaatggcatgatttgtttttcctgtttgtcattctaatattatggaataatcactgaaatatgaatgttaaatgatttgcatgtcatagaattcaattccattaattttccaaattaattagattcaataataatatgtccaaaacaatgagcctctgaataagtctactaaagctttaaatatatatatttatatctcaagactgctctgagatactcttgtccccagtagttttactgccaacaaataccaataatgacaaacggtgattaaaagggcagatagatgtaaatgaaggcagaggaggaggatgaaatgaacatctgcttttttcagctctctgacagaaattcttaaaggaccaaaaataacactcttgtttcaacttatgttaggtgtaggaaaattttctttttttctctttccagtctgagtatgcttcattgatttgtatattgaatactaaattgttttagaaaaaaaaatcattggctgataagacacttaaatgagaaaagctagtctgtcacaggcatgtaggtgtgccatatctatttaaatagaggtttaaattattgatgagacttaatgaggaactggtgtatattgtaaccaaaattgtagattccactgtgaacaatctgtgcatggatcgattcacatatttgagtctaccatttcaggtacatgaatgtacaggagctactgggaatataaaaactggaaaataaacattatcatctattaccactccctcctccttggtccattttagtaaagaattcagtaaagtgataggtaggctatcttgaatgagaagaaaataaaactaggaaagtgagagaataaaaaccaaaacaaaactgtaactgcaaactgttgtaaaggactactcacagaggagttctattgaatagtgacgaattgcttcctgattcacggttggtgatttttttaccccttcaaagagaaatttattattaaggaggaactggtatagttaacatgtttctttagcaaggccccacaaagttaaaatgtgtgatgcatccagtctgaggtcatttcctcagatcttagaacctacagctttcctccgtataaacttaatttcaaaggagggcttttggccaggcatggtggctcagcctgtaatctcagcactttgggaggccgaggtgggaggatcgcttgagtccaggagtttgagacaaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacacacacacacacacacacacacgagggcctttgaccactcttgagtagaagactcgagaagaacaaagtagaaggccagagaagaacaaagttacttgaaagatctcttattaaagagaatgtacaagctatgaaaaaaaaaaaacacacacacacacacaaacctcatctggaatgaaaaaaacataatgcatttggtttctggttccttaggctgttatggaacaaccaaagaacattattttggtttctgaggtcagaactattttattcccctcaagcacactatgcttatggtttgagggagaatgagaaataggaaactaggaacaggctgaaatggtctaatcttgaccatctaattctgcagtgtcttattctcattctaaaagagaatggttatattcgctgttctagcataaaaagtaatgataaaaataaaagatcccgtattaccagacaataatcccctagactgttttaatgcttggttgagtatttgcttatgatctcagactttaaaagatggtctccccctatggtgaagcttgttaattatgtaggcatcattaatgtctgtttacttatcaaaattttatcattgttagttgtattactacttgacagtccaatttatttaattgaaaagattggttaacattttatagtcaaagtaattgtttcctgtgttttttcctgtttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggtttttttttttttgagatggagtctcactctgtcaccaggctggagtgcaatggcatgatctcggctcactgcaacctccgcctcccaggttcaagcaattgtcctgcctcagcctcccgagtagctgggactaaggtgcgcgccaccatgcccagttaatttttgtatttttagtagagacggggttccactatgttggccatgatggtctcgatctctggacctcgtgatccgcccaccttggcctcccaaagtgctggaattacaggcaagagccaccgcgcccagccaggaatgacaaatgaattaccttataagtaaatgccattaaggaaggatagctggaagatgggttgaggggaatggaggaccacagaactagtcctatttaaatacatgtgcatggtaaaatgattccatttgacaataggttaattatctcatagcataaggaaaatgcttaacagtcatatgcaagatgataagctttcctatagcatccaaccaaaagatctagccagtacaatttcctttgctatattagggttagaaaggcccccagaggtgaaccaattagatggaatccttgaataaaacactggattagcagtgaacagaaaaaagtcagattgctttccttcttcccatagatgtctcagggatatttagtttcctcagaagataaagaatttagtaagcgtttttttgtgcatacttacatgaaatgtacattatttgaattctttaaaaagaaacagctgcatgataacaaaaattgtgttatgcttgctttagctggtatttttgcctagaacgattatatcgttcggacaagaagctattcctaagaaacaatatttttaatccaggaagtttttcatttttagaaatttatcttactatttcccaagcaaaagagggtagttacagattcactaagaatcatgtgctcacaatttttatttaataattattcctccttaaaatatattaatcacctgacttacaatggtggaaccatgagtgcatttttgcctttattgtcaataacgtcttctcagaagtgagccacaaaggtgcatagttcttggagttaaaggtctgaattaagacaatccagcataagtctcattaatgtgtgattattttgagaaaaggcaagaagtacctaagaatctccccctcactgtccagttccctgtttcatttaaagattcactgtaagtaactgaaaggctttccttgggaggatttatttgaatcagtctttcacatgcaaaggatattgtagaacatctcgtttttgctggcaggaatatgaacatctgttgtgaggaaagaaaaagtttcatgcaaattacactgccaaagaagggatgttcaagttgagaaaccagtgacatttcttgtaactgtactatgaatcagcgcattttaatcttctagataatatatggaagtgcaggaaggtggtaggaaacggtgttcattttacatatgcgttattttattctgtgtgagtgacttcatggcaccgacattgctgtttttaaatgaggatacagtaaattgcagtccgaggaaggctaactggaatcaacatacccgtagctttagaaagcagtttccgcaccagcgaagagtacaagagcgatggaaccccatgttcctggaagtttgcacatcagagtaaacaaacttgaaaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctgctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttgagtccctattaactattaggaaacttgatcatttaaaagtatatatatatatgaggagctaccttgagttttgaattcaggatgttacaggaagaaatatatgtccaattctaatttatccaaaagcagttgggagaattacagggattggtccagacatgctgcgtatgcaaggtatagccctcatctgtggtactttggcagggcttagactgcatcaaaatatttatagatgtacatttgagtgtacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctctcagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgagccacttccacttaagggtctccttacattccttgagtttaatcattcatggattcagaggaaagtcttttgatttttgcttttctttaaacagttcatttgaggtgacctaccccagtgactttgcaccaaccaccaagaaacttttttgcatgcttcccgcaccctgtgccaatcaagggaagggtttaaaggcctggcgtttttattcctcaaagaaaggttttgcacagtattttaaggttcaagtgcttctactttgtgttcagaagcaactgtcatatatactgtgaaatgacaccttttatttatccctttttatttatgcagtatgtccccttttattttggcagaattttttctaaatggtggtttaacattttcaagcacatttcattgtccaatattcatagtaaagaatgagagttaacaataaccagtcacattaaaacaagattcctgctgccagttgtgaaaccggttgtcttaggcgtggcagctgatgattgagactgtgatcaggaaaatttccactatttcatcaggcctaataggtagattgtgtctccaaatgaactgtgttgggtttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaatgttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaaggatgattttttaaaatgcacctttactgtatatggacttcctaatttccacctgtagagcatcttagggaggctaacatgtcactctggatgttcttttagaataagatgcaaatctatttttctgaaggcattagagatagcaaacatttattgtgagtttactatatactaggcactgtgctaagtgttttgcatagaaagtttaaaattctggcttttttgttggcccaatcataagtttcatatcagttcaacattcaaattatattaaggtacttaagaagaatccctggctaaatgtgaggggcagtgccacagatggactgaaactttatgcttattgcacatttatgctattattatttgttgaattatagaaccaagggagtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaatccctctccctcagcaagctttccatcacggcccccccgtcagcatcttccctgatagcgttcttctctgtgtttattctggggcttcaggctcgcccaggaggaactgataaccgctggcaggagataacattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgccctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatcttactccagcctaaacagcaattttctatcataaggtctgtactaatgaaaacagaatcacccaaggctgctgtttgttctgtctgtgctgccattgtccgcattttgctgaggaggaaacggaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtaggccttgagagagagcagtccaaggggctgtgagtgcatgcttgtgtttgtatttagcttgctttccatggggtatcgattgcatttgcagtagtatgagcccccggttggggatagtgggtatggattccgcctggcttttgccacttctagctctttgactttggacaagtgacttcccttctcctgattttcttctgaataataaaaaaattaggggtttggactagaagattaggtgaaactccctgctagcctgtgatttttgtgcttttaagaaaaacaccattctgaaaacatgaagatttcttctttttaagactgtcttgatgcttttcttaagatatttgcatcaacacttgagtcttggagcagaaatgttaggtctcagagccagcttgagagcagagctaacacatgtggcttcttcccaggtccacctgagagtgcacagtggagaacggcctttcaaatgtcagacttgcaacaagggctttactcagctcgcccacctgcagaaacactacctggtacacacgggagaaaagccacatgaatgccaggtgcgcagtattttctgggtagaccttctgacctttgtagaaaatgtctgtgagtcaccctcccatgtcctatatagcccgtagttaaagccaacaccagattctgcgttgtcccatcctggactgatggcactatggtccttcccagtactttgtatctgctgatgacttgagatggcacagccagcttccagtgggtgggaaaatggtaggggaaataaacagcccctcgtgtgctgtgtgcccacatccccccgtttgcttaataccacactggaggtgccacaaggaggcttctcacctcctaggttgctgggcgttggccggtaagcctgcccctcccgttggcaactcttaatcttctggccttcctgtctcccttccctgctgtctctctcccctacactgtaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgcttttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaatttgtctagtgtcttgagtgaagggtcagtgagcgacatctccatactgtacagatggcaccagaacaaattttgaacacaatgcaatttgtctctcccctgcccccacccctgttcttctgcagcaccctctggggtgccctgatctcccccggctccttccaggagtatatttgtgcgtgatctgacagcattgatttgtctctcataactaagatttttctttatgaactataaaaatgttctctaaaggaagcatttcaagcatcagccagtaagtgggagacgatttgtttgctttgtgaacttttacattttatttcgtcaatggacatggggtggtgagcagataaggaggacttggatcacttccagaaatgccctgctagcttgtgccagtctgtgtgcgtgtgtggagactcagcacacttatgggtgtggggccctgggaagctgggtcagggaacactttgcccattggtgacagcggcttcagtagcttcctctgggcaggccatggggagtgccctacaacccatgtttactccttcacatgtaagcacgtttgctatttgctacttgtccttttttttttttttcttttttttttttttgagaccagtttttgctctgccacccaggctggaatgcagtggaacgatgatgtcttactgcagcctttatctcccaggctcaagccatcctcccacctcatcctcccgagtagctgggactacagatgcgtgcccccaggcccagctaattttgtttgtttttggtagagacagtctcactatgttgcccagactggtctccaactcctagactcaagcaatcctcctgctttggcctcccgaagtgctggtattacatgcatgagccaccgcacctagcctacttgtgcatttaaaaagtttccagaaagctgctttcccagaatctgagcgttgttagtgtgagagccaggtatcttggtggtatggccatgtggccctatgtgatgggaacaagtctatgtgcttagccattcacgctccagaaactaacctgtgtccagagaaaaggctcacataaattcgagtctcatttgatagatgtaagtaggagatgcttctagaaaagtgatagttcattcagtgaaaagaaaatctaaaagccctttgcaagtggttttcatgcttcccatttcatctattagcaaatttatggttttatgcgcatgctgactgcatgttaagaaaataatgctcctgcttacatttggacactcaaaactgcctgatgctttgtttttaatgtttcttctttaaattcacttaaacatctgtgcccagaatttgaaattctgccaacatgtaactgtggagttaagaaaaccagaaccctattgtcataaacgtgccaaacggcgctggttatattcctaaattctacagaaccattgtggtaataatttttcaaaacaaagcccaataggatcctgagagtaacagctaactaccataaatcatagttctttacttggcaaatcatttctttctttttttttcttgagagttatatatcttgggaacacttatggacttagctgtttaatgaaacattacataaaaagataatattcactaatgagcccaagtccacccagccaaagtccatactgttggatcaagacttcatccagctgtttgtaggacaaagtaagactgaagaagccacctttttctgagtttaccttcaacaaaataaaaactctgtgcagaaatgatgcatttaattccctaccatgaggcaatatatagaatatacagcaccgtgggagtctataggcacatttctagatattttttccttgggggaaatgaaatcaatttaggatccgtaagttggtataaatgagctcattccttcctctgtgtgtgtgtgtgtgtgtgtgtgtgtgtgtgagagagagagagagagagagagagagagagagagagatgccttctctaaaaggagataatgagaaaaggccagaacagaggaatgaaagtaattagaggcacatggcagataatttctaatgcaaaaccaggcctccaggataatctggtctagaaaggaaggctgtaccacagaaggcagcagctgaaagaattgatgaacagaagagttagatagaatgtgatcattgaaccagtccagaaggcacttctgtttcctttcagagatcatggagttctttgtccataacatgtcatttcattctcagcttctggccagaagaaatcagatcattatgaacagtggccatcaaatctacttctgggtatgaagtggctacaagaaatgttttaggattggtggataagcttccctaacatcatttttcaagcttcaagtcctcagaacccaagttcatttgctcaaagtgctgctgacagctgctccttaaataagtgaaaagtgattttaatctcaatacagtcttaatcgtgtaattcaggcaaaaatgcagcaagattccaaaaagttatttttaactgaatttatgcaaatagtcactctccctttcccagttttacagcatactataaactaacaaaccctctcctagtttgctcttccttccaagtttgacaagtaatgaaccagggttggctgtgtgcacttttccttctctctgaattttcgataggttttattcagcataaacatgaatgtagtcatcttgtggttttcccctacccccgtcataaaagaaaggagaaatgacagataaatagcaatggctaatcttggtaagaaattcttcaatatgttaacaaagggggttctcatggaattgtggcaaagttccccaacttcaggtgtcttaaggattcacctgtggatgatggcaaccagctcttccccattgtgggtaaggagcagaacaaaggaaatgaaattaaagcgttgcagaggggactttggtttaagtcaccaagacgaacacctacatttagggtttgtaacacaatggattccttcccatgggagggagcagtccccatccttgcagggcttagagaggaatccgtgtgtttgaaagcacaggatgaacaagatgctctggtgagcttttcctaggtctttagtgtttcatgttctttaatgttcctgaggcttccttggaaatgctgtgtatttaggcagatctggagagcccgtctgattctgaggaagagtctatgatatcatgaaattaattttgctgtatattctgtaaaatattttaagagatattcaatgtttgaattcccagggcttctggaagggtctgaaattgaaaatgaggcatggtgccactgtcacctgcattacatgtggcactctgtaaagcaacctccaggctagcagcctttcagcgcagttatcacttaagaagagaagggaccatctctgtgttctctccactcatcagcactatttcccttgagtactgtttcctatccacaggcaaaggaaatgagacacaccgcagtccccttccacataaccctatcttgcctctccagtttttagtacaagcgacctgacagtgatttgctgtgagatcaaccaactgtggatcattaatggggtcacttactctttcttccatggctctcagggccagagtttaaaaatacacccaagatgggaactgagttgatgagctcctaccatcacggaaaaagcggcatatcaggagtttagggagcttggttctagtcctgattcagcccctggttaagcgtgtgctcccaagaaagtccgggaacctcgctgggccacagtttcctggtccttaaaaggaaggagtcatttcctgggttgtcttcctgttctttggaagatgttcttacatctcctaacatgctcagattccactgttttctcttatttccttttgatttgttttccttggaactccggttgttgctataggcagatatttgtaatttagagagcagatgtcggagaaaatgaaaatgaggggcaagtctgtatggaaacaactattgtggcttcttttggcaaaagtgagtgggcttgcaaaggtcctgctaatttgtaagaaccatgaactttccccaggaattaatatgctcatctgaaaggaatcaagattcttttaatggacataatggcttatgcttaaatcaaacttctgcttaagtaccatgaattctaggatgtttagtgggtttttgttttttttcttcgtcttctttctcttttcttttttttttttttttaaagcaaaggcctacatgtaagatgactgagaaagatttaagccccttgccacaaaaaggaaagggggacaaaaatatgggcagctaaagaaaagaatgagaacccagtcaagagaccctaagaagacgttgaaaggaaacgtttcagttagaaagtaatcaaggccctgatactgttttaacggctcaaagtttaaaaaagggaataaagaaaaattaaactgagagagggaggagagagggaaaggttaagccaagacagaaactgtgagcagatagatgtgaaaggggctgaaagtaagtgaaaagtgaaaaattgctttatgaataaaccgttgaaaaatagtgagtgaaaaagcaattgtgcttccagttattactgaatcacaagctcgtggaagacagaggctgaccccagcagcaactccacactaacctacatcgcagcagttggtacactgcagttcctgtgggcggacaccgttttctacttgagtgttcagtttcattgtgattaccctccatcaccgtcgcatgtgggccattttaccgccttgaacacaaaaaacctgacttggtcatctctctagcctgctgacactccaaagcaggtgatatcctccagaggacacacagagaccaaggggtaagggcgaggggaaggcaagcaaacctgagagaaggagaagcctctgcctgcccctgctttttcctgaaaatgacagtgtgatttcacactcagtgcccctggtcattcctggaggtgcgttcccacagggacatggtatggcccgttggacaagtctcttccgtgctgagagccaacagattgcccttcttaggaacacatccgggctcaggcttagcaaatgagacgccaaccatagcaagcttccctccaccccttggcatacttggggaagcacggggagccctaggaagtggaccagttccaccagtgtgaccgccttcctcctccttcaggaagaggctgaatagtggaagtgccggacacctgccgtaagagaagtcaatcctcatgaagaatggctggtaccaaatggcacacgctgtttccaaagctgcaggcttgctgtccttctcattgcaagtgcaaaacccacttttatattagaactgcccccaagcagctagcttttggttatatgcttcaacggaaaagaggcgggaaatgggtggccacagattcccagtaatttgtgtgggagtgcttcctgggcactttattggtaagcattcaccctccctgagcacaccctcttctcggtgacagatgcaggcaggcaggtggtcctccagggttctaaggttggggaagccaggccaagggaacatttgaccccgatgacccagaaagcagttaactcatgcacacagctggatgcataatcaaagaacgaggtccaattttgataaatctgtttcatttttaataaccagggtaagactatagttctgtacatctggccaaggcggctgaggttttcctcaaagggccatgcagatcttggtatcttttttttttttttttttgagatggaatctcactctgtcaccaggctggaatgcagtggcacgatatcggctcactgcaaaccccgcctcctgggttcaagcaattctcctgcctcagcctctcgagtggctgggactacaggcgcccactaccacctccagctaatttttgtatttttagtagagacggggtttcaccatgttggccaggatggtctcgacctcttgatctagtgatccgcctacctcggcctcccaaagtgctgggattacaggcctgagccactgtgcccggccggatcttggtatcttttcttgctgttgctacaagaggtccctggccttgtgctgatgggaaggtttaaggcaacgtgctttcctccttgagtttgttcataaaagaggtagaaaagattggtctttgagtatctccatcccagaaataagaaaattcaggtatggaaagtcaaggaatatgcccaagccacctaacaagttcatgctggaactggaaactacatcccggcttcctgactctggcagattagacaatgctcctattgctgagctgggcaggggccaagtgagccactggcattgtttgtgtgtagggcaagcttgccaaagcagcagagtcttacagcattaaatgactgtcttctgccttgtcaggagcttgactcttaactagttctgcagacatttcagtaaggaaggaggcgataaggagtcttggagaatcatggcttactatggcctaccattactctgaatccatctcacttctaactccacagaaccgttcctgtctctaaagctgagctcattccagatacccactttactaaaaggtttccatctctctgggggtggccagttcccctgtgaagtgccagagtaaggtgacatttccggtgctttagcagaaaggtgggtgtcaggcgtcagcagttctccagcagcctcaggccaacagtgttccaaagaggaaactgaggcacagaactaaccctatcccatcagagtgtgcctcagagtcctggtaactgcacctagagagcaccgtgatcctcaggtaggggggcattgagcagttgcaaaaattcacatgctattttggataaaccggctttaaagttcattccactttaaagacatggagggttgtgttttctgcaaaggaaaggaaatgtataaatggacatattttctacttcaagtgcacacaaaaaaacctgtgttgcttctgagcttaaggaggtatgttctttgttttaaatattgcccatgcatagttaaccaatgtacctggaggcagagatgaaagctgaaaaagaacagtcaggtctacctttgtgttccaaggcaatgtaatcccacaaggcacaattcctctaagaattatctgaaaattttcaatatgcccacctgttaaacagcttttgcaaccaacagaaactctggaagatttatagtctgattgcttcaaattggtcatttttgtctcctctagttttgacctacacgtggattccagactgaaaattacattatccaaagcaaaccattcagcccatcttagatagattacagctgtttcaacccttcctccaaatggagggtaataacataatatattatagctcatctatagcctgaagaattatgtgctcttaaaaggattggctgaaaagaaagaaaaggaaggaagacaggaatcttctaaaactaactatataacttagaaatgagagaagcgtcccttaaattcagatctgaatcttgttcacatcggagacgtgagcatttcaaggtgatgggctggaaatgaactttgctagtagggactttcaaccccttctctctgtgagttctgctgagggccactgggcacgtggcgggcttctcctaaagagagtcatgtacgtctgcaagattaaaaaaaaaaaaaggcagggtaaagtctgtagctgaaggttgacagacttccttccgcacttgggtttttctcccttctaagggccgtttgaaagttcttcttgtgcttctaacttagcagaaaccacatcatgtcttttgtcatcatctttgctcaccactggagaccctggtggttagagagggaaagtccctttggatggtgcctatgggggtagaaggtgttgggagccagcagggggtccgggtggagagggaagaagagaggagaggtcatcaagcttgcctttctggcccaggcaatatacccaccccggctagactt

SEQ ID NO: 725 - DNA, 3108 bp, Homo sapiens
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttag

SEQ ID NO: 726 - protein, 789 aa, Homo sapiens
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 727 - DNA, 114633 bp, Mus musculus
  misc_feature (1)...(114633): n = A,T,C or G
tacataggtagcacagagcagaaggcaactctctacatttatatagggttaccattgctgatagagtaccaactgccctaccattaaagtgattaactaacaaacctgtttgtgtagatcagtggaccttaaataagaaaaagttacaggccccagaacagctgatccaagagcagctggtggctcaacatatagaagagtccatcagctcttggaattctccaatatttttcattaaaaagaaatctggcaaatggaggataatgagagatctgagagaaattaatagagtaactctgcctaagggtccttcacaacctggaatccttttaacttcattgttacctaatgcatggcctgttatagtaattgtcttaaaagattgcattttctcaattccccctgaggaacaagatggagtaacatttgctttcactatgcccagatttaaccatgaaaatccagctaaaaaataccattggttcatcttgccacaaggaatgtcaaacattcccccaccttctgtcaatatttgttcaacagccattagaaataattcatgaacaatttcctgaatctgtaatttgtcattatataaatgatatattactgactgatccagatgcagatacattagagaaaaatgtttgaagaagtaagggtaattttgccttgtttaggaatacaaattgctcctgaaaaaaaaatacaaacagaagattctattaattatctaggatataagataggtttacagaaaattcatccacagaaagtacagataataagagatcaattacaaactcttaatgattttcagaaatggctgagagatattaactggctatggcttaaaattggattaaccactcaagagctaagtaatttatcttgcaccttacaaggtgagtcagacttaaatagtccaagcaaattatcagtaaacactgagagagaattggctctggtagaagagagattgcaggaagtgcatgtgtagtgcttggattcaaagactgattggagtttagttattttgtcttctactcactctcccacagggattattatgcagaaggaaaattatatattagaatggatattttagcatataaacagagaaaaatttaaaacctacatggaaaaagtttctgatttgattgtgaaaggaagactaaaagtttgtcaattattagtaacagacccagtacggattaaattaccatatactaatgctaaaattacctcattatgagtaatcaatgaagattgataaagagcttgcagtaattttggggggagatagtaacaacaaagactccaacagcaagcaacctcagtttataaaaagaattaactggattcttccttgtacaattagaggaacaccaatttctgaagctcctacctcttttaggatttttttctagtagctacccagagagaactgcttggagagggaacacagttttttaagatttttttctagcagcttttctgacttttgtcagaaatctcatgagctatccagagagcttttagaatgttttctagcatgaaagagctgtctctagcaggtagctgtcttgaacaaagagctgtctcaagcagaatacagagccaagacctatccacagagagctgtctagggagctatctccaacagactacaaggctgtcaacttgcaccctatcatttagagtcatttcttagccatttctaaacaccccttcctcagaacccctcttcaagcagaggctggtccttggcagagatttatattacagtttggactgataaagttaacagatgcctttcatctgctcaatcatagagcagagaatcatcattagatgatttgtgcacacggaacatttcatacatgtgttaatacaaaaaaattcccacaatgttacctttaaaagtttgtgtgtttacagaacaaaaccagacaccagtgaagacaaagaaattagcccctggtgatccagcctcaaagacagcatcagttattctttcttcaaatttgcatccaggatagcttcaaagtggccagtctcagatggcccagcgtcacagactacttcagccagaacttcagttaagccttgcactgttctagccctagataatctcatagagtctggacagcatgaaaacacagggaataaatattctcacagctgcaaaatcaaaggaagggaaaacgtatgtttccaccaccaataacaataaaatgataggaatctacaatcattggctaatcatagctctcattattgatggtctcaacaagtaaaaagactaatagaatggatgtgaaaaaaggacccatccttctgctgcatccatgaaatacatctcaagatcaaggataaatattgccttggggtaaaaggttggagaagaatattcctagcaaatagacctaagaaagaagctgaagtatgcattttaatatctaacaaaagagacttcgaaccagaactaatcaaaagagatagggaaggacactacatactcatcaatggaaaaatctaccaagatggctttccaactcttaacatctatgccacatacacaagggcacctaagtttgtaaaagaaacactatcacagggcaaataacatattaaccctcacatactgatagagggagtcttcaagacctcactcttgcttataggtcatccaggaaaaaaactaaacagaaatggtaaggtaacaccctttataaaccaaaagaacctaagagatatttatagaacatttcatccaaacacatactacacacacacacacacacacacacacatgcactcattcacaaataccagcttctttttagcacctcatggaactttcttcaaaattggcgatatacttagacaaaaaagcaagtctcaacagatatgagaaaattaaacaactccttgcatcctttcagaccacagtggattaaaagaggatatcaacaacaacaaaaaacattacaaactcatagaaactgaactgagataatacataaatgaagaaattacaaaattcctagagttcaaaaaaaatgaatacacaaaacacccaaatttatgtgacacggtgaaagtggtgctaagaggttttctaagagaaaagttcatagtagtaaatgctttcgtaaaaacaaaaaaacaaaacaaaaaacaagcaagcaaacaaaaaacaaaaagcaaaacaaaaaaaaaccctagagaaatctcaaactagcatcttaatagcacacctgaaagttctaggggggtgggggagaaagaggaaatcataccttaaagtagtagacaagaaaataaaacttagggtttaataacatggaaagagaacaatacaaagaatcaatgaagcaaagagttggtgctttaagaaaatcagtaagacagacaaaccccttttccaagtttagtgcaaggtagagagataatattcatattaacaaaatcagaaaagggggacataaaaatagatatggaggaaatacaaagaaccataagagcatactttaaaaacccgtactccatgacactggaaatctgatagaaatggatcatttctgctatagttgcacctttccaaagttaagtcaagataaggtaaacttttgaaatagacttataatccctagtgaaataaagcagtcatcaaaaatctcccaactaaaacaagtccagggctcaatggtttcaaagaagagttagtgccaatactcctcaagttattttttaaaaatggatagaaactctaagaaattccactaaaatcaggaacaagacaaggctgcccactctctccatatccgtttaatatagtacttgaggttttatctcgagaaataagtcaactgaaggagatcaaggagaaacaaattaggaagaagtcaaagtattatttttttgcagatgatatcatagtatacggaagtgactttaaatattccaccaggacttcctacagctgataaacacttttgacaaagtggctggatgcaaaactatctcaaaaaataaaataaaataaaataaaataaaataaaataaaataaaataaaataaaaatgtagtctcccctcccccagcctgaaacctgcttgctcaggggtagagcttcccgctcaatcgttctgccatgcccactgctggaacctgctgctttgctgttcggagccgtgcacgtggtcaccctgctattggactccaagattaattggcgggaatcgggcccccttcccctgctttataattgcgtgtggaacagtaaaattgagctttgatcagaatgactgtcttagctacatttctttctctcgccacccagcccctcttctcttccaggtttccaaaatgcctttccaggctagaacccatgttgtgatctgctggccggacacaacaataaaatagtaaccctcctatacataattgacaaatagcctgagaaacgatagacataaataatgtaaaatatcttggggtaattctcattcagcaagtgaaagacttgtgataaaaatttcaagtctctgaagaaagaaactgaagaagatattgatgaaaaaaactcccatgctcatgaatggctagaattaacatagtcttatatacatacatacatacacacacacatatatacatacatacatatatatatatatatgcgctactatcttagtatttttatgaaactcctgcctgtgagaacaaggggatctgactcttgggactcttttcctcctgttgggctgcaatgtccagttgtgatacggatgtgtttgattcatcttgttatattttattttgtcatgtttgcttgtcatgccttagaagctggaaagggagtggatccagaggacaagggagttggggtggaactaggaacagcagggggagagaggggggaaactataatcaaaatatattgtatgagaaaagaatctattttcaataaaatgaaattaaattttatagttacccaatactttgggggaaaagtgattaatctctgtaactacttaattatatatttgtgttttaaagattgcagctatggctacagcaaactagagttttaggttgcttgtggaaatttacaagactcagctttgacttttatttgtatagtgagtttcctactctaccttctttttcagtgtattcttttaaagatgtcctttgttgaattcattcatcttttcccctttgagttattagagatctttagaagattgtgggttcatttaaatgttttggaattcttagatctatactagaactgaatatattaaaacagtagtcccccacatcctcctttttactatgtatctggataattttataactggacagttcaggactcatagtcttcatgtgagggatgcattagatattgctaaaccttcatttatttttgtattgtggtgaaatgttgacaagtgtatggacctcgggtcctaattccaagctcagatcataatcccgggctcctcagcttcccaagtgctggaactgcagacgtgagccaccacacccggcttccagggtaaaccatattcgtctgctcggtaggtagaactttctgtctgaggaacttaaaactaaaccagaggtgactcagaagtcatttaaggagaattaagaaacatttcttcagtactactgaatatggcacattgctgtttggaaatttgtagaaatcacactgaataatagtatgattttgctctagaatttaataagtaataaagtaaaatctgctttcaagggacttcacgtgcttaaacatatcatcagtttcatcagtgatttatcttgagacaaaaaccagggctgttttaaaatgagactccttagtacatgtttatattacttgaagaaaaatgtagatttttttttttaaagtaagaatacctgtccaaagtttgaaaggcacagttctcattcactctgttgtgatcataaaaagagaaagagctagaagatatgttctgggggttgtgggggaaggggtgccacaacaggcccatgccaaggcatcccttccctgtgagggaccagacacacactggtatagcatagaacagagtttatttagggcatggggaggggagttaagaaggtagcagaggcagagaaaggcagagaggagagagtagagaagcagaggctggccatggccacatggggtggggagaataggagcaagggggcaagatgtaagagctctgcctgtgccatacctgcctggatactgccatgctcctgccttgatgataatggactgaacctctgaacctgtaagccagccccaagtaaatgtttggtttttttgtttttttgttttttaaagacttaccttagtcatagtgtctgttcacagcagtaaaaccctaactaagacaccttggttttggctaagttatttaattcagggtatccagtgttgttcatttcgtagttcagtggttaccatatcacaatccaggcagcatcctgtagctgcgaccacatcttctgagccctcgtggtcacagcttctgtcacaaccttattgttaacagatttctgacaagattgagccctatatagattggttataactgagtagaattcagtgacagtagtaaaaatcatattgagaaaggatagaaatgagaaccttaggtagcgttagcaaagaggcatatggctagaaccagcctaagagagctggcagcagtggcataaaatcctggtgacagaaaacgagtttgtcccagcaggtttaagcgtgtttcataaagtaagcatggaggcagcatggacaggtaagtgcttgggccttttctcatttaccagactgctagcagtatgtgtgaagatcccttaaaacatatgtttgaggacaatttagcatccattggatgacaggggatgagagggtcactgaacctttcgttccagcatcctgagtaaaggtcagtggcggtcagtaaagtcaaactagaaattcaggtcgtcaagtgaaaatctagaggccacggccgcaggcaaaagtaattcaacctgataccaggaatttccagccagctgcatgagccaaaagggtttatgaattgcctttggtcctatgtcctaacttgtaggtaagccaggaggccggtcttaagaaccggggcagaagaggctggccaggcactatttgggcatctaggatccctcttgccaaccggaaaactctttaccaatcaatatgccggtgtgtgtttgtgggcttctgcagtctggtagcagaaaatgtggaactgagtggttggtttgggcccctctgactgtgcctgtaacccacatggcagaggctggggactgggtcttgagtcggggagaaagcagccggcctgcagtggctgaagcagaggggccgcaggtcatgcagccctgggtggctgcgccactgctggggcccaatgtgggcaggggagagtaagggcccaaagtatcctagcaatacacttgtggcacatccacccaagtctcaggcagagaagcagagagagagaaagaggcgggaaggcagcattttggagccagatccacccctctcacatggagaatagagccaaggagagaggggagggcagcaagcaggatctgtggcaggggcggagccaaacttgcttttcaggcaaagcagctggaacagcaggctgcagatgagaggaggttaggggaaagtctaagctatagcagactgacccaagggcgagacatgtggggggttcccagacctggcctggaattctcagcctcaagaaaaaggagagggaaatctcacccaagggaaaggatcttcaaaagaggggtagttctgagctcaagaaatcttttctggggccatgtagatagtcatgctgaccagtgggaatggggggtttaccagatctgggctagcgaacgagcgtggatctcttgcggtagctggggtgggatgcaaacctgcagagtttctagatccgagtcgcgatgcaaaaagagaaagagctattaaggtatgttctggcggggtgtgggtgaaggagacacctcagcgggcccatgccatggcatcctccccccccccccccccccagagaccacacacaggcatagcatagaacggagtttatttagggcatggggaggggagttaaaagggtagcagagacagagagaaggagagaggagagaagcagaggccagccatggctacatggggggtgagggtggggaatgggagcaagggggcaagacctaagagagaggcaagagagtaggagggtaagagagaggaggggtcaagcaatcccttttatactgggccaagcctatctagctgttgccaggtaactgtgaggaggagcatacctggctgctggcaggaactgtgggggtggagtttagacagaattccaacacactccacctactcaaagcagaaatctctactatattaaactcagtaatcagttactagctgaaatcatacctggtctaagcactgaaaataaatgactattgtatgctcagccataaaagggacaccatctcctccaaggctcaaggaacctcacaaaagaaaggtgtcaaactcatgggacaagagcaagatcactacaacaaagtttgaggcaaatttggagcaagttttattaagtactggccaggacgtggacactggtacaaggtccacacccaggataaccagagaatggcaccaaattacattaggtggagccttatgaaggccaacccagcttctcctcaacagaagtctgacaagaccctcttgggtttcttcaggtaacactgcctttatttagattcatggctctagccaggctctgccgctgctgacagagcaaagtgtcgtggcagaaattccagtagagaaattgaagcagaaggatggtaaattcaaggtcagatcggaggatgggggttaaagagtatccatgattatacatagagtttgaggtcagtcagcgttgcacgagagcttgtctcaaacccaaaaaaggaggaagaaaggaaagaaaaaaaaaggctggagaaatacctacagatcagtgtagttaagagttaattgtgctcactgatctcgcaaaagactaaaatcatttccagtgcctgcactgggtgcctcacaactgcctgtaactgcagctcccggggctccatttaccatctcttaggatctagttggacacctcatcctctccgggtgggggaaggaaagagaagagtaagaggggagaagagaaggaggaagagaaggtggaggaggacgaggaggagggtgttaaaatgtttggtgagtgaagacccagatcaagtactctttacgttttgttttattttcaaagcaataagagtaggaaaggtactcttagaggtgagggaggttttggtacttttaccaactggggttaaatacagccactaatgcctactgtggtcctacaggagtggggaggttctaccgagcaaatgaatgtggtttaccttgaaagccgggtgtggtggctcacgtctgcagttctagcacttgggagactgaggaacacgagatacctagttaagtcccagacttgcagcttgatacccctgtcctgactctaacccaactaaattaaaccatcccaaccacccttaaaagtaaggtttttacaatactgttttgtgaggaagagaaaaatgctgctaccacggcagccgatgtctcaggatcctttatttctctgttcttccacaactgtcacactgacaaccgggaacaccaacgactgcgttctgtccatccaagaagaaaaccggcaaactcgttccgagttcaggcgctccctgtgtgtctgcgcacgctcaggagcaactcaggtcctgccaggttgggccgcgctcggagggcggagcgcttgccacgtggtcttggtgacgtcatctccgggcgccgagggtgactggacctacggtgggcgcccggcgctgcggttcactctggttccgagggcggaagtgcccgccgggctgttttctgacccgggcggcagcactgtgcggctgcgcgcgcactgggacttctgctcctgcgcctctgcaggacagtgtgatcccggcagacagaacccgaccgagcggctttcgcgctgcgggaagccggagcagagccggcacctcgggtagggctcatgtgtgtcccgggcgtggaagtgtggggcgggagtgggaccgggcaggggcaggggctgcgggcgagcggccggtgtaaagagcgcacccggagggatggcgggggaggcggtgcctctgggcggaggtggggttggcgagacaccggcccgggagcccttgggcagtctagctgtccctttgggtagttagtatgtcagttccttactaaggtaggaaatgtagcatcgagtctggagctcaagttaaggacttgcattttatttaaatcgtaattgtttcggtgctttttgattctatctaaacgcagactgtttctcttcgatgcggttctttgagtctcagtttaattttagtacttaatactaacaaatgcatttttctgttagtagaacactttcgtttatttagttactttgttgaaattgctctcaaagaatataaacttgaggaacctaagaatctgggtggcatgtaggtttttctcccaaagcatgtagcattgttttcactgagaaagcatagcaagtcttcactagtcagaaccccaggagcagttgactatctaaagccttctagaattcacctgataagtatcttgggtccttgataccgagtatttgagtcagatgcaaatattctgacttcattaaaattattgtttgaattgaaatttgagaacaagaacattggctttatggtagttgtcttggcaggtgagaatgttacactaagtttaattgtactttgagcccagttttgtggcctgtacctttaattccagcagtggaggtggggtgaaggcaggaaaatcaggagtttaaggccagccttggctatttagtgagtttgctgcaatcctagagggcatggtactctttgcaacacacagacaacatcctccaaagcccaaaaacaacctagcattttttggccctgcattggatcttgagcagcacaaaaccaaactataacccgaaaacaaaacaaaccccaactgtgattgcccacgtttctaatccttgtgctagagaagctgaggaaggaaggttgctttgggttggaggccagcctgtactacagagcaagactcttgtctccgaaaagaacacacaaacacacacacacagctttaatcccggtctgcatagtgagttttagactaatcagagtgacacagtgagcacctgtcccaaggggaaaaaagtattttccaggtgatagaaagttctagaaaaaggataagccaatgaaatggaatgggtaggggtggtggtgtgcatgggagatctagtgctgttcacagaaaaggtatgtgagtgaggctaagctacatggaaaggccattggagcatactagccaattccaggggcaaataggagtgcttagagatgagacaaggtcattgtgggactttgtaaagacttattttttttttccattttaatcataaagtgaccaggttttgcctgcatatccatatgcccatcatatttatgcctagtgcccatcaaggagtctgctagaactagaggtactgaaggatgtgaaccaccatgtgggactgagagtcaaacccatgtgctctgcaagtgcagccggaattctttactgctgaaccatctattttttacttttactttttttttttttttgagacagggtctcattctgtggccttgtatcaggctggacttgaactcatagctatctgcttgcctctgccttctgagggctgggattaaaagttcagattccttccttccacccttccttttctttcctccccaactcactccttcgtctctttgtctctctgtctctgtacaggatttctttgtgtattcctgactgttctggaacttgctctatagaccaggctggcattgaactcagagatccacttgcctctgcctcccagagctgagattaaaagcctataccaccaccacctggctctacttttaactgtctcttttactgttttttttcaaattggtttctcgaaacaaggtttctcagtgtaacagccctggatgtcatggaccttgccttgttgaccaggctagccttgaactcacagagattgtcccaagcaagaaggtagatacacatagtatacaaaagttatattttattacatagtatacaaaagttatattttattacatagtatacaaaagttatattttattacgctgagggtcattacacaaggttcacatttaaattcctaactatggtcctaagcctatcttcaccaaagctgctcacctgttccacctatcttagctgaaagtcaggtccagtctctaacagaagtttctgattgaacagtcagcatccttggggagactctacagccaccaaacagatcacagtggcatctctccagaattacagagcagagcattgctcttggtctctgcttatataccatcttatgggcatcctggggttctaggactgtgtctggttatcttgagtaagagatgtaactgagttcttggtgtaatgtctaaaaggctttttttcctctctctctctctctctctccctccctccctccctccctccctccctccctttcttcctttcttccttccttccttccttccttccttccttccttccttccttccttccttttttcctgtgctcattacagggatctacttgtctctgcctcccaggtgcctggcttctaatttttatttttaatgagataagtttgagtcaggagcaaattgagctaagctgagttttacactgattgccgtgttggctgcagaagtggtcagagtggcttgagtctggtgtggttgctgctaaactggagtagtcaggtatggaagaatggttagggatgattgtaagatgtatgggcagaacaacagactaatggggtttctgcttctatagtggaggaggatgtggcagtgggagagaggaagacctgaggtcagcatcagttgtgcaggtgttaaacttccaaatgacaggtccattgtgcaggaaaacacttgtcagacaagtcaggagtccaagctgaaggtgaaaatggaagttggagcaagtatatttggtatttaaagttgtttgaaagatgccctgtggccatgtttcctttaggtgggagggaggcacacaaaatacagagggaacgtaaaatcctcttctctttctccctaccccagagtggaaccagtcagtaaatccccttgctaagattgactgaagcaatagatttaagaggaactagaaatagggtcatgagacaaacagaaagaaagggaaggagatttggaaactttatgggaaggtttgggtaagtgacacaggaaagtgggggaatgggtggactggaggaatgtagaggtactagacattaccaaagacccatatttgaagctatttgcaaatttaaggagagactaggcactgtgcatttctggacagcttcccatataccttgggaaggttgccagcctactatgttttgggcccggtactcaagttggtttgcctcagttgctaaattgccttctgtttaatctctttacctccaggcttgccctccatgcacagctctgggagccttgtcccgtttcatctctctcaaacctcataggttctctagggcggctcgagttgatatccttactgctttgtccatgagcttccacaggtttgacagtaagggaattgcttgcatttcctagcatttgcagcatgtctcttactgtgcattccttgtaggttttccccactggaacaaccttgtgatttgagaagtaatttaattctgtaggaaaggagattggggcttagtgaagtgtctgggcaggggtcacacatgacactgaagcctttacagcattaactctcgactaatattcccaggcaaaagttacaaacatgttgatgcgtgttgcttctgtgtgctcacctttggatatatacagtcctgaatgtggctcatcactggtgttttcagctttatggttgtcactttgtgatacaataccaggcacagttaggaactacttgggttttttgagtctttttaaaaatagggtcttgccatgtagcccaggctgttgtcttactcatttgtgtggtatctttagtattatcctactgctgcgataaaaagcaacttggggagaacagggtttatttccgctctgtgccctgaaatcacagtccatcttgaagggaagtcagggcaggaacctggggtcaggaaccttggaggagaggctgtggaggaatggtcctttcctgcttactccattgcatgctcagcaatactaggcaggcacatctgggcagatgtggcactgcctgcccttgggggaatgggcccttccacgtcaattgttaatcaagaaaatgccctatagacttgcctaaaggccagtcgtaccgagacattttctaaattaagagttcttctccaatatgcctaactttgtgcaagttgacaaaaaaaaaaaaacaacaaaaaaaacaggcatagtagccagggatgacccaatactagtgatctttctgtcccaacttccaaagaactggaattaactgtatatcattatttctggcaaataaagtgatttgccctcccctctcaccctttctcttcagtgctgggagttgaacttggggcttcatatatgctagataagcgctctatcgctgagctgaactctatacttggattttggagtgctaccttcaagcctgatagacagatatgttaagattctctttgttgtgtctggcagctgcagtaggctgtgcaagttcacaaggataaaaagcctgctctacatttaccgtgttgctcagctgtgatatgagaaggttagacattaaatacacttttaacttaacgttattttccttttgggtttttgagatgggatctcacgtagcccaggctggccttgagcttggtagatagccaaagccagctgtgacttcttagtcctcctctacttcctgagcaatggggttatgggtattcagcaccacaccttattccatttatatttttaatttaaattcttttctgagggcacataatactcactgtaagttggagagtgtgactttttctttgaccattcgttgccatccgttaggtaccaagtgtatttattgttttatttacttatttattgtgtggttgtgtagtgtgtgtgtttgcatacatgtgagtgtgtaggggttagaggtagctctaggggttgttgacgtgctctccccgaggttcctctatcctgatgctgccactcctgactgggcatccccaaagttactattttagaattctttgaaccctacagatccagtagtatataactcctctcctccttatagaagcttctgtagagccagaggaagtagacttgttggacaggacagaacctttacatatgatcttaccgtttgcagtgaccacatgggcaagacctatacagagcaagccagcccacatccaggatgggaggggaggggctcatgcagttcctggagctgagcagctgtggctgctgggagagggagagtcagcttatgcctcagtaggttgccctgttcaggtgaactctgaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtgagtttgagttgtttccccccacccccaccctctctgggctacaaaaatcctatttcaacacccccttcccacatgtgatcatctgattttcttttcatctcattcttacacagaatttgtcaggttcatgtactctttctaaagaaacttaaaagatgcagataatgtatttgtgtacctgctatgatccagatagtgttccaggtgtcagaaggaaaatggtatgtgacatatagtcctttccccacggaagtgcattcctctctcctggaggtgtcaggtgtacagataaacacctttaagcaagcttgtcagttgtgtagaagaggagaaatggtgcatccatgaaggacagggatgcgctgccccattcctgcatagaagaaaggcttttagagacgagccctgaatgatgtgccaagtcggaatgtaaagcagagaggggcacaccagcacatgcacagggtggaagggacacatctagacatggggattagcctttctactatgtcctgctaatgactgaggatggttggttggttggttggttggtttttgagatagggtttttctgtgtagccctgggtgtcctggaattcatgctatagtccaggctggcttcaaacagagatccatcagcctctggctccctagtgctgagattaaaggtgtgcaccactgctgccccagcgtgtctaaggttttctgtattcatctagtatataccacctaccttggcctatcaaaggattaggatttattgactaaatttaatgttttctttaaaacattttattatctttatttaagtgtatgtgtgtatgagtactggtgcccaagtgcagagagagcgggtcccctggggctggagttagaggtagttgttggtgctgagaactgaactctagcagagcataatgcttaactgctctcaactgctgagccatctctttagcttggctatattgaatattttagcagtgtgtttgatccatagtttttagaatttactttctgtattggctgggtctgtgtcaacgtgtcacaaagtagtcatcatcgaggaaggagcctcagttaaagaaaggcttccatgagatccagctgtaagacattttctgaattagtgacctgttggggaagagagcagcctatcattgctggtgccatccctggactggtggtcctggattctataggaaaataggctgagcaggccactcactgaacgtgccggtaagcagcacacccccatgacttatgcgtaagctcctgcctctaggttcctgccatgtttgagttcctgccctgacttcctttgatgatgaactgtgatgtggaagtgtaagctgaataaaccttttcctcctcaaattgctttttgatcatggtgttttgtctcagcagtagaaaccctaactaatacactttcctttattgttaaaattatttgcctttatgtttttaattattcttagttcctagagcattttgcgtgtgtgttggagtttgaacccagaacctcatgaagactaatcagttgttctgccactcagccacatccctagtcccttctgcccctccccacttgcttttgaggtatagtttgttgatgtagcccaggtgggcggggaccttgtctcctccctgtttcctaggtcctgaaattacagtttcatgcgttataaatgaattgctttgttcatggctaatgtggtagtgctgtttttcattttgcacgtgaggaaacagacatgttaactaagggtcagtagaaaatggcatcacctattttgcttatacatttaaagtagatttattagaccagagacacaaaattcttataggtgaacttttctctttctaatgattaataataaataatacataaaagaatgtatatctctgcatgtgggtatgtgcacctgtgttctggtgtcagtggagatctcttggagttagaattgcagataatagtgatctgcctggtcatgtgctgggattgaacttaggtcctctggaagagtgacagtgctcttaaccactgagccatcttacagccccaagatgaacagttactaatattgactgcataatttgaagtaataagtagccttgcttacattccactaatctcttaggcagtttggtttacacaatgtatgtcaacaataccatgttctgtttagctgatctgccttggttcagtcggcttctttccctgaagtccaaatatatcagtggccaacaatggggggcttcaaggagattgagagttggagttctgtctgcgccacagtttgagactctgtctcaaaaactaaaagcaaaaagaaagaattgcaaataagatgtaagcctctagtttatttcttggtgtatgtcgctactatagaatgttcataaacatggctgaattacaagatgttaaagtccatgcctccctgggtatggtggtgcctgcccagaagaactctctgaattcaaagccagcctgatctaaagtgagtttcaacatagccagggctacataatgagaccttccctttaaaaaacaagcaaacagacaaacaaaacaaaacaaaaagccctgcctataattgagttttgaggtatttttcatttctcaaagtctatccttgtatcttctttgaggagggactcaaaaattagaggagagaatgttggcttctctttgctctgatataggaaggagaagaagaacagaatagaataacagggaaagaccaacatggtcaactgccctaagcatcagataggaaaagaagtcatccaggcacggtgttttggtttatggtgatcatctatctagaatagtgttttggactcctaccaattgggtctttacttcttgggaagggaaagagctttcccaacgtggccttgggcctttttaggtttcatttattgtcagttattttcagtgatggtgaatttaaggagagaccattccatgtgccatgaattactatttatgtctcatgacttgaccataaatgtgttaaaggaactctgacaactttctctatttctttttattagatattttctttatttacatttcaaatgttattccctttcctggtttcccctctgaaaacctcgtccccctatcccatcccccctcccctctgctcaccaatccacccactcccgcttgcctggccctagcattaccccatactggggcatagagccttcacaggaccaagggcctctccttccattgatgaccgactaggccatcctctgctacaaatgtagctggagccatgagtcccacgatgtgtactctttggttggtggtttagtccctgggagctctgggggtactggttaattcatattgttgttcctcctatggggctgctaaccccttcaactccttgggtcctttctctagctccctcattggagaccctgtgctcagtccaatggatagctatgagcatccacttctgtatttgtcaggcactggcagagcctctcaggagacagctatgtcaggctcctgtcaggaagtacttgttggcccagtgtctgggtttggtgactgtatatgggatggatccccaggtggggcagtctcttgatggtcattccctcagtctctgctccacactttgtaactccttccataggtattttgttcccccttctaagaaggatcgaagtatccacactttggtagtccttcttgagtttcatgtggtttctgaattgtatcttgggtattccaagcttctgggctaatattcacttatcagtgagtgtatatcatgtgtgttcttttgtgattgggttacctcactcaggatgatagcctccaggtccatccctttgcctaagaatttcataaattcattgtttttaatagctgagtagtactccgttgtgtaaatgtaccacattttctgtatccattcctctgttgagggatatctgtgttttttccagcttctggctattataaataaggatgatatgaatatagtggagcatgtgtccttattatatgttggagcatcttctgggtatgtgcccaggagtggtattgctgggtcctcaggtagtgctatgtccaattttatgagaaactaccaaactcatttctagagtggttgtaccagtttgcaatctcaccagcaatggaggagtgttcctctttctccacatccttgccagcatctgctgtcacctgagttttttatcttagccattctgactggtgtgaggtggaacctcagggttattttgatttgcatatgatcatctcaatagatgctgagaaagcttttgacaaaatccaacacccctttatgataaaagtcttggaaatatcagatgttcaaggcccatacctaaacatattaaaaaacaatatacagcaaaccagtagccaacatcaaactaaatggagaaaaacttgaagcaatcccactaaaatcagggactagacaaggcagcccactctctacctatttaatatagtacttaaagccctagccagagcaaatagacaacaaaaggagatcaaagggatacaaattggaaaggaagaagtcaaaatatcactatttgcagatgatatgctagtatacttacgtgaccccaaaaattccaccagacaactcttaaacctgacaaacaatttcagcaaagtagctggatataaaattaactcaaacaaatcctctacacaaaggataaacaggctgagaaagaaatagggaaacaacgccattcacaatagtcacaaataatataaaatgcattggtgtgactctaagcaagtgaaagatctgtatgataagaacttcaagtctctgaagaaagaaatggaagatggaaagatctcccatgctcatggattggcaggattaatatagtgaaaaatgtacatcttgcagaaagcaatctacagattcaatgcaatccccatcaaaattccaactcaattcttcactgagttagagcaatttgcaactttatctggaataacaaaaaacctaggataacaaaaactattctcaacaataaaagaacttctgatggaatcaccatccctgaccttaagctgtactactgaacatttgtgataaaaactgtattggtacagtgacagacagtggaatagaattgaagacccagaaatgaatccacacacctatagttacttgatcttgacaaaggagctaaaaaccatccactggaaaaaagacagcatttttaacaaatagtgctggctcaactggaggttagcatacagaagaatgcaaattgattccattcttaactccttgtacaaagctcaagtaagtccaagtggatcaaggacctccacataaaaccagatgcactgaaagttatagagaaagtggggaagagccttgaacatatgggcacaggggtaaaattcctaaacagaacaccaatggcttgtgctgtaagatcaagaatcaacaaatggaacctcataaaattgcaaagcttctgtaaggcaaagggcactgtcaataggacaaaaaggcaaccaacagattaggaaaagatctttaccaatcctacatctgatagagggctaatatccaacatatacaaagaactcaacaagttagactccagagaaccaaataaccctatttttaaaatggggtacgagctaaacaaagaattttcaactgaggaataccgaatggctgagaagcatctaagaaaatgttcaacatcctgactactttcttgagtaagagttggagctgctaattactgcttactactctacataggccatcaggtctgctaggcaagcactctactgctgagctctgtctataaagctctttttctttttgcaacagggtttcactgtttcccatgctggccttgacttgactctgtagcccaggccttgaacttaatgatccttctgcctcagcctgtttggtagctataattacagagcttgaggtccttgatagtgacttaaacatttaaattgcaaatcaaatggtcgaatactttcttagtatgtctaaggcactggttttgacccaatgctaccaaaagtaaacaaaacaagaaaaaactttacaactgaattgagttttcttcaaatgtgttagttaaggaagtttttagttgtcttctcttgagcaagagtcatagttgactggatggttcaaggttcccaaaactactataaatcattcgatttcagatgtgcatattagtgtgccttaggtttctattgttctgataaaacatactgagcccttacctcaaaatcaggaaatatccataagctgattattttttccaattaaagaacatttaaattttattttaaactttattatatttttaaaaagttgaagaaaaaaaaacacccaaagactatgcaattcaatgagcttctatatattttatagagaaacaggagctgtggatcttcacattgcaagttatgtatttccttccttccttatttacttatttttgtttgtttgtttgtttttgttttgttttgtttttgaaacagagtttcttgatgtagtcctggctgtcatggaactcactctgtagatcaggctggcctccttctcacagagatctgactgcctctgcctcccaagtgctgggattaaaagtgttcactaccaccacccatccacattggattttatatttccactgttttatgcacttacccactaccaaaaccactaccaccaataaaaaaaaccacgatagagtcagaactcggaaacagcttgtatttactacttgcattcattccttcttcatttcctaatgttagcttttcttgctctctttcatatgttactgtacctacgaatatatgtattcacacacgcagatgcattcatgttagattctgcatgtaaggaagaaatgtggtttttcttcttctaagattgtgtgaccttgcttaataatatatattctaagtccatccatcttcctgcaaaatttgtgatttcatttttctttagagctgaacagtattccatatatatatatatatattatatatgtatacatatataattttatatatacaccaattttccttgtccatttgtctgttgatgggattgaggttgatttcagttcctttctctcgtgaataaagcaataataaagatgagggtgaaaacacttctatgctagggtatactcagaactgaaataggagatcacatgataattctattcaaaagttttttgagaaatcgtcaaactgagtttcatgacagctgcagtgttttgtggcccactaatcgtggttgaggttcctttccctgcacatcctctccaacatttgttgtcacgtttattgatgaccgatagccattggtgagacgctctgagagtagttttagtctgcattccctggagagatggctcagtggtgaagagcactggctgctgttccagaggtcctgagttcagttcccagcaaccacatggtgactcacaaccatctgaaatgggatctgatgctctcttctggtgtgtctgaagatagctacagtgtacttaaattcattaaataaataaatctgaaaaaaaaaaacccacattgttttttttaaagttattggccattgtgtttctttttttttttttaacagtgaatattcaagtttatttacccacttgctaattggcagtgttatttctttggtgtttcatttctgcagttctttgtaagtttggatattgactgagtgtagctggtagcccccattctgtgggctgtctgtggctacagcgttctttgctgtacagacttctcacttccctgtggccccacctgctgatacttgaggttggctcctgtgttgttatgttctgttcagaaagttcttcctatcccagtagtttaaaaggtgttttctttcaagttgtagtgtttcaagttttaaattaaggtccttagtctgttttgtattgatttttatacaaggtgaaaggtaagactaatttcattctgctgcaggtacagccaggagggccagcactgtttgctggagaggctgtccgttttccagtatgtttttgcctactttgtcaaaaattcagtggatacatagctttgtcattttatttctggatcttcttttctattgctcttcctgtgtgtttttattcctgcaccaggctgtctttatgactataccctgtagtataacttgagattcctatgtgtgggtggggtatgtttgtgcttgtgtgcacatctgccatgcagccacgtggagatcaggacagccagtttttctcttcccatcatgtagctctcagtagtctaagtcaagtcattagactgcgcagcaagtgcctttccccaccaagacatctctccagcccataaccacataaatttattcattttacttattttaaatttatcttactttgatttttaatgtgtatttgtttcagtgtgtatctgtgtgaatttatgatatgtttgtgggtgcccaaagaagccagaactgggaattggatattctggaactggaattacaggtgcttctgcggaatcctagctgggtgctagagagacctcaggccttctgaagctcagcgggcattctgaactgctgatccatctctccagcctggacatttattctaaagatcagctgctaacctagtcaggaagtaatgagggcttcctgttttcagcaagttaatttgagtgatttgtacattcagaaatttttcttttgagtgtagaatttaagcatgcttgaatttgaagtctcactgtggtactgaatgaaatttacatatgtatatcactagcttagaatacttgtatatatttaataaaagtcaaggcactgctaagtaccagggtccttattctaagttgactagtggccagtagtttgacataaggcaggtcttttcccacctaaggcagtttgcttatgtgtggatggccaacagctgactgatctttaactatggattaactgatgccaatcccaaagggtttgtcctgggtggggagaaaggataaaagcaagctccttgatgtacctcggtgttaataattgatgtcctgctggagagatggctcagccattggaatacttttggcttttgcaacaagttcagttcctagcatctgcatggtggctcagaaccttttgtaactccagttcagggggatctgacaccctgttctggatcttcagggcatcagaaatgcatgtgttgcccacacatacatgtagacaaaacattcataaacataaaataataactctaaaaagaattttaaattgatatccacctaggcccataattttggagggcaccatgcaattatttaggatttttcttatacattatactaaattatgaattaactgcccaacactgtcttggttgtatattgacccttaatactcaggtagaacctccttgggttgccctgtgcattatcagcagtgtgtgtttcatcatgtacacaggtgacatggagtatgagcatgatagcctgggctatcccagagctcatgcacattgtccttccctgatcctgagactttcctcatgtgcagagcgagctagcagcgctaccctgtggagtaaggactgttgtgagttggagaaatatttcactgggactgagggtgttagtcacttgacagtgtgagtaagagttggagagaagcagcgtgagttagtactaggctggggagtcagagcacagcgactggatgtttaggggtcggggcttactgaggtctataggacggagttgtaatcagtatgactggaagtattggtggggccaagttatgcatctgatgaaatttagaaaagggaataaacttaataaagagctttttgttgttgtttatttgtttgcttgcttgtttgtttggcaggggctcatgtcacccaggctcaacccatgaggcctataggcttgcaccaaccccagttcttgattggtatatgctatcatctgcaaatcgaagcaaatattctttttatttttttttcaggagaaatgataaacgtggtaggagaggctaaatacattagatggggcaagtgtaattatgtgaataatcatctgaaattagattaagatcataaggcacaggtacaaggctctcttttaggtgagtgataagagtctaccaggcttgaaaaagtaagaagtatgtggtgtgatttactttgtgcctggccctttaaaggatccccagttgctagtcacctggccctttaagagaactgcttgaccctatggcctttggtttgggttgcctctagaattctagggataggagaggatataaagagccagcagaggctgagagaggggagcccgagggtccaggtggcaggagagtagggtcagagaagacagttggtttaggaaaggactgagtagggctgaggagaaaagacagtcagtgtagaaaggaggctgagcagaagagaatgggaacctgttgagccagagaccatattattaggagacagtagagagactagcagagtgacaagagacagttggtgacagctgagccaggagaagccaagctgagcagatagggtagaacagctgctatagtttggagaggctactactggggaaaatgagagacgagactgtttaagcagactgttgggaaactgagggaggaatggctgaggaaacatttgaaggggctgagctggaaactgggaggggggctggcctgtagttaagagaactgattgcagtttgtaagaaagaaggcattaaaagaaacattaaaaaacacacacattttgcagaagtatagtttctattttgatgggacttatattgcttattacttgaatatgtaattggcatcacatacacatgcatgcacatatgcatgcatgtgtatacacacagactttttgagattgtgttttaccaaatagctcagtcttgctacatacagactcttgtctcggcttctctaatgtagaaattcctggcttttacctacctacctcccctcctccctggctgggagagagtaagaggtaggtaagtatggctggcctcatacttggagaaatcacctgcctctgcccctctgcccctctgcccctctgcccctgccaagtgctgggatttaaggtgtacatcagtgaggcctccccataccccactccaccttttctttaagtgaagttttttggtgttcattttttgcctatgaaatgttttcattaattcttggaaggatctgactaatgctatttattctgtttccagtttggctttggttgaaggaagaacttagcctatatgtactgcttcatccactggaagaatgacagatgacaaagatgtgcttcgagatgtgtggtttggacgaattccaacttgctttactctctatcaggatgagataactgaaagagaagcagaaccatactatgtaagtgtgcaaaggggacctataacttcgtccattatttacaataaaataaaagttttagaatgtggaggctgtcactttgcgatattttctccatccacccttccttcctatgtttctctttctttgtttctctttcttgtattctttgctcatatgatacatcctgacgcagactcccctctctccccctcctcctcgcccgtcccctcccctcgtccctcactttactgtgggcggttagaagactaggatggttacttggctggtcacgtgcttaccatgtaagtgtgacaacccaaattaagctccccaggacccacttgaaatgtgccatgtgtcatagtgtgggctctggggaggcagagacaggagggtgcctaggggctagctggtcacccagccctgccttcaaaccagtgagctccagatttagtggcgctcagtaacgtgaacagtggctggagagatggctcagtgcttagaacttggctgcacttgcagagaaccctgtttgagttctaaacacccgtgtggcacctcacagccatctgtgactttgtgctgcacatacatgcatgcaggcaagacactcacacacataaactctttaaaacaaataaggtgaagggtaatggaagaagacagctaacactgatctgtgtggctacatgtatgtacatgtgtgtgcatgtatgtgcacatgcacctgatgcaccgtaaatgaatcaatgcaaacaaaagagggcttgagaggcagctaaacagagaagtacacatactgctcttggagaggacccagggtcccaggatccattttggcagcttacaacccccgtaagctctagttctgctcttcaaaagtacctgtacatacacataattaaataacagcaattctctaagataaataaatcccctctaatcatgctacccacagttcaaacacacatgtcactttagacatactgatatgcgttcttttttgtgtgcgtgtagtcatctatcttagagagtggagtcaggctatctctacaacagagcacagacttagaatgtcagtacctaccacacagcacacctgtagtggaatcataagcaatgtgctgtgttttaataggaagctaggtttttttaagttttatttactttatgtatatgggtattttccttcatttaaggatgccacatgattgttgtacctgagcaagtgagaagaaggagccagatcctctggaactggacttgtacacaattgtgattggtcatgtgggtggtgggaactgaacccaggttctctgcaagagcagccagtgcttttaacccaacattggatttttacatatttagatgattccaagcaattagtcaaatatgtatattaatggacttacaaatatatatacagtaataaaatctcttcacatgacaatgttatttatgacctaatgttaaatatgacctaatgacctactatatgatcacaacatgttatgtctgacatgtttaatagaacattggggcatggagtatagtagggtggtagaatattttcttagcatttagaggagaggccctgggttcagttcccagcctccaaatatctaaatgaaaaaaaaaaaaaaatgtatgtttgtgtgtgtgtacaatcactgtggaatactggtatgcattcttttttgtttgtataaacacacacactggtcactcgaacaccacagagacgccacacacaccacaaacatatacatcacagacccacactgcaccatacacacctcagatacacgtatactacagaacacagaccacacacaccctcctacacacacagacacaccacgatcacacttaccagacacaaccacaccacacaaacccacatatatacacacacatctctctgtctctctgtctgtctctctctctctgtctctctgtcacacacacatgtgtcagtcaatggatcagtaaggtggatcctcagttcatttctagcatccatgtcagatggggcataatcacctgtaactccatctcccaggggtcctacaccctcttctggcctctaggatcctgcactcagatggcacacacaaccatatacacgtaaatacaaatataaagactggctgtgtggaggacgttagtatagattttgaatgtctaatcctcttgctttggcctctgtgctcagtactagaattctttttctaaatttatatttcattttattttgtgtgcctaagtatgcatatgtgcaccacttgtgtcagagaccttggaggtcaggaaaaggggtcctgtatcctgcacctggagttacagagagttgtcagccatcatgtgggagttgggaaggaaacacccgtcctctgtaagagcagtagagcactcttaaccatggagccctctctttactccttgaaaacaaaatattttaaaaagattcaaggccccatgtaacttcattagcctagagcacgctgtgtagcagagtcatgactccctgcagcgccctggtccctttcttcccaacccccacaccacaccctgctctcccttccttctgttcccctccctctttcctccttggaagaagtctcactgaaaagcctcaggctagctttgaacttaaaggcatcgtcctgcctctgcctcctgagtactggaactaaaggcatgggccaccacgcctgcctgaaaattcttagtttactatgctaatttcattctcttttggtatgataaatttccccgacaaaagcaacttagggaattatttttaaataagtaattcacggttatatatttaattttggttgcagttcatttttgctgcgaagttgaggcagcagaagttgaagcacctagtcacaccacatccagagtcaggaataaacagaaatgcatgcatgtgcactgctcactgcgcttctctgctcttagtccagaacctaaacccagggaatggtgtctcccacatcagttagcaccgtccaggtgacctccagctctgtagacagttccgcattgagactgtcctgccaagtgattctagatagtgccgaattggcaaagccaaccatcactcacacgtgtgttttacaccaatagattatatttctgaaagagggcaggtttgctatacccctgtgattttgtatatccttcagtgtaccctgtgtattggtgctttaatttcaaaagagtataatgtatctttgccatttattagctatattattaaaatattattactatgatattttaatatcagtaaacattaagttctgtgtaaaagaggtggtaatactcatgtgaatcatttaatatttacaataaatttgatagaactacttagtatctggattagtatgccatgcaattatgtattagataaaggggtagggaaaattatagatttgtgtcaattataaacatctgttaccctagctctacttagaagttataactcaattagaaacatttgcttttttaacctctagcttttagtttctataaaaagcagattattgggattaagtagtcaaaatattacaaagaacacaactgtttcccttactattaaaaggcttacttaatatctttgttttgaaacaataatgagtaaataaatatggcttttcaaattttcatttcagttgcttttgccaagagtcagctatttgacgttggtaactgacaaagtgaaaaagcactttcagaaggttatgagacaagaagatgttagtgagatatggtttgaatatgaaggcacacccctgaaatggtgagtttttcttctttgttaagcactaagtatatgctagctgtaagaaggtatagtgtcctaaaaccattgtgaaaagttctacaaagaaagaaggccaagcatggtacctgtaatcccagcattcaagaggctgaagcagaaaattgccagtttgtggctgccctggtcaatatatcatatcaaataccaggaaagctagcaccatacagcaggaccctctctcccaccgtcccccccgcaaaaaaaaaaaaaacaacacacacacacacacacacacacacacacagaaaagaagtgactagtctagcaagagttaaaccattatgcagtactttgtagacaatattctgccttgactagcatggccctggattcagactcttaacctgtcagaaaccaggccttatgcggcacacctgtgattccagcactcagagctagaggccagaggatcagaagtttgtcatctgtgggcacataatgagttcagcctaatctacatgagaccctgtccttgtcctcagctctacccactactttccactccttcactcccccacccccaacaaaaataatggaaagaaaaaaaaattctgccttcccaaacagtgccattagagatagggacccagtgttcaaatacctaatcttgggtgacatttgtcatttaaaccatcataaaaagggggagaaatctgccttctgtttggatgcattggtgattttatgatagattaatgtattttctttgttaaaaaaattgtttttaattatgtatatgcctgtgtgtgtgtgtgtgtgtgtgttggtatatgcaagtgagtccaggtgcccatggaggacatgaagcatcaataccccacaacaagagttactgttggctatgagccactctgcatggatgctgggcattgatctggggaatctctgaaagagctttgttttgttagtgtaggtgtgtgatgcccatataggtcagaagagagtcttggatcccatggaactagagttacaaatggttttgagccacaatttcagtgctgggaatcgaacctgggtcctctgcaagagcaacaagtgctttatactgctgagtcagccatctttccgatcccaagtatgtattcttaagtgctgagattatctctccagacccacaccctagctgctatgctattttttaaaattcttcaaaacccctcaatttgggtttacccatgtgcagataaggttttgatattctctgtttttgagagtcttatttattgtgcttccaacctgtttcaagtagagaagttacaaagggaaggctgtgggagaggtggaaatacactgggttcctgcattcatgtttccatttgcatccatttggttgcagaaaggtgttgactaggacgatttaaaaataaaatttgaaaaatacaaataggttaaggcactttctcccaatctggaaatattaaaatgaagaggctttgaaagaggctaagaaataaaggaaattacttaggtataaataatcttgtgtcgctgacaaggacaacttagaaggagttaacttctaggatctaggttatatttttaaggtcatgtctcctagataccacatcaataatgtttggaccaatttcttctttttacttcagtagagtgatttggcttatgttagcttcctacatcctttgagaaagcatcctgcctccacccatcactgggggttgaaccaggggtcttgggcattgtaggcaattctcttcctctgaactttattctcagctctcttgaaagtctttttccctcctagtcaggatctctgtatcccaggctgatgaatgctcactctgttatccaagcttgtgtcgatcactgtgtttctgactgtggcctctcagctgttgagataacaggtgtatgccagtgattgccttgacaagagcttcagctcatgacttgaactgctgtcaatctgctgaacagtttccccttaatctgttctctaatttcctagttgcttattttaatttgcccaaattataacagaaagctatttaagaaaagtagtagacagactgaatgtccaacaagttaaaggacaagcctagcataacggtcatgcttttaatcctaacactcagaaggcagaggcaggcagatctctgagttttagggcagcctggtttacatagtgagttccaggacagagctatatagagaggccctgtctcaaaaaagaaaaaccgttattggtgcatagataggttctaggtcatagtcctttgtaggttacaagtgctttgtctttgtcatggagcccagccccagccctcatgcatttgtgttgctaacttttaagttatctgagatacagaagtgttggtccatctgaaaactgtcctttttggaatgacctaactagacagcagagggtgctctaacactgcagtttaaggagtgaagtttcgtattactgaaacttaagtattcattacgtgtatttgatacttgcagactgtaattatcttaagagaacagttccatattctctgaaggctactttggcagtatatcatattaatgggtaaaatcagttgggtttgttgctcaataggagaatactggcctcacctatacaaggccctaggtttaattccctactgctgcagggaaagataatggggagaagaaagaaaatgaattatatcttcaacatttgagtaaaaaattaagaaagttcttttgttttggtaattgtaagataaatatatctctgctgtgatttttaaatattgtataaaccattttcagaatggggactgtagaagtaagaagttaatactgacttctgaattgaaaaacaaaccaaaaaatcctgctgaccttaaacgtaaataggatgcagtgactgagcagcacgtgtgacctccagtgcacactcacacaagatgtccagtgcacactcacatgcagctctcttgagaactcgggatgctcgtcacagtttgtaaataatgtggagattactcccttggctccatgttttgtcatttttagcttttccattcatttttgtaaggttgtgagtttggggaatttaaaaaaatattttgtaaaatgggccttttcagggtcagggtcagactcaggtcttgtaactaggcgagagtacatttaattacttgggttttttgttggtgttgcccttgatttactcagtaaaaaataacttgtgaatcttcaatgtggtgatttttctgggtaagaggcatttatatctatggcatgacttggggcagtcgtgtccagtgtatggaccatccatgcgtgcccacccatgccatttgagtgcttgtgcagttagaggacaacttttgggagtctgttctccagctcagtctaggattggtaggtagcattaaatatgcaggcttgtttgaccctccctccccccctccctccctctcttctttcattcctcccattcattcatccatccatccatccattcattattgaatgcagggttatacatagccctggttggtgtcaaactttctgtgttgctgaaattaagcattgaattctggatcctgcctccatttcttgaacgctgggattatagacaagttcagtcatgcctagagggttttgatgctttttgtaataactattctgaatctgtattaagagtctgtaactgtatatgatatacatacataatattatcacagaccagggggtttcctgctctttaggtgagtgtctgtagacttacaaatttataaattttgaaaacaaaaagcaagggctggagagatgacttactggttaagagcactgactgctcttctggaggacctaggtttaattctcagcatccccatggtggctcagaactgtctgtaactccaatcccaagagatctaatgtcctcttctggcctttgaggatactacatgcatgtagtccacagacatacttgaagataaaaacacctatacaatctaaaaataaaagttaatttaaaaaaagactggctttaggaactcatccttcaaggtaattggaccaggagttcaaggacagcctaaactatgggagatgccatctcagaaacggaacaaatcagtcactgtaaaagccagatgtggttatgcacatctgtaatcccagcatttaggaggtagaggtagaaggattgattgctgtgtgtttgaggccagtgtagttaagatagtagcaggccaaccagagctgcataatggagttgtctttctaatgtaacaagatatttttgtgtttaaataaacttacaaagaataggtccctcttataagtactgggatgataatttaaccctatagcagctgataagactcccttgagtacattgaaactgttcttggaaatggaaaagttagaaggaaacacctggcagctggatggagcgtgtgtactgaccaatcatgtggccgcacagttacttttctgtgatcagccagtaaagcctgtgacagtgcgtggtaagatgtgctggaaattggtttgggggtcatagttacaaatttatgcattttttctctctttaagatatacctttcgtttttaggcattatccaattggtttactatttgatcttcttgcatcaagttcagctcttccttggaacatcacagtacatttcaaggtatagtttaaatagccattcctgtttgttttatttgcggttcttaatagagtagaatttttttcaaataaattatttatttctcctttttatttgttcttaagcccatgctggccagaaacttactatgtggattaggttagcctcagactcaaagtgatcctcctgctgagccagacctttgtgctgggtttgcaggcaggtgtgtgctttctccctggatagtctgtcacttctgacttcccatggctgctctttctgccctaaaatagtctccactttcttccaagtttttgagaaaaccatttaatgcataaacatcttttcgtttttagagctgagtaatctatggtttagacttagaacaggttgttctatataacctatatataatacagttatatttaccaaacaatcaaattcccaggtgtagacatgggcatgagagcagagattggaataactgatacagttgagaagttccatagctacttggatagaagtttaaagattttgtgagcctctgttttgagatacaattccttgtagttttgagaccaggtaaacgcattgttgtgtaattgtgtcttactaattgaaaagtactggtcatggctgagcataggtgacactctgagtggctctggtgtccaggaggcagagatacaaaggttctgggttcaagctcagctaagacttgggctgcaaaagcaatttgagtccaaccttgactacataatgaatccatcttaggaagaaggagtaaaaatgaaaatgaaaaaaaaacctcaccctggtttcctccctctttccttgtgctccacccctcctgctcatggcaggcattgcaggagtctgaagtacatcttgaattatcattagtaagcagctctccagtggcagtgggcaatggagaggcatcaggagtgggaggacatcatcatgtcagggctgctcacgcaggcgctggcccacccttctcatggtgctcttcctccatactttaactcgctggccatatactatttccctggacatgttaaagtgctttgcaaagcagtgtgctactatattttagttatcccacagctgtacaggtggagccaccatcctaatagtgtgcatgagtttcactagccatggtgtatgtgcaatgggcagttcacggtggtgtgaaaataagactacttcaaacagagacagagcaccagtattgcctaacaagcctgtctcttagttttaggaataaagaataatcctagtagttggattaaattttaacagttaactgtcatttacttaacaatctgcggagttcatagccaccgcacttccagtgcatgcttccaggtggacctgggctgttgaggatttcagtgcagttgtttatatagcagccttgcaaaataggcctgagttttgtagcaagtgattggatctcattaaaacagacccatttcacttttctttttaatttttaaatttttatttgtgtgtgtgtgtgtatgtgtgtgtgtacgtgcaggtcagaagagggtgtgggccccttagaactgaagttgtaggagtttgtgagctgtctgctatagttgccaggatctgttctctggtctgacagagcagtaagtgctcgctcgcactcactgagcctccaggttggtttccgtcttatccagttgacctgggctactgaatgtgatataagcatttggctcacatgccatcgccttccacagccggcacatggttttctggtgttgatttcgtttggctgtttccttcccatccagtatgttcctacaagttttgtgttggctccatgagcacttcagtggcttctcccggcctcacaggcactgcagtgaggtccccacatgtctctgcagttcctaatataggagcctccgtcttcatctctatccccatctgcctgctcccatgggtttttcagctgctgaaagaaaagctttagtggtgtccctgggttgcttaatgtgtgtgtgtgtgtgtgtgtgtgtgtgtgtgtgtgtgtgtgtgtgtgtgtgagaatgttaaactgtaaggactagtgcagtaaatgctgagatcctgnnnnnnnnnnnnnnnnnnnnnnnnnnnnnnnnnnnnnnnnnnnnnnnnnnnnnnnnnnnnnnnnnnnnnnnnnnncacccactcccactttttggccctggcgttcccctgtactggggcatataaagtttgcaagtccaatgggcctctctttccagtgatggccgactaggccattttttgatacatatgcagctagagtctagagctctgggatactggttagttcataatgttgttccacctatagggttgcagatccctttagctccttgggtactttctctagctcctccattgggggtcctgtgatccatccaatagttgactgtgagcatccacttctgtgtttgctaggccccggcatagtctcacaagagagagctctatctgggccctttcagcaaaatcttgctagtgtgtgcaatggtgtcagcgtttggatgctgattatgggatgaatccccggatatggcagtctctagatggtccatcctttcatcacagctccaaactttgtctctgtaactccttctatgggtgttttgttcccaattctaagaggggcaaagtgtccacactttgatcttcgttcttcttgagtttcatgcgtttagcaaattgtatcttatatcttgggtatcctaagtttctgggctaatatccacttatcagtgagtacatattgtgtgagttcctttgtgattgggttacctcactcaggatgatgccctccaggtccatccatttgcctaggaattttataaattcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccggttgggacatcttctggatatatgcccaggagaggtattgcgggatcctccggtagtactatgtccaattttctgaggaactgccagactgatttccagagatgttgtacaagcttgcaatgccaccaacaatggaggagtgttcctctttctccacatccttgccagcatctgctgtcaccttaatttttcgatcttagccattctgactggtgtgaggtggaacctcagggttgttttaatttgcatttccctgatgattaaggatgttgaacattttttcaggtgcttctctgccatttggtattcctcaggtgagagttctttgttcagctctgagccccattttttaatggggttatttgattttctggagtccactgtcttgagttctgatagagcctgtttttaaaggttataactgacccgaatattgttaaagaaattaaaagtaaattggcagctcaatatcattaatggacatggttataaaagtcttcaataaaaattagcaaattgaagccagtagtacctaaaaaaagaacaatacacacattgcggagtttatctcatgaatataggattgattcaacacccaacagtcaatcagtgtaattcattgcattagcaaaataaagtagaaaagccacacaacaaaatcaatagcgaaaaagaaaggagtccagtgaccagtgccatgcaaagcctatgccagcttaggaataaaacacgacttactcagtgtgaccagcagcacagcaaaaatcttactaaataatgtggttttttttttaaatgtttttttagctgaagagatggctcatcagttaagagcactggctgctcttccagaggtccttagttcaattctcagcaaccacatggtggctcataaccatctataatagaatctaacactctcttctggtatgcatgaaaacagcatactcaaatacattaaataaataaatctaaaaaaaatattttaggctcattctatgaatgaatattttgcctaaacgaatgtgtgtgcttgctatctgtagaggccagaagaggtgtcctgtcttttggaactaaacttatagatggatatgagcagccatttggattctgggaacccagcctgggacctctgcaagagcagcaagtgcccttgaccactgagctgtctctccagacccctacatgatggatttgaatctagaagaagacagttatataagcagttctgctataatccagcatgttttccttagaacgaaacaaaaccaaaaaaaccactcctgcttaagattgtacagttaaaaaccacaggtcttttagggacagtccaaagcctttccacagcatagttttactcaggcaagtagctaagaggtatgcaaacactgcagtaaggaaggcattgcaaggcaaacgtttgctctggagagggcagcttgagcaggtcagctgtgaagctgtgggagggtcgcttggaaccagaagttgtgttggctggtgtttgtgagggtggttgctgacatgaggtatttctaacatggaggcttccgacagtctacgtttctgggtacagaatgcggtgtgcacccgctgtctctcgtggacagtatttgcataaggacacacagaagtcacattatgctcatcctcttacctcatgtgccagctgctttggaacaaatgcgaacgatttgtacagaaagttcacagaacctatgaattaccaataaatacatgaaaggtgcctatcatctttagtcatcagggaaatgtaaatgagaaccagagagagagagattactttacatgtcctaggatgactgagatggagaaggctgatgatacccctgacattgagcccagagctgggaaggtgctgatgagagcctagcactgccctctcactgcaagaaagtagttcagcagtgtttaacaccatcaagcaaacacctggatcagtgtggacagcattgctgtttgtagctgtatactgacaaagacggaaagatgtctaccaggacacttgcctattactgttcacagcagccttattaaccaagtcaaagttggaaataatcacgctagcaaagggatttcaagattaaacacagtagtcattcactgataccttagtaacagaaaggagtcggtttctggtgtgtgcagtcagtcacagtaaatctcagagcatgctaagtcagtggcactgtttcttacatgattacatttgtgagatgttattataggcaaaactggtacaatagattatgtcagtggttgctggagtagggaagagggcgcctgctacacaggacacgaggtaccttgtagtaaactttggtagagagtgagggaatagtagtagttgcagttaacttttgctgaggaatgagggatgtggttgcttatctgttgtaatgctatcttgtttggtttatagttcttcaaaattcatctaactaaaacttcctatgtttcattacatatgaatcatatctctataatttgacttatttaagaaaaatactgataagaaagatactgagaaatgaggtcattatctctggtttatagactataagagttcggatgcctgtggatatgttaacaagcgttatagttctggccagtattactacagagtccagtatagggacagtataaaattctgccttgacgtggtgggtgaaagggaaagtgtcccggatgtcgtccatagaagctgaacctgagctgaagattttttggccagatgtataagtagatagacaaggggaaagaaatgttcagatagttggtgtgaagacagagatgagagggtgttgctggaagaacaagtgtttggagcagggtgtgtgtgagtgtgtgtgtgtgtgtgtgtaatagggtgaggagtttagggcaggttagcagactcaggtaatttagaatcttgatggctttgattatatgctaaaaggtcttaatttttggaaggtcactataactctcagttcaaaaccattaagggtataagattgtagacatgtgcccttgatagcttaaactctgatatgttgcagcctagagccaacagtgagggggttgcagttgaaggattgcccagatcagaatgagctgtgcacaagtatgttggggattaccttgattgttagctgacatcgagggtccaccccaccccgtggatagcaccataacctgggcgggaggtactggactgtattagaaagcaggctgaggatgagagtcctgcttagagagctagcgcacagccaaaaggcttctgtgaatttgtggtgatagatcataagaggtgtagccaaagagaagttgagtttggagttggtgtttggctttaggtaggtattttcagtgggaagaatgtatgtatgtatgtggaatgctactaagagggggaaatgagcaaagctactccatgggagaatctaaagattggacagataggacctaggaaacatgatgagaaaaaatatcctatagattgtagcaaggagtgatgatagcttgtaggtagaattagaatcttacaaaaaagaatgagaaacttaacttggtatatggtgtgcttattttagccttggctcatttacctgtttccctttctctctctctctctctctctctctctctctctctctctctcagtgactttgaattcatgctcctcgaatgttgaaattacaggcatgtgtcaccatgtctgacctttagcttctgtcagcctttgggttgtgggtgggaggcccagaaggagtgggttataagttcacataacccatgctggcctcggatttgcatccatcttaccgctacctcctgaagctggaagtataacaggcacggaattacttttcccaatatattctttcttttcttggaaaataatacatgagaagaaatacttgggggaaaaatgctctcccaacccgtttatgtacaccaaagtcattttgggaaacttttatttttttttatttttattaaagtaaatttataaactatgactttatatttttcattctgaaagctgtgtcttttactagaggtgatggtaatccaacaatgagagctcatggttaataatatatttgattcttttcatgtgacatgaaagtattgcttacacccatggaaggagttacagagacaaaatttggagctgtgacgaaaggatggaccatctagtgattgccatatccagggattcatcccataatcagcttccaaacgctgacaccattgcatacactagcaagattttgctgaaaggaccctgatattgctgtctcttgtgagactatgccggggcctagtaaacacagaagtggatgctcacagtcagctaatggatggatcacaggacccccaatggaggagctagagaaagtacccaaggagctgaagggatctgcaaccctacaggcggaacaacaatatgaactaaccagtaccccggagctcttgactctagctgcatatgtatcaaaagatggcctagctagccatcactggaaagagagacccattggacttgcaaactttatatgccccagtacaggggaacgccagggccaaaaagtgggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggaaatgtaaacgaggaaaatacctaataaaaaaagagagaaaaaaagtattgcttagctgctttaacaagtggtattgctaatagattgaatttttttcacttacttgtaagaagtgctttaatctaatgatattcatttactgataacccatctagatacattatagacagtcagtgaatattctaactaatgcaattataatctctagaaagaggacctaagaatgtagctcagtggtaggacacagagcgtcctggctttggcccttagaatgtggtagggattgtatgtgcaaagtaataaaaagatacctgcacacctcaagtgaatggcttcctaaagggagtcttcctgagtgtcctgtaaaagtgaaatgaaatttactttgccatgttttcaatttggaagataatgagagtaagcacggtgttactctgtctgtaagaggttgtttgagtcaggaagataaggatgtgtacacaatggctagtgcactttaggagagatagaaatgtaatggatcaaggatctgtttgtaacttcactgtggtctttactctcacttgggtggatgtgaaagagatgccccacagtgggggcaaggcagggtggccgtggtgcggcatctgtcactctctgcagtgcgcgtccttcagctgccttgactgtataagtacctcagctctctgttctattactgccctcccttgtctcttgagttcctatcattgcaatttcaaagccttcctaattgagctgggccttctggttccaaaggccacacatttgtgattgctagtgtcagttataggtgtgatatccttaggaacatacaagaggtaacttcacagatgaggatttttgggaacagtgcagattgtgtcaaatgggcaataattactaaattaatttttaaaatatttgtagctatcatgataatgaaatgtggcatgctgtgaacactggtgagcggggaaatgtagtcaatgtagttctcctgagacgctaacttatgtctgcatacttgttttgtgtgtatttcctttaatagagttttccagaaaaggaccttctacactgtccatccaaggatgcggttgaggctcactttatgtcgtgtatgaaagaagctgatgctttaaagcataaaagtcaagtgatcaacgaaatgcagaaaaaagaccacaagcagctctggatgggactgcagaatggtaactacacagtgcctgactcctgattctgtataccgtagtacgcagccatagccctgtgagcaggtcatgctttagccgtatgagttggccctggctaccaggcccaaatccacacagtatgtactccacttcagatctgcacagtcatctcttccatttcagcttgccagtgttgctgtgttcctgattctctctcgtaggctggtcacttatgattttagaaagagtgtggtcctcatttcttagacatggctctattttggatcatagttggaagatgaatgcatcctgaaaggtctctactcacaccagggctgcagcttcggcctccgcttcttcacggtagtacatttgctctgtgcttggcttctccattgccacgctgtgatttcgactctgcctgcaggctggctccgtgagtaaaggcacttgccaacaagcctgacagccagcgctcagcctcccacccgtggaaggagaggactagccccgtgattgtcctctctctccatgccatggtgcacacagatagatagacataaagatgctgaagttagctatggagtgtttgtgaaggcagctgctccatcgtctctgtctagaagactgcctctccttttctgcccgttgaacttctcacgtctttacagtgtctatatggtcaccttttgtaggaagccttctgtttgtagttagcaatgtgtatctaacttgtcctgacattgcagagaaggtgtggtcctccagcacctggggtcacatagccagctcctggactgcaggcagcagggtggggctcctgtacttggtgtgtgtgccaggggcactgccctgtacatgccttttgttctctggtgttcctgcactgctgttttctatcttgcactgcagaatgctcaaggggttggcatatatcttacatttttatcctcaaaacatggtgttactttcagcgtaaaagacataagttttgatttacttttttttttttatctctttctcacatgaccaggaagtactattaaagtgtttcataaatagtttaatattcttagtttaaattatttatggaaatggctttttatatttaaggactttttttttttttttttttggtaacaaggtcctgattgtgaggtcatagagctgttgtcacctttgtgtcgatgtagttgtaaatttgtccaaattcaaacaaagcaggtgggccactgttccattcagagctgcacctggagaacagcaaagctaagcacaagtttcaacgatttttgaatactttcaaatgctaattttaattttgaagctctctgaaggagaaataagaaaagcttatgaaaccaagaaaactcatttaaggcataatgtgcctttcagttttttataggctttcagtttagaaacgagaatgtgccacctctctgaaacagttaatggtgacaacagaaaagaaagtagcatttttatttatgggacagttgtcaattcatgtggagtatttctgttcagcgtcacactgtatggggagatttgaggaaatcactaaaagattacaagaatggtacaaggctcagcgtttagccagtcttctctgagtgtagctactcctttttctgtttgggttttttgagacaagtcgttcagcctagacaaatgtttagtcccctgcctcagcttccaagtgatgggattgtgggtatgcattaccatggccggagtgagtcaacacttaaaaaaaatgatttaaagttccatacacttgcagataaaagtatgatttagctgttaaatacacttaaaattcccattacttataaaatgttgttagccttttaaattagcttacagtgtgctatttaccacacacactcaccccttgattgtttttcctttgttgagacagggttctagtatattctgacttcaacttaggatcctcctgcctcagtctctcaaatgttgggattgcatacatgtgcaaacactcggctccagtttgccatttttaacataaaactggttttaagaggaaataggaattatgcaaatagacttgggctagggatagaagacttctgtaaaggtaaggtgaactctaaaggaagagaagagccagcttgtattacagagccatgtttcaaaatacaaggcaagaaagcttggtttgggtcttagtctctgcacatttctacaacaagagtaccatagacccaaaacagtaaatactgactttatccatctctggagactggggtagtatgaggtaagacacctgcagacccagtgtctgcgcaggagagagtttccctgagtcctcacgagtgaaagcaccctggggtctcatttataagggcactaatcccactggtaaaggctcagcatcagccatgattgtctctaaacttcttggccactcaataccaagaagccttatggagcatgactgtggtgaggtggagggcgtgatgatttagttcacggcaggtaggttccaaacctgaccgagaaccgtgatgtcttggatgtcacaggaggaaaggacaagttaatgttctggagggatgggaaagagtccatcatgtgggttcttgtaggccaaggctacaatgggaagggttgaaggcaatgggagggaagagccagtggaggaggggttttgcccagagagtgctgaagcagcacctggctgctgaagagcgggtgggaaggagaggcaggagccgaagtggggaatgtagtgaccaacagtggatagaaagacagcccgctgtggttgaaggtcattttgaaggtagaattgacaaaacctattattagattgagtgtagtgaggaaatgcttattttgggatcctgatggtgttctatgcactgaactgtgaaatactggatacagagaacatagatgtggtcggcagcaaatcaggctcatctttatggctcaaagtttgagctgttcgaggcagctacatggaagtagactaagttgttggtagaaatacttagtgtgtgagacagtggatggagaaagtgcggtagatcaggctctaacgctgcagcgtctaaactcctacactgtcccatttcacaggcggtgcctatttgataattatctttcacctgtcatattttctggaccagtgagtaagttagcctacatgtatcggtgaagaatctatagcatagtgagaaagttgtttaaaaattttagcttcctggaatgttcacttaggtttcattacagaatagacaggcgatttattctctatgtgtttttaaatttttaaattaattttgaagttgactaaattttgactcagggtttaaaaaagattacttagctctgactagcctggaactctccgtagcctcaaactcacagaaatccacctacctctctgcctcccaagctctccaattaaaggtctgtgccaccatgtccagcattctctatatacgcttctatctatctatctatctatctatctatctatctatctatctatctatctatctatgtatctatctatctatctatctaaaattaatgttttgtgtgtgtgtgtgtgtgtattaaatcagtcattccattttcttttctgtagtggagggaaactggggagatagctcagtgaatgtcctcagcatctttgtaaatatgaggggcagggattgctggcctgcctgtaatctcagcacccaggaggtgggaaacacagacagtccatcatctggaaaagctagctacctagactacctaaagcagaggattctgggtacttggaaagacccttcctcagtaaacagactagagagtgattgagaagtcacctagtgtcaacttctggcctctgcacaaatgtacatagaggtatacgtgcatatgaacatgcacacgtgcagaaaagggtgatatgaattttataagtgaatgcatttgtgctttaatgggaagataatttgttaggcttctaaagaaagattgctcatgaaatttaaataataaatacaagcagtatttgaattatagcctcctagaatacaaacagttaagaaaaaaaatctacacagttatttcagaatgccaaacagattatactcatgttaatttgtcagaaggtatcttaatagcctgggatctatgtacatcctaacagattggttatctgtgtacttccatgaggagatctggttgacatgtgtataagtctgtgtttaggctgatacactgattaccacttgatgatagatatattaagggagtatttagtttcattgaaataaaaaggattagttttataggcgtatcaacgtttaatttttgtcatccctttgaaatgtaatttcttatttgttagtcctttatcttaaatatgcgctacttaagaaattttttacatttttgtaagttctaagattgttgtctttcattttaatatatttaggaaggttcatggagcatcttataaataaatatattaatgatccattatctaaaaaggaaatctgaaccatgtttttgttttgtgatgtggttttgtccctttgttctcctctttccttcccttcttccctcccctcccctcacttctgcatgaatggggttttgctgcctccagatataccctggactggcctgtaacttactgtgtagcccagctaaccttgaactcttggtgacattcctgccttagcctcctaagctctgggatgataggctagaacataggcatatattgtttaagatacttgcaaatgaatctttgtatggaatgtaaannnnnnnnnnnnnnnnnnnnctctttaagagaacagaaatgaatactgctgcttttcccttagaatagcaggaagcacttcctagatgtcacagccattccctccctctctgtgctgtgcacttcagcattgctttcagctaccactgctgtcctgccaggtatacatggttatgttagggccatcacatttatagtttctcttctagttctgtagctcagcacttggtctgtatgtgtgtgcagtcgttagagtgatctgtttggctcgttcttgaagctgtattcttttaaatgttaatgtagtgttttcctttttgagatggggtcacataagttacctggctctgcctggtgcttctgatcctcctgcaccattttcctaagtctgtaaataagggcaaaacagtgggctttatgtcctttttaaaccagaggaatttggtatataaacagacatttaacccgctcttataaaagttcaatcttctaaccttctggttgtaaacttaatcatgtttagttggaatatgattttatatttgttcaaatcaccattaaatgacaaattgtattaagatcaatcctgcttacgttttttggtggtttggtttggttttggtggtactggtgactgaaccctgaccagagacttagagtttctggccattctagccattctcctgtctcagcctcccatctccccgttggtagagtgggatttcatgttcctgagctactgcttttatggggttctgaggatctgaccacggtcatccaggcttgctcagcaagtcggctgcctccccatctttttctacttctatttaaaaagcaaataaaaatgtgtatgcttgtgacatgacctcaactatgtacctctggccagctggcctggaattcactatgtaagccagttacgtagttcctctgcctcccgagtgctgagattaaaggcatgtgcttaaattatttttagttctatgtactaatgtgtatttgcatgttagtatcctcagaagccacagtgtctgatctcccaggagctggatttacagatgctcgtcactcctgtgttgtggtgctgtgaacagaccttggctttcctggaagagcagtacacgctcttaactgctgagccatctccagcccattcttgcacttttgaagcaacttgtcttctgaatatgtcctttggagtcttgtcatttcttccagagttctctccttcctttttcttagtctagttctgcttatcctttttgaagatgagattgtttttcttttttgagacagtctcactatatagctctggctggatgtcctgaaaatcagtatgtagccaaggctgcccttaaactcacagagctctgcctgcctctgcccccccagtgctgcgattaaattcatgtgccactacacccaggtttagttctgtgggaattttttggttttggttggttttaattctgaagagaacagaaaagggcagcttacagatgactagccaccatgtgaatgtatggaattgaataattatcttctgtctctccagtttcccagtactgcacactgggaaacagactttcctcacaaatatctgagtttcatttactagcctctgcctcgctcagttatctttgtgggatctacctggtcagatgacatttttcgttcaacattaagtagttaatgccatttaatgtgttagctatctctaggtgttgcataaagttttaaacaagtgataaattgtttgtactgggaatttcatgacttcaaatccctgtccccaatcatggcttcattcttactgtctctcgaactttttccgtcaagtctccattagttcctgtggtgacagtgaactgtgacttcagcattctacatattaaaaaatgtttcttaaacggaagaaataaacactagtttcttgtatcttattgtatgactttattactttagaaactatagagaattcacaaatattttatgtataaatcatatttacatattattaaactatgacaatatttaactaggactcaaagaattgccagatttctggatactagaaatggcaaatgtgcagttatagaagaatgaataaatgtgcgaatttcagatgcagcaaaatgagatgcattctgtacttgttttgtgttttttaaaacagttttctgctgctcctactactaattaagtgcataataatttgagagattacactctctatactttgtccaaattgaaaactttttgagtctactggtccttctgactttgtttttaattattctgcagagtctatgtcaaaccctgacctcagtgagtcctaatggctgccctcccccacagagttctagttcaaatagcagtttccagacggtcctctgggatccaagtggattcttgggctttcctcttagctcttgcctttgtgatctttagggtattaaaatatcccaccatgtgttaaattgaagtaaatatctgccggtctaattctagatttcagtcccattgtcatggtaagatcttgaatattttgtaggaatctatagacaactgatgtttacttatagctccttagatgtggccttgtagaaatacttgtctgcattcacttaatcctttaaaggtggtttgatatataagtgttaagtacctgataatctcatttttcacatacgttgtgaagcataagcaataattgcctgccttcaataaggagaagaacaaaagagaggtgtgatgtaggaaatgggaagagaaaagacaagagagctgaggcaaaggaaagatcttatattctaatgagcgtcatcactgtctttagttctgttgtttccatgtgccatgctcaagagaatataccatgaggttcagatatttgagttgtaagtgagtaatatgggaaatattgggtttgtctcaaattttattaacctcatttttccgttaggattctgattaaaatttctttagggtttatcatgagtatcacttattattaaaatttgctgaataaaggactagagggatgtctccgtggtttagaacactgatcgctcttgcagagtacttagatcctgttcccagtacccacgtggcagctcacaatcatctgtatctccagtacagggggggttggttgtctcctctgacctctgtggacaccaggcatgtgcatgctgttatacatgtaaaacaaagcagctttacacatgaaataatttaaaaagtaatttctgaataaatgtttaagagaaaggaggaatgtgtgtgcatgcacacatgtgtgagcatatgcctgtttataagtgtatcacatacaataataagcaaatgcccaccttcagtaaggagcagaacaaaagagaggatgcatctgagtgcatccacatgcagatgcccgtggaagccagaggtgttggacagtaggtagctgtggccatgccacctgatgtgcgtctctccagcccccatctgattttccactccggtgctatttggtgcttctctttgatgctgctttccaccagcaaaacatctgtgtgtttttttcagttcaggaccacttgtcttagccctctctgccatttgaggaaatgggatatgggtaggcagagaagacctgagccaccaagcactagtagtgcaaataaaagggccggtaagacactttagaaatcttggttatgtgtgaagtgaaggagaaagcctatttgtttttagatgcagagtagttgagcaaacccactttccacactctttttgtctgctgtttccattcttttgtggtagtgaatgtaagatcgtgaactgtttgtaaattaggaacatcttttcgagggaaattttcatgctgccagtatggacatactaaatgaagtaccaatagaaggggattttcttagagagattattataattaataaaattatgtaatgtcttagacctggatactcttacatgcattatcttgtgattccttataaagattaagtaaacgttatcaactgtacaaataaggaaatgaacttaactattaaagaggtgggaccaggaattttagcctagattgcctctgattccaaaatgaaggcatattccattacatctggaggttattaactctggctacatattggagtcatctggagagctttgaaaaagtactggtgccagtaaggggggcactgtaattgatctagggaacatcccatgcattggtgcttttaaatgcttcctaggtgatcccagtgaggggtagcccaagaaggattgcagctcattctacagctgccctggccactagtgtgtctttgcctgcaaacattcgtcaacaatcatcagtgttgctgaactgacattctcttacctaacataaagaatttgtattagataaagagacgatatcttatataataaacactgaaaagattttactgaccagggctgtggaggtggcttggaagttaggagtactggttgttcttccagagaaccagggttcaattcccagcatcacatggtggctcacaaccatcagtaattcctactctaggggaccctacactctcttctggcctctgcagatgccagacatgcacatggtgtccagatgaacatgtaggcaaactcccatacacataaaatgaagtaaaaacaatttttaaaagttagagtgaccatagtatgggttatccttgcctttagtctgtacaaaacttaaaagtaaatttatgattttgtctttctttaagttgcctcctgagtgaagtgaagtgtgtttgattcattgttcagtttgtttctgtacctcatctcaggatgtgacaacactcattgagactgagagaaagaacactttctcaacacatggtggatcaggtcatgagattcagtctgtactttgtacaggaacacatttagataatcagagatggctccataagtctttttaaggacctttatttctctcctcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccctccctctctctctctctctttctttctttctttctttctctttttttggctagacatggtagccaatttcatttaatcccagcactcctgcacatatgtacacacatacccataaacatagacttaaaaaacaataagccagccaggtatggtggcacatgtccttaaaccagcacttaggaggcagaagcaggtgcatctctgagtttgaggccagcctggtctacacagtgagttccaggacattcagggctacagagaaaccctgcctccaaataaataaatacatacatacatatataaatacataaataaaaccataaattgagcaaataggttaataaatactaagttttgaggcagggatgatggttgtgatgagaactgtcttccatatgcttcatctttgaacacttggttcccagttggtggcactgtttggggatggtcaggtggttcaaccctgctggaggaatcatgttgctggggacagacagatgttaagatgatgtagcctcacccagcttccagttgctctctctggttcatgcttgcctttgaagatttgagctcttcactaccatgtggctactggctgccatgcctcctcctcatcctggactcttgccccctggaaccataagctcagagagactccttcttctgtaagtcatttctggtcatagtgtttcatcaccacagcagaaaagcaactactcactactcaggctctcatgtgtagtcctggggcctggaccaggctggcctcagactccctagtcatttctacctcctaaatgctgcattaaatcacacttgcctggtttatttgtcaaattatgtatatgtttgtagatctgcatgtgggtatgtgcatttgcgttccagtgcccatagaggccagaaaagggtattggataccctcacctaacattcaggtggtaagttctgggagtagaattgcggttctctggaaggacagtgtgcacttcttaccgcagagattacaggaagatgtgactctgggtgaagaccattctttcaagtgttgtaatgtgaacacacaagaacaacaacatttgttactagcctgtgatgaaagttttgatgtttgaatcttcagctttccggtaaatttgaaagaaatactttttcataagagcacttgcagttcttctgaaggtcatggtaaacatgaagtaaacttggtgtctgtctgattactttttctttcagtactatcatgatgaatatgtgttcttaccatttgtactttgtagaagaaactgaaggacagttgtaaaagcatcgtgcttgggcctggggagatggggagatggctcagtgggtaagagcatgctctgtaagcaccaggtcttgagtttgaatcctaagagcccacgttaaaaaacaaacaaaaagcaaacaaacaaaaaatcttgcctgcaactccattgtggggtgcagagaggggtgcagagacaggaggcttgctagggcttatgacctctgaaggagttccaggttcagtgagaggccctgtcttaagaataagggtgagaagtgcttgctgatagaagcctggtatggctctctcctgagaggctctgccagactgagctctggggtcccggatggaggagttggagaaggaactgaaggagttgagaggatttgcatctccatggagggagcaacagtgtcaacagactagaccccaccccctccccgggagctcctggggactgcaccaccaaccaaagaataacacggagctgcccatggcgctggccacatatgtggcagagggtggccttgttggatgtcagtgggaggagaggcccgagggcctgagagggttcaatgtcccagtgtaggggaatgccagggcaggaggatgggagtgggtgagttggggagcaccctcatagagacagggggaggaggggaaggatagagggtttacgatggggagacctggaaagaaaacatttgaaatgtaaataaaaaaaaatccaaggggggaaaaaaagaattcggtagagagggttcccgcagggtgctgggatgtgagaacacgtgtgccatgtctcacacaacacacctcagttgtccactggctacaatcataggcatgtaccaccatgcagggttcacggacagataatgttctggataagcgcttctgggtgctttgttttggttttgttttgttttgttttaattttaaactgatgagtgtctgcaaggaccatcattacaaacttccggtataaagacacctggttgcaccttctcttagcgctgctgttctttgacttttattcatatcttttaataactataaaaataactctagctgggtgtggtggcgcatatctgtaatcctagcacctgggaggcagaacctggagtgttggtataagttaaagcccagctggcctaccagtggaaaatacagattttataaggatgtttaagagtaattaatacagattctttgtggttttagtttttcattacatttaatgtgtgtgtatgtgtgcatgtgtgttagaaggaagaagagaacctgcaggagttggattttctccacagtgtgagtcccgggatggagctcaggatttcattcagtcttggtgactcatcaggcctgctcaggaggcagaaaccacgcagtagactgagtgggtaaatgtgtaagtcttatagagagtgactgttagttatgaggaagctctgtgtgctacttagggctgggaggagaaaagccacacctggggttcaccctcagttgaggagtgtagttagcaccctgggttagagaagctcatcccggtatccaggcccaagtgaatctgtaacccacaagtagctgagtaacagtagggacccagaaggccctttagggcctccactgtttatagaagctttccgtgtgctgacatccgcgtgcctgagaagactgcacagctggccatatgacaggagtgacgtctcctttactgtctttagcctagtgactctgatctttctcgtggccgttgggaactacagaggagcctttcgcttagcaatctcagcacactctgctgagaagtctgttaaatggttggtgttgtaagacccggccatactgtagtgcataagttaaagcgtgaattggaagctagggtgggtggggctcctttctcttagtttgcttatcatctttcagtaccctgtgactggtttccttccatcagcattttgggtcaacatagttacttggcggagctgtcctatgtattgtagtatgtagcagttttcctggcttccatccactaatctctaggcatacagacaagttttgacaataatgtctccagacagttacccaatctctcctgcagtcttaaatcttccctagttgagagttagtctattttctgggttttttttctctccctctccctcctgttggaatccgagtaaatctatgttaatgtagacttgctttggggatttgctttgcagcgtcttgagtcaggatcttggtattctagctgccctggatcaaggtagccacaagcctgtaatgatgatcctcatgcctttgtctccagctctgctggagggctttttgtttgtttgtgacagggtctcaagtagcctaggatgccctcaaacacactatgtagccaaggctagccttggaatcttgatcatcctgcctctacctcccatgagttttgattatggaagtgtgccatcatgcccgggagccacagtaaggggagcagttctgtccccaaaagttttcctctgacctcacatgtgcagtgtggcatgtgtgcctctatttatatattcacacatgctatcatacacaataataaattaaaacaaattaaaactttgagcatttctccagagatgtctccaagtacataaatggccttgcaagcacatgtacagatactcagttattacagaaatgtaaatcccaaccacattccattcctatcttgtactgactaagaagtccatataaaaaacaaaatgcagccgggcagtggtggtgcacgcctttaatcccagcacttgggaggcagaggcaggcggatttctgagttcgaggccagcctggtctacagagtgagttccaggacagccaggactacacagagaaaccctgtctcaaaacaacaacaacaaacaaaaatggccagacatggtggcacacacctttaatcccagcgcttgggagacagaaacagatggctgtctatgagtttgaagcaagccaaagctgcatagtgagactgtctctcaaaaaaacaagcagggcaaaaatgactagtgctggtagtggcaaacatggatttcaactctttgaccttgcttgtgggaacggagaatggttccacttttgaaaatagtttggcagttccttagaatatttaccaagtaacagttaaacggctttgccatccgacatagagatttcactcttgggtccaccaagtgaattgaaaacattcatacaaaacatgtacgctgatgttcttagtaatgtgatttacgatagccaaaagtagacctgactcaaattttgtaagtcaacacagttttgtaactctataccactgaatgcttattgcatcataaaaataactgaaacttttaagactacatatcacaagaacaaactttgaaaacatcatactgtgcatgtgtgtgtgcatacatgtgcacagagcaaatgtataagaccacatactgtatgaatgcatttgcaagaaaatgacctttgaatgtacttagaaaagtgctagactctctacagtctatgatctgcaaagtataacttagtaccgttttaactgaacctaaaaaaaaaaaaacctttaaagtgtaatcagtatgaaattgagctgcaattgacatttcacacatgcacgttctagatattgttacccaccctctctcccccatgtgctgtgaattgagtccagggctttgtacactttaagcaagccaattcaaccaggggattacatccatccctgcttgacagcccccaccccgtatgtgtgagtggagagctagggaacgcctggagacaaagtccttcattgcctatagagtgccagttaggccaagtgcctggcccgggcacaggcaatgtctcttcctctctggtgctgggattaaagtgggcaccaccacacccggcatttttgcataggttccaggaggctgaattcaggttctagtgctttcaaggcaggttctatacagactttgccctaacaccaggttccacatttctttaagctcttctacactgttgtaatataagtgctgactaatatttaaatcgtgcaagtttgttcttacatagattagcagcagaggttagaccagaggcaatctgtctctactgctggcctttgccttgataacagaagtagtcccatacctgtcgagggtttatcttgagaggaaaaaaaagatgttaaagattaatttcatatcttccttttgttaacattaagagaaaaaattgtaaacactgtcttaatgcttctcagaaacttctgagtggctaagactttactgtctttttatgagctaatctgttatgatgttcattcttaataacagactttatatcatttcagacagatttgaccagttttgggccatcaaccggaaactcatggaatatcctccagaagaaaatggatttcgttatatcccctttagaatatatcaggtaggaagtaacattacgaaaaatgtttttgaaagctttagacatcattttgaagcactgtgtctagaacccttctgtctgaatgggaacttactagtatctgggtttgcatcaggttttctagctccgtcttttgctggtagtagaattggaggttgtgttgcagtgactcatagttgctactggttatgtccaatgttcttgctgattcgtctacctgctacagtttacctgtaaccctgagataacacatgaagcatgtttgaagactattttgctgagagagtttcaagtagcacagactggcctggaacttacctagtgaaggctggccttgaacatgtacctctgcctcttaagtactgcaactatacctgtggtatctgggtctacactggaaacccagaactttgtgcttgttaggcaaatactttgtcagttgaactgcatcccaagccccaaggccttttttacttaggtgttgagacagcaacccagatggccttggactctcctaccgtagcctcctcagtgctgggattatatgggtgcgaatagtggtagaaatggcctgatgtgcattcccctacacaacacagaacaacaccaacagcactgtaagcaaacagcatccttttcatacttgatttagtactgctgttattctttttgtttttactgagttgttgttgttgtcgttgttgttgttgctgctgctgctcaagatgggtcctgggcaccctgctgtttctgacagaagcatacatacatcaggtctgggtttgttgactgataaacagtgatgaagtctcatagagatcacctgtctccccaaggagcgtggtatttgctaattcagtgtttgctcctgcacctgaggagagtgagtctagatggggagtcatcagggctatagacagtgtctggtagtcaggcttacagaaagctgacacaaggtaaagataggattctgcttggtgtgtcgccaatgttaaataaaccttgagggcctgcaggggtagctcagtactagagtgctccgtactagcaaacatgaggtaggccttggattcagttgctgatgctgtaaaagttgtattggtcgtattttaggaggcagggtacctactctaatgacaaatcatttaatagcagaaattgaaagcaagagttagtattgcaggtgttattttcaaggcttctacgtttgcaaaaacagagttctgttcatgctcagtccagtgtctaaaatgccctgtacgtaacactgttaactcttattttcattttcacatgccgtgagctctctagtaacttactgtcaggtatcccacagcctcacagagtgtctagattgtgaaatataatttaagaactatcgttgcccagtagtgcacgtgttggagaagaggccttgcttccttgtttattttgtttcagggacagtcgtgaggtcaggttatcctctcatgctttgctcttaccacccagaagagtcaggtgtggagaaggtgtgtggagagcgaatgtgtcggggaatagagaagagattgtccttttgttttggagacagggtttgctttggagactagcctgacctggaactcacaggctttcatataatagcattttaggtgtgtattaccacctcgacttgagagaatggtttttatacagttctgtcatcagatagaaagtgggaacttagagagctctcagaactagcttcactaggcctggctgccagatgggggttctgtgagagccaagcttcctgcaggcctttcctgtgtgggggagggaaagagcagggcactttattgtttcttagttgcttacaaacttttcttcctttccattctggttctgggttgaatctgaataaatctgaataaaaagtatggtatgtaagtaaataccaaaattttagatttataggtttttttttttcattttttttcttacattttttaagttttccttttatgctccgaccaaaggaaaatggagcctccatttctttttcctaattatattctagtagtagcatcaggtatgattgtgatactctcttaggtgagctgttacttaggaagcattttgattaacacttaatttgagcatcacacacacacacacacaacttagtaagaatatttaaagaaagcccagaagcccatgtttaatagacaaagaataatgtttgctaagatattagatcacactgaagagactcatgtcacttccccaggagagttcaaaggaaatgtagaattagcagccagacccaggtctgatatgtcaacaacttatttcttgtttataagttaagcttatcatatttatgtaacatagttatcacaatgaatgagacagcctgaatgtagcttggccagatgagccaataggaatctagaattccatgactgatgttgttcctcatacactggacttctgcagagatggcaagcgctgctttccatgttatgtgttcatcgtggactcagaatgagtaccatcaagtgacagaattttagtggtaaaagtcagattcctccagaattctctagcggtgttacacaccgtttctctgtcatttacatagtagtcagtgtgtgagtttcaggtctgtgttcctgaagtccaggtgcttcagtatgagccagtgttctagaaatgaggctaatggcaggaggtggttccaacatgcagccacatgttatttagaattccatccatcaggaaggagatggtgttaatgaggttacctccacgaggctctgtgaaatggccacgaaaggtctgggcagggatggtaggccttgcataggcaaagggacttgagaagaacctgtagccagctgaaggagacactgatttataggggatgcacatcaagaggaataaggccacaaaggaaaaggttcctgcattgaggattttcctgtggtctggacaactgccagtcattgagtcactttgtgctgtggcttgcttgacactcttcctaggaagaattgaacagtgttattttaagttttaaacaataaagaacggttggaaaatggtgcctagatcctacggatgctcagatcacctctgcctgtctttatcagctgtaaaatagagtctgagttaggttgtctgtgcttcgtaatcaccagaacgctgattccccctcccccaccccctcaatgtttcagtataaaaccatcttatatatcactaaagcctcattgatgacttaatttgattgagaggtttgcttgccagttttactttagtaggtctacttatcttctatcgtgacgcagtgaaacctttaagaatgtaatagttaagggagttcatagtacgcgattataatcagaaactaggttggctaggactaacttgtactccctcatctgaggaggggccggatttcaggcatcagtgaattttctgaagttcttaacaaaagtgtgtggcaagtgatgactccctccctgtgcacagctcaggggaacatgccacatagactgcgtaactctcttcagagagacagaaatggtgcttccttctgacgcttctcccctagtgtactgcacggtagtgaaaagttacctttctgtgctcttactgcctcatattttagttactatcttgccattacctcaagcagagaagctagagactaagaagaggtcctactgaatgctttttttttaatttagttttaacttatttccaaagaatatatataataatttgtcacttattttaactgcctgtgagatatgtcaccaagggtagctggtgagatgccctttccccacaggtctcagaattatgctaccagaatctatttctcgatggtttctatctcttatttaatattctagtttactcttacttttgctaagaacttatttttctctctctctgtgtgtgtgtgtgtgtgtgtgtgtgtgtgtgtttgtgtttgtgtttgcttgcatgtgtgtgtgccatgtgcatgcctggtgctgtgtgaggacagaaagggctttgggctgtctggagctggaattatgagcagttgcaagtcaccacataggtgctggcaagggaaccctggtcctctgcaagagcagaccagctctccagccctacaagttctttttatttaattttagctttcaattttcagttagctgtgactcggcttatgttttcttttgcttggtggagtgaggtggtctcatgtagcctaggctagccttgtcctgcgtagttcaggctgcccctaaactctttttaagaactgtaatcacaggtatgagccaccatgcttagctctatctctttatcttcataatctctattgtttccttaaatacattttcctacttctttaattattttcacatttttaaaaatttcattgtattaaaaaatagttctgtaaaagtccctatctagcttgctcaagtccagtgtgtgtgattttacagttgtcagcctatttccttatttccttgcttgggttataatttgtatggtcatctgacaatttcaaaagattctttaaatgcctagaatagtacatctctctgttctctctcgtgtgtgtgtgtgtgtgtgtgtgtgtgtgtgtccacgcgcgtatgtgcttgcttgtgttgcatgactaaagtatgcaaacaaccagtgtataagctggctttcctttttatatgaagataaagtcaccacagacatgagtgcagttctgttccgtgtctgtttcttctagattaccattgatgtgttggggcctttataccagttcagtttcttatttctagattttcctattcaatttttttgactaacttgtttgctattgctgttgtcttctagtagctatgaagttttaaaactttttttactgagtaagcttgatgtctgaccagataaatcctaggacagacaaatgacagttttctgagaaagaactcagccccattctggcccttcctctagtgacaatgctgccatgatcccaggccgaggacgcacatggcccactgggaagctttggcctgaggtggaatctcagaaagctaaagtgggatgacgtctctggaaacagatgttccctgagctgttgcaagagcaagttaattttaagaaacactggttagtgttttagttttcttctcttgtgtgaagaaccctgacagaagcgtcgtttgggaaggaggaaggcttctgactcgcagtctagggttcagtgcttcatggtgggaaagtgaaggcagctgattgcatcacatccacagtcaggaatagagccgtgagctcctgctgctgctcctacctcagttagagcaatgaacccaaaccccacaggcatgcccagaggccagtctccatggtgacggcccattctaaccacagcagtgttctccttgcttggtggagaggtcatgtgataggccgacactccattactgaagaaggcatctctactacctctaaggcttgatgaatggattttgtagaaatttggagaaaacgataaagatgaagtgtttcctagagttttttttgttcttgtttgactggagtgaggagttattttaagacagtgtctgactgtaaccctgaccagcccataagttgctgtgtgttggcattgagctctgtctctggaattgaaggtgtacatgcctggctgctatctctgttaatgatttctaaagtgcaaaacgttccactgagtactcgaccttaaggataagagtcgggctggagaggtggctcagcagttaagagcactggctgctcttccagaggtcctgagttcaattcccagcaaccacatggtggctcacaaccatctgtaatgggatctgatgctgtcttctggtgtgtctgaagacagtgacagtgtacccacatacatgaagtaaataactaaatctttaaaaaaaaaaaaaaaaggaaaaggaaaagaataagagtctgtcatgttagatgcccagggattgccttctctaccaacctgcagcttatagctaatgcccctaccctggacagtctgaaagaataaccctgtagcatggagcatggccgtggttaaaatagagaggcttcaagccatgcaggactgggatctcaggcttggaaagcaagtttcaggacagagcaggccagctgttcccaagctgtggttcacaatcctatggggggggggggggtcacatatcagatagcctgcatatcagatatttatattactattcataacagtagcaaaattacagttatgaactagcaatgaaatgattaaatagttaggggtcaccacaacatgaggaactatactaaagggttgcagcattaggaaggttgggaaacacttgggcacttatgtctcatttctggatcttcttcatctaaaaaactctgattgtagtattttgttactgtggagatgaaatgcgcctgcttcactgtaatgtctcagaatgcttggtgtggaaaagaggtacagatgctatctaatcagctgtgcactgggcaagttgagttaccttagatcatactattgttgcaaattaatgtttgtcaggctttctgtatttctggcgagtggaatacgtgtgatgagttgttcatgacacgaggctgtgtgtgcgctgctgtatttgtagtgtctaccacaagcagcgtaagcctgtgcttccgtttcctctttctttccctgcaagtccgcagactcgggactctggagtaagttttgttcactttctttgactcactcattctaatgtcccagaacaacctgccttaagtctcagctttccatttgcatcttaccccttcctcctcacagaacttgtcatggttcctgtagaactaactgcctgctgtgtttctttccctccaaacgatagctttttattttgtttttgagactggtttgctctgtagccagggttgcctttgatctctcctgcctcagccttgttcagtactgggaccaagtccgtgtcccaccacacacagctggcatatggatgtttgttttggtgataattttgatattatatattagctatctagcatctaaatcacatggtattgtttaaaactggactgtttggggggctggagttaagagcactgactgctcttctgatggctctgagttcaaatcccagcaaccacatggtggctcacaaccatccttaatgagactccctcttctgatgtgtctgaagacagctacagtgtacttgcatataataataaataaatctttgggccagagtgagcagggccggagagagcagaggtcctgagttcaattcccagcaaccacatgaaggctcacaaccatctgtacagctcaggcataaaataaataaataaatctttaaaataaaaatactggactgttctattttcttacctggttaacttctctcacagggcctttaacctcaccttaccatctcttctggctaatctttcccaatctttcacctgtgctgtatataggttaattctttgctcttatcttaggtatttctcctttgccatgacagaaactaggagtctgacatcttaacactgattttgacctaaaaaatgacttgctcagtgtccagctggttacctgctgcacgactgaacctgggccttcgtatcttcagctttcccttgtccttgtaatgcaggcagtggtttttattatctcccccagttcattctgttgaagtgtgtgtcgattttctggatttagtcgattgctgaggaaaagaactgacttcctttgcatcttgatagctgttatagacagtgtcttactgctaggagggattgaataatgattttagtgtcgttttaaaacatatctgaatcttatattctctgttccttgtaaaataagtgggtaaattgaggcctgcagggggcagtcccaacacagcaggtttttaatgtatttagtaatctcagatggtttagagttaaattccttcctgtggggaaaagtttgtaagggaagcaaattatacatgaataacagtaattgctaacatttattttgtattttttaaggccaggtactgtcttaactattctacatgtgtttattcccttatgtgttcatattttctatacagatgagatcattaagagatactctaggccctgatactcatggcttcatccacctggtgattaggaagccagggatttgagcagagacagtggagcctctcggcagagcctgttctctttcatgggctgttggttcatttctttggttttcttagcctgtcgttgcttcttatttgaaattcagtttgtacacgtgtatactatccctcccattctgtggctcccagccctcaatcccctttcttctaatagagaaaagtcacaaacagtgtgaagaaactgaagcagagctaaaactttggaaccctctcttcgttacagaaaatttctatctaccaagtaggcaatttttattgatcccattaagttcaattttagaaatagaatgagtgccattgcttgtatctatgtataagacgatctgcagtaaccttgaagcctcagtcattaatatgtcatcttaaaaggaattgtaaaggaaactctttcaacagtttcactaagaatttcttggttgtaagaaacagtattgggagatgaggtgatccagcaaggaaaagcacttgccatctaagcctgttagccagaggttaatccctgtgaccaccacgtacatgtcacagcacacatgcacacacacatccatgctgtcagttactggtatgtctttctcttttatcatgatagtttcacctctcctttctgagaatttgattaaaatagtaagaacaaggtcattttaaaaaattgattggtggtacttatgttaaatgtaacacactttaaaatgttcacactgttgaaaatagaagtgtgtgtagtatttaccaccacaaaatagaaagctgtcacctatcagaccttacaccttacaaggttgtgttggttcctgatgtttgaggtgactggttcagtgactaactttagttctcccagcattcccggacatatagcctccagttgcctgagttgcccactactcttagtatgaccttgacagtaacaatcctatcttaaatgccagcaagattttgctgaaaggaccccatatagctgtctcatatgaggctatgccagtgcctggcaaatacagaagcggatgctcacagtcagctattggatggaaaacagggcccccaatggagaagctagagaaagcacccaaggagctgaaggggtctgcaacctataggaggatcaacgacatgaactaaccagtacccccagagctcgtgtctctagctgcatatgtagcagaggatggcctagtcagccatcactgggaagaggccccttggtcttgcaaactttatatgccccagtacaggggaatgccagggccaagaagtgggagtgggtgggtagggagggcagcagggcagggggagggtatagggaactttcaggacagcatttgaaatgtaaataaagaaaatatctaataaaacaagggaaaaaaagaattgggattaaaaaaaaaaaactggtttaaaaaaaaaaaaccaaggcaaacacattgtagtcctgtcctaagcagaaactgtagcactcaatgcaactttgtagacaggagctaaagatgccagcactaactgttcattctattttccctaaataattaaaaatatacttatggttaaagtatttaagattttatattttcttctctcatttaatgggatatgattggtattcttaatgtatataatatataagagcagtcttaatatctcacactgtttagaaggagttttatacagtaatttatccaaccatatcacctttatgtttcaatatcactagatggccttcctaacgtgtcataaaattttatattcttaaaaaaaaaatcctatcttaagtcacttaaccttaacattcacaactatcccagctggtcagctggtttcttcgtcacgtgggacttccagtgttctgaaactgtacgcagtgctagcattgggatgctgctcctcagatgatccttcagcctgctgacagctctgtgctgtcagaaatctgcttaatcacttattagtttcagtagggaaaactgccttctaattttccccctgctcttctcataagtaattttcatatagcacgcagagcacacacctgtctgctgaaagcagattgccaggctttggttcttagcagtggttccttcttttggggaaatatgagagttgcttttggtagaattactcagactttaaaaatacctatctgctaatactttcaagtaggttgtatgtagggtgctcacttaggaatactagaagagaaatcaacttaaagagaacaaagcaggctggaagtgtagatcagtgtggtagagcatgtgcttagcacacccaaggaccaagttacttccccagtaccactcatacacacacacttgcagacatgcaaagtaagccaaagcaacttgtattctttctgattgagcctatttatagatagatagatagatagatagatagatagatagatagatagatagatagattgatttatatatagatatatacatatatgtgtgtcttataaaaatatatgacagtgttgttgagtcacatccatttagaaatatttgtatttattcttgaacagttacacacacacacactcatatatatgtatgtgtgtgtgtgtgtgtgtgtatatataaataaataatgtaccttgactatatccacccaagctctcctcctgtcccactctgctcacacacccccagtatgtgtccctcctaccctggtgtcctccagtttggagtccagtttttgctgcctgcatcacacacctgaagaaaagtgaccccttgtcctagtgcccatcagtggttagtagctcctcagctggggtggagctgcacagcccttccccatccatgctggcatcactggttaggttgaccttgagaattgtgactgcactgaagtcagagtgcacagctgcgtcatgaccagcagacagtgtttcctcatcctctctgctgcttagcattttcctgtcactcttccaggacgtttcctggggtttctggaagtagatttataggtgtctcagctatgtactgactgctccctactgtagaaagcagcttctctgacaggctgaaagcagcactgatccataggtattctcataaatatttagaaggcagtttgaccatgtgtttgtttagcacaaactgcggttgtgtttccctcctgtcctgcttagggtttctcctgcagtggaaaaacaacagggccatacctaccttcatcttacagttccacgtccagtccgtcatggaaggagtgcagggatgcatctacctacagcagtcactaatcaaagacatgctacacagcttccccacaggccagtgtggcggggtcattttctcagctgaggttctctcttcacaacttctgtatccctagggactgtgacctccctgcctatggatttttatctaggttgtaaaccagccatggatctctcctatgcaccaggcctcagatgcagtcagaaagcaagtggttattcctgtagtagtcagaccactggttaatatttgtaggggttgtgcttattggttttcaaggattttaggtttgttttgtggcccatgcagattgtttcagtacatatgcatgtggccagagcaacatgtgtgcatagattatgttgatcatgaatcaactctgacagccatacatgaagccattacctaggcagatgcttcttggcggttttaatgaattaacattttaatccttcataagtaaatttagtctgatatgaatattctattgtattatctgagttgtatgccttggaagctgaaatgtttataatgatgtagagaataatatatttttttaattttttattagatattttctttattttcctggtttcccctctgaaaacctcctatcccctctctcctccccttgctcaccaacccaccctctcccacttcctggccctgcctttcccctttactggggcatagaaccaagggcctctcctcccattgatgaccgactaggccatcctctgctacatatgcagctagagataggagccccacccaccatgtgatttctttgattggtggtttagtcccagggagctccgtgggtactggttagttcatatcgctgttcctcctatggggctgcaaaccccttcagctccttgggtactttctctagctccttcattggggaccctgtgttcagtccaatggatggctgtgaacatccacttctgtatttgtcaggcactagcagagcctctcaggagacagctatatcaggctcctgtcagcaaactcttgatggcatccacaatagtgtctgggattccacttcacaccagtcagaatggttaagatcaaaaactcagataacagcagatgctagtgagaatgtggagaaagaggaacactcctccattgctagtaggattgtaagctggtacaaccactctggaaatcagtttggtggttcctcagaaaattggacatagtactacctgaggacccagcaatactactcctgggcaaatacccagaagatactccaacatgtaataaggacacatgctccactatgttcatagcagccttatttataatagccagaaaccagaaagaacccagacgtccctcaacagaggaatggatacagaaaatgtgatacatttacacaatggagtactatgcagctattaaaaacaatgaatttatgaaattcttcggcaaatggatgtatctggagtatatcatcctgagtgtggtagcccaatcacaaaagaacacacatgatatgtactcactgataagtggatattagcccagaagctcagaatacccaagatacaattcacaaaacacgtgaaactaaagaaggaagaccaaagtgtggatactttgccccttcttagaagggggaacaaaatacccatggaagaagttacagagacaaagtatggagcagagactgccccacctggggatctatctcatataaataacacatttctaataggcttttctcttgatctttgctttttttcttttccctttttctctccccaactatcccatttccccccttttggaatccttctgattcactaatctgaaaagtgtttttactacacagtaaaccatttcctattttaatgaacgtcttgaagtttcctttttaaagagcatgctgctgaaggcaaaatgactgccttagcttacactggaagcttctcctcacgatgaagataattgttactgtaggccagagctcatttctcactgtatgtttcaagaaacatgggctcggggagggatgctcttgcccaggtctttgtttcagctgcagatgcttcctataaaacagggttgagtagccttcaaaagaacctgcacatcaaagtgggatttgaactctttttttttttttttaatgttgctttaggaatgcttaatggaatagaactaacaagtttactttcttcctgaatatactgttatgttaaagtttttaatttttttacttccatgccttctgtgtcttatatatggtggattagttttattgctctggagtgttctaaccacactcatgttttatgctatagttgtagttcatgttttgtatggccaggggcatttcccttgactgcagttaattctaggctaaaatgttttgaatgaagcattatatcgtaagttgtaacagcgtgctcttctcctcttctctaatgtggtaattattcagcaagctatgcttagctcagccacagtgtatcctctcaggctccctaccacagccttcagttctcagttgaacaaattgttacttaaattatacaagagttacatcagtctggtttggtttcatttgggttgggttgggttgggtttgggtttggggactggtatctccacatagggatgtcctggcccactatatagaccaggctgggtcttaaactcacagagagagatctgcctgcctctgcctgtccagttctgagaataaaggcaagcgtcaccatatctacttatatgcatctatgatgtacatgatcctgccagaatcctgtttaaagttcattatgtcctgccttagcctcacctgtgctgctctaagtgcttcttcagcgttgtcatcagtactacaaaggagtacttctacatgggaaaacctcctatagggataggaaagaaaaggtcaagacaaggagctgaaaagaaattgtgggagtctagttaaaataagtcatttaccaggccgtggtggattatgcctataatcccagtgcttaggaggctacggcaggaggattataacaagccaggataattttaattttagccatgccacaaaggagctagtgcttcatagcaaacgggagcatgtgattgagtgtctgcgtagacacagcattggcccatgcgcatctggattctaagtctacacctgctggcttttgaggtgctgtgtgtaacctcccatgggctgtgctgatccaaaaggattttaagaatgagcttcagtggggctggtgagatggctcagcggttaagagcactgactgctcttctgaaggtcctgagttcaaatcccagcaaccacatggtggctcacaaccacccgtaatgagatctgatgccctcttctgatgtgtcagaagacagctattgtgtacttatttataataataaataagtctttaaaaaaaaatgagcttcagccagtgggtagaagagcacagttttaatcccagcactctggaggcagaggcataagccagcttggtctacagagtgagttctaggacagccagggctacacagagaaaccctgttttaagggagaaaaaaaaaaaagacaaaaaactaaaggaaaagaataagcctttctctctccaccccttcctggaggggtgattggcaattaccaggagcagtttcaggactccctgggtggccttttatgacatgctacatggagtttgttgtagatggccaggaggaagcctcgcctctgccacagagaatgctggaccagatccccctgaagaacaccttttcatgttcatctttgaagatctttctatagcagtccaggctacctccacactttccctccactctgcagcactatgtgtccctgcgccttgtcgcaggggtaagacacagctctgacttcagcagtcacccgctccatgaccagctcaccacagtgtggtctctgtattcttaggtctgggagcatgccctgagtggtgtcatagtcgacactgatgcccttgatggatacactgaagctctcctacaatttacaaatgctgtctgacttgctgatcaccaagcaattgctcaggcctctggattgactgactcagtgccagatttgcccactttggcctacatgcagttccaggtgacagagccctgggaggagactccagtttccaggcttccacgcagcccaggaagacgtgttgtacctacccttgaatgctgagttgagagtttgcatgaggggcaggggaagagattggctaggtccctgcaacaggaggacaggtactccctgcacagtgggcttttgtgtatcagccttgatcagcttgccgatgcgtcgcacccaacagtggcagtgtctttaggagttaggacagctggagcagaggtaaaccccattctgtgcacctacctggaagtaccccagagctggggcggggggcaggaattccttacttgttcaaggtcatatcataaaaccaattcatggtgactagttttataaaagtacttcggttgaccacagacactcaagatcatgaataaatggacaggtcacatggatggaaggtgactctggggatagagaggtggctcagggattaagagctcttgtagacaggacctgagttaggctcccagcacccattggagcagctcataagcacctttcattgtagctccaggggacctggcacctgtggtgcgcatgtactcatggtgaccctgttaacagcatgcatttagtaagcattcatctttaagctaacatcttgtgctttaaaattctttcccagctgcgttttaattatcaggtcataaaacattaaatgagttttggcaatcaggcaaggttttctcccattctaactgagaaactgctaatcgtgcttgttctgttgggggacgtgtgaactgcttctgaactgataaggataagaatagttctctaacccttgtttgggtgctgtactggctagttttgtgtcaacttgacacagctggagttatcagagaaaggagcttcagttgaggaaatgcctccatgagatccaactgtaaggcattttctcaattagtgatcaagggggaaaggccccttgtgggtgggaccatctctgggctctataagagagcaggctgagcaagccaggggaagcaagccagtaaagaacaaaactccatggcctctgcatcagctcctgttccctgacttgcttgagttccagtcctgacttctttcagtgatgaacagcaatgtggaaatgtaagctgaataaaccctttccttccccaactgcttcttggtcatgatgtttgtgcaggaatagaaaccctgactaagacaggtactattgaccttttttaaaaaatatataattgtttgaaggaactcatagtcactcacaaagcttgagacttccccaagaggacacaccactcctgtcacgttgtatgagtaagaattaaaaagaaagctcaaacaaaagcttttgtgtgtggcaggcagcagtgtctggctctttcttgtcctaactacacctgagtgtgtagtagttttattgagttgtcagtctagtagcacgcatgtgtctcatttagacagtgacagagtcatgcaaccatcactgtaccgaatctcaggagcactcactcacccctacttactgcggccactagctcggtttctgtctttgagctttttgcctgttctggacattgtaagaaactagggtgttataatacacagtgctttgtatctggtgccttcacttgcatatgtcccagactcctacttgtagatcatgattgctcaactagagtaattttcgggggagggtctttgtatggtccagtatacagctactgccagttgataagcatttggattgtctctgtctggggctgttctgactgtatgctgtagtgagtattaatgctgtttttcatggtgatcgcttatgttcatttctgtgggtatttaaagagtacagttgacaggctatatgccgattgtttgtttagtgttggttactgtttcaaagtattgttagtgtattttccaaagcatcttcaccatattcctgcccactgtgaatgaggctgccagcatccttgccagtgcttgcttagtcttaccctttttagtccagcgtattatatatacatggtcatggtatatatgtgtgtgattatgtatatgtcagcacatcacagtgcacatgtggaagttagaggaaagctgtcagtgattcaagcatgatatagccttgtgtgttcccattgtagctcccaaataattgacacaaagaccgattatgtttattcacaagtgttgagcactgtgactgctcagctactcaggaattctaaccctctaagctgtctacttctcagccacatggtctttaccttcagtctgagttctgttccatgtgtgtcctcatggcaaatgccttggtggtctgctcatcacagtgcttcctgtgccctctgcctcacggccatctcctttcttcctcctcctactcctttcagaccctctccctgggaacagaagttcagtcataggcggatcggctctttattaaacaataagatcactggggagccttctttatgcgagcgatactgatccaggagatggttcagttcccatgacagtgccagcagctggactggaaccagatctctggcctcagaggtcagtatctgaatacacagtgcccaagaccaaccccgtcaacgttgtggagtcatgtctctcctttcccttgtgtgggttctggggatggaactcaggtcattaggattgcacagcaagcaccttaacctgctgagccagcttgccagcccctttcatcatttttaagtgagattgtctctctattgttttgagaattctttgtatatgctaggtactagccttgtcggacgtatgatttgcaaatatatcctcttattctgtggacttttcttattttcttgatggtgacatttgaagcgcagactcttcagtctttggtttaatctttgttgttgctgttcttacgttgtcatcgctgagaaagcctggcctaaccttgttagtccaaggctgcaggcttctcccttggttttcttctgagagttttgtgcttttacttcatgacttttcgcgtgtttcataatagtcaagtgctttatttttaaacttgctgtcctgtagattatatcagcagtcagatctatgaattaccacttttgtttgctgcttcaaaaatttggacaagaattttcatatagtctattgatacttcattgggctacactgaaaaattatatacatcatcaaaaaataataatatccccatacagtaagcttcagcactcactgtaaaactggtggagcatgtatggagggtgggcgtggaagcctttctgcatctgtgcagtcacgggttcttggccgggcttagactcagcttgtctcctggggaagatatttgactggccttcagaacagccctacttctgagatcagcgtggctgctttcactcagacgtttcctcttactgctgtatttgtacaaattggaaatgcttctaatttattttacagtaatgtctgtaaagataaaaagttcatgcaaaactaccctttgacttttcaaaagaaaataacttaattacttacaggattcttgtattcatctaactttttagtgtggctttcaagacaattagcaaacatgttaagttattaacttgaatgaaactttatgattctcttagtataattgttttggagagagatctttagtgtattaagataactatttctaggattattaacaatactgtctttacttgagtctttttctatagccatgctactaaatttttcatatgaaaaattaaactgggctagggagctggcctagtacttgatccattaatatgagaacctgagctcagacccctacctagcattcacataagccacatgtgactgtgtgctgctctaaacccactgagccctctgaggtcactgaccagcttggccagctgaaacagggactgactctgtcactgaaagaccctgtctcaaacagtaaggtgaggctagagagatgactcagtggttaagagcactggctgctcttccagagggcctgagtttgtttccagcatccacatggcagctaacaaccatctgtaactccagtctcaggggatccagtgcccttttctggcctccatgggaaccagacatgtacatggtacacagtcatgcatacaggcaaaagacaaaattaaatgaataaaactttaaaatgtaaaacataaagtgaagttattaaaaaaagaaaagaacaagatgacagcccctggcctatgtgtacacacaaatacactgcacatacacacaaacagtaaagcaagtatttccaagcagcccgtgtgttctatcagaaggctcaacatcatagattcctgtcttccgtagtccaccatgctactctgcaccacgtatattatagtgaaaggatgtgaggagtacacaaactgttaactacatttgctttaactattatgtggcaaactatatttggcattgtctagacagaattacaagtgtaataatttcaatgagacaaaacacactttaagccagatgtgaggatgtatttggatgtatgtgtgtcatttaatcatagtctcaattaagactctgctgctttggagattaagtgttcctggctgtaataatgacagcttcaaatctaattattatttcttgatgtcgtcgggaatattgagaggggcctgcagagtattttagccagcccactcacatttccctccataagggatgaaaggcttgggcccccgctcacctcccctagagacttgactgtaaagtcctcagcattgtttaaacctctctgttatttttattgaatacatcttgtaattgtgtgtattcttaagctaatttaaatatgaacctggttctgaaaagcatgtgatgcacaatttgacatgcatgagtttatctgcagtcacgtgtgctgtgacagtttgaagcctacattaggttactgttggtaaagcctgacagtgcgcctgtgtaacacgctttctttgactgtgtgccatgagcacttacttgaattaataaagtatcaaaggaagttgaaggagactgttaattacttttgattctctctgtaattgtttctgtaacaactactgttcccttttatttaatagtgctttaaaagttaggagtgaaaagagttagcctttgttaccacatactgcattgttcagtctacattttaggaattatctatcttattattatgtcataataattaatcataggtaacatttcccagcttatcagattgaggagaggactccagtgttggatttctcttagagacagtgctttgtgttaggagttgggattgcagtcacacttgcctgttctgctgtgccctgtacactggcccttagctggggtttgctatccactaatttctaacaagtgctgttactccaggttcccatgaatgctgaagtgtgattatctctttcttcattaaagaataattcaagctctgttatgagtttgaagcttgaggccatctggatttctccttggttttcatcgtcttttgaaatggagttttcaaagtttacattggatgtgctgtgcaattaactgctttaactttatacctgctagggtgtctctcactcttagaactttaccttatgtaacttgttagggtttggggggttttttgtttgtttttagtggggttttttttcctctatttttgttcttgttggtgagtttgtgggtttggtttgcttgcatctagtggcccagccctgctcatggtaggcaagtgcttttatcactgagctgtgtatgacccaagccctgagtgaagctttgtgttctggcttcctggtatttcctcacaacacccagtttgcggttctgctctcgtttactacggtattacagtcacttgcgtgctatccatctatccatgagttagcatgaggatgcccttctaagtacaggacaagtctttactgagcagtcctgatacaggacacttgggatcgtagttgagctaagctcctacttgaacatttctccctgttcttcactcacacttttgttgcaaatgctcttttaagctattttttaaaaagaggaaacatcactgccctctgcagttctccttatgccaatcattatgatgtccctaccattatgaatggaatggaagtagctatggtttactatagagtctttcattggcataggaaaaaactcattgctagcaaggagatctggtgacctagcaattgtcgaggtttttaatttgggaaagtataatttgtgaagaattgagttttattatttttgaagatttttaatttaaaacatagttattctaatgtctgagtgatgttacaccttcaggagactactgctaggaaattctgcccagcctttaataagtcagcccctgtcatcattaggttatgcctaagcagtcttaagtagaagtctctctaaaacactgttctttctttcctttgaagtaaagcggtttctaagttttgttgtcctgagcattattgttgtacgacagaatttttcctgggaagacacaacacacaggtatattcactccagatagggatttatagcagagtgaagtatagacaccaccaaagtccaagtttatgaaccagtaggtttattggggtttcttacagaagtgtggctgaggggctactcactggagcagaaatggctcaaagacagctacatcaccaatgccttcccagcatgaatggcaggtcacaaaagctaggaacctgggacaccctgtacagcctgcagacagctcaactgattgcagagtgtcctttccaagttcttcagttggtctaaacccctttcaggtagctggtctggtctcagagtcatctttgcccctcagcttgtctgattgtctttgtagctcagcttcccttcaatgggactcttagcttttattctttacagtggcaagagaggcctagtgaatctggtcagtttcagggacttcctgaagctattttgaattgtctttcttcctgcttgagcgtctctgcagggtagagtgttttgcccttatctgtacacagccatgtgtgtttgtaatgtagtcacttttggagaagttaggtcattgtgtccataattctataagaatgataaccaccagctagttctttatcacatcagagtctatactctttgacaataccttaaaaatcaagaatagatgcctgagacgcagacttgatcatagtttgtgagagtgtctcttacactgtttatgtgttttctaatctctaaattaccagggtgagtctaggaaattggctgcagtgaactggattgtcctgttggcactgatgcagtattggctgatggccttggctgtgtttggtagcctttttcttttgcgttttctctgtgatggatacaagcagcacttccctttggagaactgtcttggtcaccattttatggtgttgtgttaaggtgtgttactgtggaaagatttattgttacgttctgggatagtgaaaacaggagcaatactgagaagtaacagggcatgtgtttttcaatactggaattagaatttcctttttaatatgtaaccatcactatttggcttttcctgttttgcctgttgtttttaagtaagctttgtaactcagctacctcacgtttctgctgctaactaggtatgagtgacaacaggatcccggagagctcactctgacagtgctgctgtccacatccctgctgtcccacccaagcctgttacaccttcacttcgtctcctacctaggctgtccccatgctgctctccattagtgcggagagagaaaaggtctctttcatcaggtcacttcccttactaaaggtcttaaaagcctcttggtgacctggaagactgacagtcctaagtgggtggtggcgatgttaagtgattgccctagtcccttttcatttcttttcttctggggctttcctaactttattatctttgtgtagttgatcagtcatctagacatgataggttgggtttttttttaatgtgtatactaaactataggctttataaataaaaagataacaataaattttaactgtggaccagttagtgaagaaatccaaattatttctgataagtgttgctgagctattgttttgcacaatttgtctttattattgctacaaattctcagctgtgttgtttacatccagtttttagcatttattgtatatcccttaaattgctcatagttacatggtttttttactcatgttttagtttctgttagttctttcaaaaatgttagctctttcaaaaaagactaagaacttcctctgattaaaagcataatatccccaaaggatatttgaagtcatattcttagattagacatatttttgttcttagacattttgtggctttttataccaggaggcttaaaattaaaacttaacctcataaaatggactaacaattgaggtgaaaagaaatagttttcatttcttaatttgtgcttggtagcctcccaacaacacacagaagaaatgggggtgttgagccagtgttgcacaccagctgcaatcccaacactcaggagcggagtgggggcagggtggaagtgccaggccagccagagctactgatggccgagcttctgtactctggtcactcatgaaaggaaaatagtcttaaagtgagcagaggagtgtgcctctgaggagtcaagtttgtcatgatgactgtcctggtgccttgttgttgaggggtagaacatctgtcgtggtgactggtaactgtcctgatgctttgctgccctgtgaacctgccactcgaacagtagactcttttgagaaattttctttttagttcaatagttaatcagggttctttggggggcttgttttttaaaactatttttatttatacttgaacaatttcatatgaatgcagttaccttgatcatacttaaaccaaatcccagtatttccatttccttccatgtcttctttgttgttgctgtcctcctcttcctccttctcctattcctcctcttcctccttcctcttcctccttcctcttcctccttcctcttcctctttctcattctcctcctcctcatcctctttgtccttcagtaactccctcagttcgattaatgctgccggtatgcacataggtgtggggctatccactgatgccaggacatcctcccatcaaccacacactcgaagaataatgagtctctttgaacagccagcaactgtcaataactcctcagctctgggtagaaatcactgagcgctccctcccctatccatactgtaaagttgactggtttggacttgtccaggtaaccatagctgctgtgcattcctgagtacactgtccatgtcacatccagaggacatcatttcactgcactcctgcattgtctgatcatgaaattctttctgccctccaccacccccaaaatacatacttctgtgagttgtgagccttgagagtaagagggttgataatagactgcctatttagggatggacatcagtaacttactctcagggcttggaccagttatgtgtctctgtatcactacctactgcaagaaccttctctgaccacagtttagagcagcatttatccataggtgtaaatataagcatgtagaaaccagttcaacagtgtggctgtttagcacaacaaccatagtgtgttctccactagggctggtggcctccccagccagggaacattgaccaggtttacagagcaggccttgggtttaatcagaaagactcccataaaagtcaatgccagtatttcaacctcctgggcatatcttgtgtggcaggtcagtattgctgcagggaccaccactgggtagtgctattgatggtttttctcccccagtggcctgtgtagcgcctgccagcactaggaaagctagccagcagggaagaatttttcaggtcagttccaaattgatttctctatgtcctacaactagaatgtgtggtgtctttaccaatatagccttactatctagttatggtgggcaaccaagagcaatggcaggaccttgtgttgtttgggtagtctgtggagctaataacttgaagggagatatcccagacctagcactgaaatccttacctctatcaaaccttggattcttgatatgaattcattgttatcaaatgtctgttgccctacttacaataggctcatttcaaaaccttctttttaaagattgaaaaaagtttttttaaaaatttgtgtgaatgttttacccatgtgtatgtgtatatggcacatacatacctggttctcatggatgccagaaaagatggtaaattcccctggaattccctggaacaagagtgacagatggttgtgagccaccctttgggtactatgacccaaacctcagttctttacaagagcagccagtactcttaacccctgagtcctatctctagccccttggaaaacctcgagctagggactgcttctgtatttggtggttgtgttgtatcactacagtgtctgagattccatacttgcatgagtttgattgactacatttatgttaacctttgccccagtgatctcacgtcagtgacccttacagttattatctgcattcacggttaccccacatcagaagacactaatgccagcttcatgtttgtgatctatgggtctgtagtcagcagcaacagcaacaaggactgacttgcttgggtttattccctatagaccacgacggagcggcctttcatccagaagctgttccggcctgtggccgcagatggacagctgcacacacttggagatctcctcagagaagtctgtccttccgcagtcgcccctgaaggtacggtgcttagcagctgcgacacatcgctgccgttttctgttctaaacctttgatttctgaggttaagtgagtattctatattggcacattttaggaagaattttccttaccttttaagggaaaatcttttgttttatagcaattgtcacaaaacacgaagtcacttctgtctgacaaaatatacttcctgtgctctggggctttgtaagtactattctcatgcatttgtatacttgaaaatcagtacacataaacatgtatttgagatgcttggcactcaagagtgttccaaatttctttcagaagttgaaatatttgcatacatgtagcgaattattttgcggatagaatgtaagcttaaatatcaaatttgtgcacacatacccacctacctatatgcacagcctaaaggtgatttccatggtatttttagtgtgcttacatttttatgtgtgctgtcacgtgcggtcagctgtggaattttccacatgtgctgttgcgtcagtggtaaagtcagtgtgggcatttcagatttccacccgagagctgctataaatgtgtacatgtatacacacatgcatatggacatgtatgcgggtgtcctgctgcttttcgcacccagccattgcccattaactcagcagtttgcagtttcagcctcgtggtctattacaacattactgattacttatgtaagaggaatcgtcagccatgtacaccatgttcatttacacaccaagcaggctttctcacttagacctaggagggaggaggtaaggaattattaaaccttatctaaggacgtggttttcctgagaaatagaattagagccagtgtaggcttggagacaggactaaatcagaaggggtgacaaggcacatcatgaacccagcacagagttactgaagacagacaagatttatggtctcagagggtcacttgcctcaccttagcgcctagactactatcagagcgtctcatggtaagtgttcactaaccactggaattcctgaagtccttgtgtaaggcttagctcaagcggtattatttatgataactaatttgaggtaacactaagtttttgtctggccttggtcacagtcccacctcactattttataatgttagctttcattaaaggctttctgccgttcaatatatttgatatctcagcagctttttaaagtaaactctacagagctcgtgtcagaatttggaagagaacatttttgtcccctcagagtgctcccttctgcacacttggagctgttagctgtaagcagccattgctcaactgtctgtctctatgatttgccttttaaaaaacacttcctataaattgaatcctatgctaagtaggcgtgtagcccagcgaagcgggtttgtgttgtttgtctcggtggcgtctttttgttgaggactgctcctgcttaggtggaatgtcacagagaattcattacacctttttacctttctgattaattcagctgtgaacattggcatggatctttctgggaacatcttttcatttccaggacaaattcccagaggtgggatgacggggaccagcaggcagtgtgctggcctgctcactgtctcttccctgccattcccccacgggactcaggaaggcttcggtttcttcacaccagtgacatgttttatagtgatcctgatgactgtgtgtcggcatctcacagtgatggctctccacttccctcatttgaatttccctactgataactctgtctgccgtgtttatttgtgtaaggaagacaggctatctggtgtgctgagtaaacgacggctgccggctgcggagccgcagcttctgatcacatgcccttattttcactcccaggcccccattttattactttcccaatactctgttttgagaaatattttatattctggaagaacttgggagggttttttttcacacaaaatctatggtctgtctttttattagatattttctttatatacatttcaaatgctatcccgaaagttccctataccctccctccaccctgttcctctacccacccacacccacttcttggtactggcattcccctgtattgaggcatataaagtttgcaataccaagaggcctctctttccagtgatggctgactagggcatcttctgctacatatgcagctagagacatgagctctgggggcactggttagttcatgattgcagaccccttcagctccttgggtgctttctctagcttctccattgggggccctgtgttccaacttatagatgctgtgagcatccacttctgtatttgtcaggcactgacatagcctcatacgagacagctataacagggtcccttcagcaaaatctttctggcattgtgcaatagtgtctgggtttggtggctgattatgggatggatccccgggtggggtagtctctggatagcccatcctttcgtcttagctccaaactttgtctctgtaactcctttcatgggtattttgttccctattctaaggaggaatgaagtatctacccattgatcttccctcttcttgattttctcgtgttttgcaaattgtatcttgggtgttctatgtttctgggctgatatccacttatcagtgagttcatatctaatgacttcttttgtggttgagttacctcactaaggatgatatcctccagatacatccatttgtccaagaatttcataaatctactgtttttaattgctgagtagtgctccattgtgtaaatgtaccacattttctgtatccattcctctgttgaggggcatctgggttctttccagtttccggctattataaataaggctgctatgaacatagtggagcaagtgttcttattaccagttggaacatcttctgggtatatgcccaggagaggtattgctgggtcttccggtagtgctatgtccaattttctgaggaacctccagactgacttccagaatggttgtacaagcttgcaatcccaccagcagtagaggagtgttcctctttctccacatcctcgccagcatctgttgtcacctgaagccattctgactggagtgaggtagaattctgacggctaaatagttttaattctgatggaattgtattcagtttttagtgggttgtgtctagggctttttttataatgtcttctagtcagtagataatatatttgtgtgcttataaaataaaagttggtgtgaaggagctcagagcagttgctctgccttgggtcccgtttggaggcacagtggcatttccccatgcatctaattcctgtcgcttcaggttttggaaattgggaaccttcgctggtttatgaatactgttcccgcactagttagaggatgacaggcctgtgagtgtcctcactgcatcccaggttgtggaacagaaactgatttcctcatttgaactgtggtaaggccctgcccatgttctctgtaagagccctctttccttgactagctcgcaggtggtctacaactcactgtacagaccacagccatcctcctgtctctgcttcccaggggctggccttacagacatgtgctaacatgcttagccataatctgtttccagaaattagtaattttaggtgtatttctttaaatggccctgtgggatccttgattactgagtgtgagaccatcacattaaaccctgtctccagagtgtaatgagtggcctgtgtttgctgcaggtaggtacacttgtgctttgtttagtaaaagtaactttatttatttttttttatctaattttttaaaatgttttttattacatattttcctcaattacatttccaatgctatcccaaaagtcccccataccctcccccccccccacttccctacccacccattcccattttttggccctggcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctccctctcattcatacacacacacacacacacacacacacacacacacacagagagagagagagagagagagacagagacagacaacccttgagtgtgccaagaggacaggtcagaggacaactttcaggatctcctactatgggctctggagatcaaacgcacagacataacatgaagacataacacccatataataaaataaataaataataacaaaaaccctttaacctgcagccgtgcttcagactgtctcaggtgttgtgagtgaatagcaggcttctcccccaaagcagccagccaagttcgttggtttatgggagcacccatgtttcatagatagtcccagtacgcagtgttaagtttcataccatgattgagcacgtcctcaattctgtctttttctttggaaaacttttatcttttgcctcttttcatttcatatttatttttaggaaaaaatcatttaaaatctgtggagagtaatcagaagcttccagtctctgagtgaagagcgactctgtgcagattaggatacctgaacactgtcagtgtgtagcattttgacatacctgcactcaagctgaaagtgaaagacttgaaacttgggtgtgcatggataagaactagctgtcatcacattataaaaagagaaagtattcaaagaacccgtgtcctgcttctccctgtgagaagtgaatggaacgtggaggaatatgtcttacgtcatggtgacagtagaatgcgctatattatggcagcgaagctggggtcatgggagtactgcagtgagctgctttgttctattccttctgatctgtaagtagttaggggaattagccaagatggaaaaaagaaaccaaaggtgagcacaggtacatgatgcctgtggtttcagtggagttaaaatgactctgaggtctgcttttctgttctaggccggcagttacacaccttcctctctcagtatactacgtggcagggtcaggaagcaggcccagccatgtgcttctggctggctgggcacctgctgtcagcctccagcccgagtccaatccctgggagccaaatgatggaaggcgagagataaactaaatgttaatatttaaaaagtcaaagaccatatgcttaatttttatttagaagaatataaaatgcctataaattttgctgagtcatattttatttcccaatgttccaatataattataaaaacctagtaagctacatagtgtaagatagtgtaacaagcctgcattctttttatttttcaacattgtatttttatttgggaattttacacattgcatgtttatcacactcacttctcggtccttccaggtccaccaccactcttgttcccttccccaaaatagaagggaaaaatatgcatagtccaatttgggttgcccatacactcaggggagcatggtcaaacttttagtggccagccgcttaaagataaccccctgcgtgtgttccccctcccccacgtgccagaagctgtcagctgtgaagaggtgcacttcagcatccctatcacaatttttaagggctttctgcaatggtttcctgtctagactgacaaaccttcattcttggtttttagaatttccttcaaggtttcattgattaattatttgtgttgaactattttctcgtggttttatattcagtattacacaaacagcaaggtgtaaagaaagacttggtccatggcaggttagtcctagtgtcctccggctctcctgagaggtggatagctgagcaagcgatctgccctgtccagttcctcccgacggccgttgtacttcttactctgtgacaccctagggtcctttacaactgttgacttctgggttccatgtgatgacttaattttatctcagtcactcactctctcagggctgtatatcttgtcttgtcgctctcagatatgaaagatacatcgtgtgctctgtagaaagctttggtcaggcggaatgggcaggaagttttacagctgtgggtgagccacactgaggatgtgctgtgcatagtgagggaagagtaaagatggaatcttaatgaagacgaaccgaaggcagacagctgggaaggaaagggctcaagccacacctcacatgccactgtaaagcccttaccatgtgtaaggcctgtgtgtgccacggagcctaaagaaaggctcctgccactctgtttgagagacgtctgccttcagatatgcctgaaattgccgtaagctcagacactgtggaaaggcgctgtggaacacagtgaaattgaggcgagggacttggaatgtccaacttaggtgatctaacttcaaaattgttttctttgtgcaggtcctgtgtgtgtgtgtgtgtgtgtgtcacagttttactatttagtgaccctctgtaacttgctgtgtagaccaggctagtttggaactcattcagctgcctccgccttccttgcaaatgctggggttgaaggtgtgtgccaccaggcctggcagttatcttatttttaataggctttatgagaaaaccatagaagttcaaaaaaatagaactttagtgaattcatatttttccgtactcttcatggtgtctgtccggtgattctccatatggagtgttgatttcagacacagcagctggggtgggaacacaaagcccggaagtatcctcaggcggtggacaggattaaagacccccatggctgcctgagagcatgagctgtcactgcagttagcagtcacatggtcgatgggctctgctcccacaggagcaagcatggggatgtgtgagcacacatcagaactgcagccctgcccctcagatggtatggaaggatgaggctttatagctctagtctctttctcaccacagactgaactaacgtctatctgtgcgttcctcccatttgaattggacaatcattaaaattttaacagatctaggtgtctaggtttatgaaataagttagtttcctgttgcattctgtagaatgtcagacaacatttccatgtgaaactttaaagtcttatatttttctaaggttttcagttagcctggtatttcttttgtataggtttgctaatatatttttacaaacaaaattttatgggaaacttagaaaggccaattataccttcacttatgggaagacttccatgccatggattgactgttttagaaactagtttctagatggaattagacatgccacaggtgtagtcccagaaggaaagagaagcaaggttggccacagcgccaccgtcacttcatgccctggagcaggcttgattgtcagcatataacttgctgaagcatagaggcccagaagtaggttgtagattctgttggtactaacggagcgtttgccattcaagaggactactgtagtgatccacacagcactgggtcacccctgtagtgggagcctcctttgtagactcttcccagcccggtttttgttgttctttattcttgattgcatttatattttatggaagaaacactgtctacagtgggaagtctaaaagcaatttaaatgctggccctctgtgagcaaagatctactataatccttgttaaggttcagcccaaacttggtaattatagtttactaaatttatcacgcgctgtaaatataaatgagtcttgaatgctttcctctctgtctgtcctcatgctttgtccagcacacaggcacttctgactggtcttgctgatacagactctcttcagatctacatccattggtgtatgtcttttctaaaatcaaaggacgaaaatgattattttctttctctactaatggagatgatatgatactggatccaacaaaagatgcctctgatttcctttccatcattttttttttatcttaatctcaagaagctaaataagttaacctggattttcgaaaagtggaaagcatgggcttgtgcaacccttactctgttgctggcactagaaaatgaagttgcacacagttgtgtgttctgaggtctgtggtcctcagccttgtcacatggtgcagctgctctgccagtcccatgtactgtctgccaacaacaagctcaaagctacttggtccctttatgcagtcacaacagtagtgtcttgggtgaggaaaggctccgcaggtaaagatgcctggtgatgtgagttcagaacccaaagtggaaagagaagtcattctacagttaccctctgcctgctacgcatgtgccgtggcacatgcacgtatgcacatacaatgcacaaacagcaataacgtttttaaggaaaatattttgaaccctccagttttttaattgtatccattttttaggtgaacaaggccatgtttaactttcacctttttaaacttgatggtcatgaggctcttgatcagtttgtttaaatcatctaacagtcactatctacattttctattatggctaattatatggttttaattttaaattttggtttatgtctttttcatataatggctataagcaaaagtcaagcgagtgcacgtgcctaaaagttgatgataccatctaaagagccaaggctctgaaagtattttagaaataaaatattatatatgctaggtagtttgtacatggaaaagggatccggggactgtgagtggctccttatagctggcgctgagtgagcatagacccggaagatgttaatggagtgccgtgaaaggctgtagctctctgataaacaccgctccttctgtttgtgatcacggatgaaagcccagtgctcaggaatgctcgttttcattgctgcagcgtggagtgtgctcttaagatgaagatctcattccccaggaagcatttctgcgtaagattaattgcccttttaaaatcagtgtttgatgtattcctttggccatatcctggcttgctttaacccccgacctgacctccctgactgttgccaccgaggccggccgagtcagagcatgatgtatgcacttcagatttcagcctgggctgtctcgtggcagtggcttcaggctgcattttattcatgaacatatctgaggaatttgtcagattagagaaaaattgttcagactagttagtggtaatcaaaaagcttgtctctttatttattggtcttaaaactttcttacaattattaaattatttttaacaaaatttgttcttgaatcataaactacccctgaagctgcagtagttaaatcgggtgtcagttcacttgatctgagctttctgttcctccatatttagaggtgtgaacctcgagagagattaatccaatggaaacttctcattgaaggctgtgctccttttcatcctttcctttagcatcctttgtaaactaagattccaattgtgtctgtcagtcagaaagaaactgcaagatgtcccgagaaactgaggcagcctgttctaaagaccctcgtatgcttcttgttgctgtctgcctggacctgagcactctgtccccagcaggccagcgatcagggggtgagctctcaggaagcaggctgaagagaacagtctttatagagcaacgttgtttctgtttaagtggggtttgttgtttggattgaataaagatttgttttgttttgtttattgtttgtttgtctgtttttgtttggtttgggtttcttgctgggggggtggttggggttttttttgtttgtttgtttgtttttgttttttttttttttgagacaggctttctctgtgtagcactgtagatcaagctggccttgaactcatccttctgactactgggtttaaagggtaccaccacttccctggtgttggtttgcttttgttgttgttgttgttgttttttaatcttcttaaaatgaatcttaaagtcttttaaacaatattatcataatatgtcagggctcccttgactttaaggtgtggtatttcactggatttttatgttgaatatattttgtatcttttgaattattttgaatgtcacataatttgtatattactgagtctggggttttgttggccctccccgttgttttttttttgttgttgttgttttttttgtttgtttgtttgtttgtttttgaacaatgccaccaaataattagaggctaagttcttataacctcttggctgccaatcacataattaagtccatattattttatagctcttggtggatatctagtaccaaagaattaacttcttaccattcttgacagcctagtcctccccttctctgaccccctttcttaacctgctctcccactgactccccccaccctcacggtcttctgtagccccgcctgggctggaattcgctgtgtgaccttgaactctggttctttggtttctacccgctgtattgctgggattctgaatgtgcgctgctacagccaacttgggcagtgctagagatcacacctaaggcattgtgcacacttagcaacctctctaccgcatgactctagctcagagctcattttcattttctctataatattttcataccctaggaagggtggagaaatgaactaacttcattgaatacctgctatgtccaaaccctcttgcagcttcaactggtcttgctgctgcttcctcccccctcctcctcctcttcctcctcctcctcctccttcttcttcttcatttatatagtgtatgtgagtacactgtagctgtcttcagacacaccagggggtatcagatcacattgaagatggtttgtgagccacctatggttgctgggaattgaactctttatcactgagccatctccccaacccctgggcttgctttttcaatttttcttttattcttcgaggagccgtagagatgagtgtttactcactctctaagatgaggaactggaggcgcattcagctagattctaagctagtaaatgttgatggccgacgtctgaaggagagtttgctgttgtggtgtgaaagagtgggatcctgattagaactgggaggtcttctaggactttatagagcagaggtttgcagcctgtgacactcagctcatggagacctaggtggccttgggttctgagcaccagacaggacttggaatatgtctcagtcatccgtcagccttcactgcattgccaacccagcctcctcaggaaatgtgaagagagggtgtgttgtcttctcttgacgtgtgcagcatgtctgagaatgcatgtcactgaggttcattgagaagggcagcagaggaccagccagcctgtttgtttttcttccattaaccttcctcgtgctgtggtggtggatcagagtgtgaactaggaccctatatgcaaccttcacttcctataaaatgaaatctcagagaaatgaagctgggcatccattcccagggtggggattcaattaatgtatctgtcagtagcacctgtctgcatgattggcctttctcctttatgcctgatttatatcattgtgtgcatttattcttgttgtacatatgtctgtatactggccccatcccaagaatcctctgtttagttacttttagaaagaagtcggaaaacaaagcaaaggagaaataccgatgaagtgttggattgatacgtgctgtgacaactgtttcacatcgttgtcttatccgtcttgtctttgctttcttctcctttgttttgagatgggatcttatttagtctacagagtaagagtattaagagaaccatacattggaatgttttcaggtagtataagagctgttctaaggactgtgcctcccatgtgctcagagttcaaacaaggctaccatgccaggccttagctcacaccttcagttgttctgaagagaggtaggcacaggtaggcccaacttaggtgtccaagattagaacacattcatgcaagagttcagagtgaccccagcctgcaggctggagacgcagaacttgccttcccagcacacgatggcacaacaaggcacgtttgatgcagttagagtgcctctcatgttctctggcttgcaccagggacagactccatctgctctaacgggattggtggcctgccttgtcaggcacatgtgcagcaggggctgggacacacgcagtgaatgcgagctggtgtgtagtgctgcgtcaggacctgtgctgagactgaggagtgcctggttaggctttactcgcacagggctggctggcttgagaaactgcgcacagagggaacttttactctcaccacgctttcggtttttgactcagttctaagtaggaggaaattctgagaatattaaaatagctcaaagaaatatataataagaatattaagagaaccatactagaaacgttttcagatattctaagaaaccattctggagaacttcgtccatctaaacactggttcttcagtcttctgtgctctgtgtgcagctttgccttctgtctgtagatgcttctgaccagcattctggagccattctttgtattaatgctgtgattatagctgcataaaataatgtctgcatagatgcaacaaagctggctagagggccggagaggtggctcagcctttaagcgtgtgctagtcccaagtcgcatcccagcacccatgttggggagctcacaatagcctgtaactccaggtccagagatccaacaccctcatctgaccactggacactctactcctgcacacacccatttagactcagatacacgtgcattaactaaataatacaaatagggggttttgtttggtttgtttgtttgtttgtttgtttgttttaagatagcttagggaaaggaaagcaagagaggcaatttttaaattatgggtccttaggcagtggtctttccccaaagttaagctgaactgtgacagggataagggcaagctttgtttagtcgtgtttgaagttggtagctggtaacatgcttatcaggtttttaattttcgacttctcttttgactgtagtgcttccatgtctgctgttgctctctccctgcctacccacccttcagcctctgaaggaaggctggatatttctttaaaggttctgctttcgtgtggagccaggccgtcccagcccttagagcagtgaagggcactttgagtagaacagaaataccagcagcagctgtagtggtcctgcccaccagagcttgccctgttctccttggtccccaggatgctgagggttgcccttatgttttgaagacactgtcagggagttgtaccgcagggtgacaaattgttcctttttttccgttttggttatttttgtttggttgggggaggggtatgttgtcgagctgttctttacattgggggtttgtttgtttgtttgtttgttttgcttttttaatggtaatacaatttgaatttaaaggtattaattgcagcatcctttaaatttgtattatgtttgaattcattttagtgtagaggtgattgcccacatttcttggtatgagtatggaggtcagaagacaccttgggggactaggttctctgcttctaccctgggtgtcagggatcagactggaagccatctggcctgccagtgagtgcgcttctcagttgagccctgcaaccagccctatagttctattttaattagcaagcaaatattagtaaaacctgatgaggttttgggactcttaatgaagaatctttaagtcagattattggctctctgtgatcccagctttaattgtacatttttttattactttcaacactatgggaaatacttgagcacatttcagagaatcagcaaagcacccagctgttaaacatcttctcgaattctggtccgattctggatcacttctgccctatatttttaagggtgtgttgtgtggccttccacagagttgccattttaacagtcgtctgtggtggtttgaactgtgtacctagagtattttggtcagtgggttcaccctgctgttttctccagcatggtttcactaacgtcaatctcaggcaagcacagtaattaagaaagaacaaacactttcgcagagcaacagaatttttatcagaattcactgtagccctcaggtttctgtttaggatgagacattttgcaacatttaaactttctccttgtcttcatttcctgttgaggggatagaacaagtttgaaatccatttaattcactgaggaccctgaaaaggcaagtcttcctctttccctgtggtttttactgttggatctctttcttggaacagatggagagaagaggagccaggtgatgattcacgggatagagccaatgctggaaacccctctgcagtggctgagcgagcatctgagctacccagataactttcttcatattagcattgtcccccagccaacagattgaaagagtgtgtcctcctcgctagatggaaccaccttgagtcaggacaacgaggcgtgacacccttgcttcagtcaagttcagtggaggcaacagaaacccgggctgctgcaagccaaggaggagaagattccatgagagatagggcgcccgggcagggctgagtgtgcaccactgcttcgctgagacacacaggaccactgcagcctcctcttctcgtgaaatgcaatgcagccgaagcctttgctcaatgaaaaaaaaaaaaatggaaatgtgccacagtttgtatttctgattaacaaataagtggggtatttcctaaggtgaccatggtggaaccttaggcaggagaatggaaacattggttgaattttcaatagaattagacttaagaaagtaaaagagaaattctgttattaataacttgcagtaatttttttgtaaaagatcaaattacagtaaacccatctttccttaatgagactttcctgtttacagtcagtctattggtatgcaaacaatcttgtaactttgataatgaacagtgagagatttttaaataaagcctctaactatgttttgtcatttaataacatacagtttgtcacttttcaaagacctcctgaatctcatagagtaagccactttttcttctgtgttcccatttctcactggcatagcaagggtgcggggcataaggcgacttgtctcaggagctgtcacaggatttattactgtgacttgaaaaatctgtcttctatatactaaaggtataaataatcctatctgtctttgctgttacgttggtcactgtaaacctgtcaaatcatagtatgccaagtatctgtctatgataatttttgaatattttgaatctcccgttcctttccagtgtttttgtttggtttggttttggttttttgttttacgtttttgttttttggctcctggattatgtcattgtggcccctggcagccagtctttaaagcctgcaggtgacctgtctctagactgcagtagcttttccttatcattaccaaaaacatccagaggttactggaactcctaccacagtaaggaaagtttgctgcactactctcgatggctgcttggagactcctgctgttgatttgtgagctagcttgctgtccacattgaatgtcaacccatctgagtatgctaaaagatgatatcataaaataatggttctagattcaataataaagatgaatgttttcttataaaaattatgtggtggctcaagtgaggtccctgatagcgctccttcctcctttactccttcccctgtnnnnnnnnnnnnnnnnnnnnctcctttctccttcccctgtcctctcccctggccccctgccctctcccctatcctctcccctggccccctgctctctcccctggccccctggcctcctgccctctcccctaccctctcccctggccccctgccctctccccctgccctccttagcttttgatcttcactgatttacagcacattttttcacaaaaatgagataaagttggccaaatagcaaatatcctagaatggaagttgtaagcataataataaaagaaataacagtgagggtcaatcacagaaaaaatagaagcgagcaggaaagcattgcctgacaaaacaaagcgccctttcagtaaaggcggggaaaagagcaccctcagttacataaggagaactcgctgacttgtgcttctgcacattggtctgggtatgaatgaggggattttcccctttggagttttgacaaactgaggagaggttactgaaggatcggatgccagggagggcttgtgaggtgtgctcagaagggtagccatggtgacttttgggtgacactggggtaagggacctccacttgtagattaaccgagtaaatcccaccaagccactgccggccagccccccggtgttcctgctgccaggagcatctgcagcctggtgagctaaggaccgggcccagtgaccagagacagaataaagccaggaattagtgctggctacaatacctagtttttatttgagcacttaagtcttatggcctactaaaaagctaggtaaatatgtttgccttcattcctaggagttgggagtgaaatatttatagagcaagattgggattccctcatcttcagactacaagtttctacagagatgtgggatgagggataatggagaacgaatgggctacgggtcttagtaggtggctcactctgagaatgaaaaaaagtaagttcttggctttggtgacaggggaggaattcagagcctaagctactacttacctatcattgtgctcctcgaaacttgcatgaccttgctccgaccatagagagcttgttggaactgaagcctggtgataaggatgcacagggtatgtccctgaggatgagggacaagtgtccccagccatgttgtgattttcccaatcagcgaaactaagtgggttatcctaagacttcaggtttaacattgagcaattagctttggggtgggggtgggggagccacagcaggagtgggggctggctctctccttccactcctggtcccagagatagaactcagggtgtcactcttggcggcaagcacccttaaccacttagctacatcttgctggcccaccaataactcttaatggttatttttctatggtatacttgtttaaaaatctgttcagataacctatcttctagttttcaaaacatgcagtacatgtggctcgtgctagataatgcaaattacattttctcagactgttgatgcttccgttctgagaggagccgggtctcccattacctgtggcactgtaattcaaaaagcaggataaaatccctgggtatgaagggagaaaaatcaaatatgatcatatttaaaactgggctcatttttatgcaaccacgatgacaagagttgttctcaatacaagttctattcctctctgtggtcttttttttctttttttctttttcttttttttttttttttctgctctgttctgttttttgagacagggttactctgtgtagccctggctaacttgtaactcactctgtagaccaggatgacctccaactcagatctacccgcctctgcctctgaggaatgggattaaaggtatgaaccaccaccacccggccgtctttattttcagatatattcatctggcctgagaatgcaccagaagaaggtggaggaaggagaggtgtgtatcttgttcagattattggagagcagatggcaccctgtaattacaggtcatcttttgtgatacagaagtgacaggcaggtagtgtgagctgcactcaagagcttcgatggcttttaggctagcacgtgtggtagggatgctctttccagctgggcagcaaagggaatccccaagtcaggcagtcctgagagcaaacataacatttttcagtgtgctgtgttgtaaagccaccaggttcacatgtgtgtgaatcagatgcactgctgttgagttggtcttgagccctccatgtagctaacagttccctggaacttctgttactctgcctatacctcccaactgctagcactacaggtaagcattaccccatatatttttcaaatgtggtttttctgtaggatattttcagcttgcccgtctgaaccagagagaagccataggaagctctttatcatgatccttcatatgactgacagatcttgcagactcaaatacaaattatatttgcttccccagatgtactagcaaatgtactaatgtctaaccttgtaatcacacagtctgtgtttaaacaatgaagagactcactagattcttaggtttttaatactgagccgttttaatcttatttgtgttaaggtgataacatatcaaggtaagtctgggaatttgggacatttcagtgtgctctgacacatcccctgaccctctaaaagggcttggtgtatagctttctccaacctccagtcacagagccaaaaaccggtctataaaaaggcataattaatggctaatgacatttttaagtaggtcttgtgttcctgtcagagttaccagctacaaaaataggacagaccctgtcatttagaaatcagtatacaaagttcagttggttggggttggcatcaccagtggagacgtgcttactcaaatctgctctcagtaggaaccgccacggaccgggtccttgcgtcagcccacattcattttagctgttgcgtcgaccacagtgcaggcctgtttcagcctccctttgagcagctcctcagctgctattctcagccagcatctggaggtcttcaccagtcctgaccttttcatagacgagtggtgtgtgccgagcttgtgctggaggcgttgcgtctgaaaaggagagttgtgggatccagcagcatctccctacctcctggcgctggagcaagcacttgggtcctgctgagttaagcttagagtgtgaatcttcatcccctccccaggtcccagcagctctggctgttcactaggaactcgggcctgagtcatctccacgccgatgatttctagctgctcgttccttcatcggaggtgacccattttgtcaatgtcacttccaaaataatttactaggtttatattgactatctgctgtcttgccaagtactcgggaattcagagccagccccgttgcagtctctgagcatgggaatcatatcgagagcattggctttcgggcactagcgcatgcaacaggtacctttgacctctagctggctttgtctggacttggtaggagtggaggtcctggggctgtcactggaggcttttgtccacctggctctaatatctagcttgttacttttctgttgatggcttttttttttccaagacagggtttctctgtgtagccctggctgtccaggaactcactctgtagaccaggctggccttgaactcagaaatccacctgcctctgcctcccaagtgctgggattaaaggcatgtgccaccactgcctggtgttggctgactcttctacagagataataactgtgatttgtagacgtgtggactccctctcattttgtgaagatttagggaaacttcccgttccagaggatctggcactctcacacagacatatgcatgcaatcaaagcatcagtggacataaaaataaatgtcgtttttaaaaattcaaatataaaatgttatcctggcacaggcatttctctaatctgggtcagtgttttgaagttcactgctgtctgaagtctttcataggtttcaaggatgctggttcttaagtcggcaggtgtcactaaggcctgatgagacagtaaaagtgagacaaagggaatggaattagcagccagcacctcagatgctgcaagcccaaggattagatgtatggcatctttctttcctatccaggtcctatgaggtagtgcacggcagccttgaaatcatgcctctcctgccctggcctcctgggaggcagcactcagcagctgcatgtgacataaaaccattgctgccatggtacaccagttgctgctatgtgctagacagactctggagtttatagacatccatgcgacaagcgcagagatctagggaaacggttgcgaaagttgtgcagcaaacaagaaagtgtctgggaaggcagcagacagaacttagctgcagggagatactttgaagaggcgatgggaaacgctagcagggctgcagcgggagggactagcttcggactgtggggtgactttggcggggatttgactggagcacgtttgacagctgaccacaccttgtttcattcttcactttctttctgctcaccacaccctgcagctttgcttggctcggccccttttcagtttccttcccttctcaccttgagtgtggtgtcccagcggtcacctggggggggggggggggaggctcttcctctaccgtacttgaactcatcccaaggctcttttgttgtttttaatgtgaatgcgtagggcatggtggcttatgcctttaatcccagcacttggaggcagacactggtgcctctgtgagttcaaggccagcctgaactacatagttgcagagagccagagttatgtagagaccctgtctcaaaaaaataaaattaataaaaaaaaagaagtgtttgtgtatgcttttgtggagatgctggagcccatgggaaccagatggtgtgatataccccagaactagagttagaggaaggtctgagccaccctgtgggtgctgggaactgaacccaggtccagagcagccaaggctcttacctgctgagtcatcttcccagctccacaacttaggccattttacacccttgttatcaccaacagcgacctctgcactccaaacagtactcagccacctacttgacatctatgtcagttgaatagcaattcaaacttgagcatcaaagcagaattcttgactcccctgcctcagacccccacctgtcccgttcttccatatctactcagctctgtggtcctaaaatgggagtcagcatcagcaccacacttgccctgctcacccacaccgtgtccatcattaagtcttggagcagctacacaccagctcatccggtctgctgcagtggccttttacctggtcaccctgtctccagtcaatactcagggaaagctaagtcacccgtaggtgagtcggaaactatttagtactctcaagtgtgtcctgtgccatgcaagacatggtaatatggaagagcatgtatcatctatctggaattacttaggtcttctgccctctctgtggaagcctccctgacctagagttgactttgggccttcacctcttgcgttcccactcatgttaattgctccacagctgttccttggtaggctatagagctctgtgagagccagatctgtctgcctaacacagtgttgtaatggcacttgggggtagaggcaggcggatctctgagttcaaggccagcctggtctacagagtgagttgtagaaagctaggactacacagagaaaccctgtctagaaaacaaacaaacaaaacagaaacaaagattgagtaaataaaaataatgtttgctcgaggtatagagagaggggcaggtgctaaagggtctgacttttctgcacggagggaacttcagtggtatagcaaagtgggtgtctgggaagggaagaaggcaaatgctggaagatagtgctgcagaaaattcactaccttcacagagacccagggtgataatggaccagacctttgaatttggcaagtaactattcagagaccctcaagagagctgttttgagatgaaaactgtcaggttgcagagatttaggaaaagaaatgagttttagtgatgaaaaaaaggaagttagaaccaagctgtggtgttgtacccttaaccccagcactggggagacagaggcaggaggatctcaatgagtctgaggccagctacagagagttccagaacagccagggctacacagagaagccctgtgtcaaaacagaagaaaaagagaaagaaagagagagagagagagagagagagagagagagagagagagagggaggaaagggaaaggaaacgaaaaaggaaaggaataggaaagaaagaaagaaaagagaagaaaaagaaaagaaagaaaaagagaaaagaaaagaagaaaagaaaagaaaagaaaagaaaagaaaagaaaagaaaagaaaagaaaagaaaagaaagaaattagactacagctgggcctgccatgggggagagagaactgagttttaggtggccaggagaggcagtgcactgtggggaaaaagggaggagccagtgggattccagagcgatggtcacgcccacggggtagtgcatggtctgggaagtggaggggatgggcgagtttcacaaggaagggcctgaacaatgattcctgcagtcatttctaacaactaagaccagtggtctgaagaagtcccattggcctttgtcactgaagatgacgttcagtcttcaccagaaagtatgaactgggtggaagcaggtcccggagcctctctgcaggcagagcctttcctctgtggggtttgttggcgtgcagctttccttgggtgtggtgggcctgggcttcagcacttctacccaggcccaaatggcgctggttctgctggtcttagctgttaccatcttggttctacaagacatccccctcttttaataatagctgcaagatatgtttcacatttggcataacgttacagtgaaaacacatacacacacaaaaacatacaataaaaagtatttttagagaatgcctcaagtctttggaattcgaaattatattgctctggaatctgagagactaggaaactacctaaaagcagctcgtgaccttgatgaaatatttccctggagtaaaatacttcggttatttaaggagagcaaatttcaaatttaaggtcagttattttagttatttactaatatcgtatggagggttgtttgttttcatgggtttttttgtttgtttgtttgtttgtttgtttttatttctgagacagggtttctttgtgtagctctggctgtcctggaactcactctgtagaccaagatggccacaaattcagagatctgcctgcctctgcctcccagtgctggggttaaaggtgtgtgtcaccactgcccagctctatgctttattattaatggtaagagatggttttaaaggatgtacactgagcaaagaaatgcttgtttcgttggcagggtacacgacacacactggcctggatatgtaacccagaataaccttgaacctgtgcaacattcctgcctcagtttgagcacaggtatatatactgctgtggctagcaagaactcctaacagaaaatgacagcgtgtgctatttgcgaatctaggatgtatttgaaaagttattcctaatgtagaacttatgagctacactgaacgtgtggagttccccatacctctctaccacttcctctccttacatcatgaattactactgtgtgtttatcacaactaactgttttgatatattattgttaactaaaaggccctattttattctgattcatttgtgtctacagccctaagatactacattatatgggagtgttttttccttattatcttttacttagtcttcaaaaatttcaacagatacacaatgcatattgattgtatccaccttcctatcctcccatgttcccccaggaccccaaagcccacttcctttctaactcaatgtcctctcttttattagtactagaacctcctgagtccaactaactgtgtacacgtgggtgtggggccatgcactggagtgaccctcccccagcagccctcaactgccatagctcctccatctgcatgagttttcttatctccttcatcctctgttgtgtgaaggtttctagtcttccatgttctcactgatacgaagaatactgggcagtcactgctctctagttgagcttttctggtgctggttctgggaagaagaacaccccagcaaatgctttctcaccctgtcatgcaccccgctacatactggcagggcatcatggtgggctcagccttgaacagggttctttctgtctgtggccttactttgcactgtctgtgtctcctctacctctgttgcttaaaaaccatcatttcctctcctcaatgtacagaatcaactccaccttcttattatttagataaatcatttgaaattcatttgtaaggaaattttgatcatctgcattcatttatttaaaaggccatttttttttatttatatgataggtttgtgtatcttactgctcaggctgttacagcgctggactctgggaggtttccagttggctcctgtcatgcacccctgtccttttgtctgtaagcagtttcttactttctggcatttaatgatgtgtttcttgcctcagcactaaaattcagtcttctccagggaaccctggtttcttttattgagaagacttgtttttaagtccaggctgcccacccatccgttccctcagtgacaactgaattctactctaatgctatcagtggaccagaagctgtacacacagtgggggaagaaagcagagaaaaggaatagggttggcaagatctctcagtgggtagtggcacttgctgatgagcctgaatttgatccctgagacctacatgttggaaagagagagctaattcccactagttgtcctctgacctgcacatgcctacctacatacatatttgagcatacccagatacacataggtacaaaataatttatcttcgtcactttattataatgaacttaccaatgaaaatatcacacggctagattaaggcaaacacttgcctagtcccaaactctgcatctcaatggattgctattctgttagaaagtatagtctgaagccaaggagtcacattgggatttgacactttcactctaaattacattttttttttttggttttttgtttttttatagatttacaccaccaagaaaaatctatagcagagttggaactagcaaagcaatcatcagccttatgtctgctttcctagcttacgtgtccctttgcctgcattccaaccttccttgtcactagcatttccctcttctcagtctcctttctaaaccttcttccatacccatctctttacatagagcatgtctatactatagtctagacttcatatgaagaagaagctttgcatctgggtaacatcacttagtaccacatcctaagtccatccgttttctggcaaatttttgctttgcagataaatggtattctgtttgtatttgtaccattctttaccctttaagtacattttcaaaatgaataaaaatattcaaagtattaccttacaaaagtcttattctctctatgtgtagatgtgttagttaaagctgatgatgtcttagtcagggtcttagttactgctgtgaacagatatcatgaccaaggcaactcttctaagaatgacatttaatcggggctgacttacgggttcagaggttcagtccattatcatcaagggagcatggcagcatccaggcaggcatggcgcaggaggagctgagagttctacatcttcatctgaaggccactaggagattaatgacttccagacagctaggttgagggtcttaaagcctacacccacggtgacacacgtattccaacaaggccacacctactccaacaaggc

SEQ ID NO: 728 - DNA, 2350 bp, Mus musculus
actggacctacggtgggcgcccggcgctgcggttcactctggttccgagggcggaagtgcccgccgggctgttttctgacccgggcggcagcactgtgcggctgcgcgcgcactgggacttctgctcctgcgcctctgcaggacagtgtgatcccggcagacagaacccgaccgagcggctttcgcgctgcgggaagccggagcagagccggcacctcggtttggctttggttgaaggaagaacttagcctatatgtactgcttcatccactggaagaatgacagatgacaaagatgtgcttcgagatgtgtggtttggacgaattccaacttgctttactctctatcaggatgagataactgaaagagaagcagaaccatactatttgcttttgccaagagtcagctatttgacgttggtaactgacaaagtgaaaaagcactttcagaaggttatgagacaagaagatgttagtgagatatggtttgaatatgaaggcacacccctgaaatggcattatccaattggtttactatttgatcttcttgcatcaagttcagctcttccttggaacatcacagtacatttcaagagttttccagaaaaggaccttctacactgtccatccaaggatgcggttgaggctcactttatgtcgtgtatgaaagaagctgatgctttaaagcataaaagtcaagtgatcaacgaaatgcagaaaaaagaccacaagcagctctggatgggactgcagaatgacagatttgaccagttttgggccatcaaccggaaactcatggaatatcctccagaagaaaatggatttcgttatatcccctttagaatatatcagaccacgacggagcggcctttcatccagaagctgttccggcctgtggccgcagatggacagctgcacacacttggagatctcctcagagaagtctgtccttccgcagtcgcccctgaagatggagagaagaggagccaggtgatgattcacgggatagagccaatgctggaaacccctctgcagtggctgagcgagcatctgagctacccagataactttcttcatattagcattgtcccccagccaacagattgaaagagtgtgtcctcctcgctagatggaaccaccttgagtcaggacaacgaggcgtgacacccttgcttcagtcaagttcagtggaggcaacagaaacccgggctgctgcaagccaaggaggagaagattccatgagagatagggcgcccgggcagggctgagtgtgcaccactgcttcgctgagacacacaggaccactgcagcctcctcttctcgtgaaatgcaatgcagccgaagcctttgctcaatgaaaaaaaaaaaaatggaaatgtgccacagtttgtatttctgattaacaaataagtggggtatttcctaaggtgaccatggtggaaccttaggcaggagaatggaaacattggttgaattttcaatagaattagacttaagaaagtaaaagagaaattctgttattaataacttgcagtaatttttttgtaaaagatcaaattacagtaaacccatctttccttaatgagactttcctgtttacagtcagtctattggtatgcaaacaatcttgtaactttgataatgaacagtgagagatttttaaataaagcctctaactatgttttgtcatttaataacatacagtttgtcacttttcaaagacctcctgaatctcatagagtaagccactttttcttctgtgttcccatttctcactggcatagcaagggtgcggggcataaggcgacttgtctcaggagctgtcacaggatttattactgtgacttgaaaaatctgtcttctatatactaaaggtataaataatcctatctgtctttgctgttacgttggtcactgtaaacctgtcaaatcatagtatgccaagtatctgtctatgataatttttgaatattttgaatctcccgttcctttccagtgtttttgtttggtttggttttggttttttgttttacgtttttgttttttggctcctggattatgtcattgtggcccctggcagccagtctttaaagcctgcaggtgacctgtctctagactgcagtagcttttccttatcattaccaaaaacatccagaggttactggaactcctaccacagtaaggaaagtttgctgcactactctcgatggctgcttggagactcctgctgttgatttgtgagctagcttgctgtccacattgaatgtcaacccatctgagtatgctaaaagatgatatcataaaataatggttctagattcaataataaagatgaatgttttcttataaaa

SEQ ID NO: 729 - protein, 285 aa, Mus musculus
PICTASSTGRMTDDKDVLRDVWFGRIPTCFTLYQDEITEREAEPYYLLLPRVSYLTLVTDKVKKHFQKVMRQEDVSEIWFEYEGTPLKWHYPIGLLFDLLASSSALPWNITVHFKSFPEKDLLHCPSKDAVEAHFMSCMKEADALKHKSQVINEMQKKDHKQLWMGLQNDRFDQFWAINRKLMEYPPEENGFRYIPFRIYQTTTERPFIQKLFRPVAADGQLHTLGDLLREVCPSAVAPEDGEKRSQVMIHGIEPMLETPLQWLSEHLSYPDNFLHISIVPQPTD

SEQ ID NO: 730 - DNA, 161334 bp, Homo sapiens
  misc_feature (1)...(161334): n = A,T,C or G
tnnnnnnnnnnnnnnnnnnnnggcattaaaagaaagagagtcccacgaatattgaataagagacatagagcgcatattgcctccccccaacggaaacaatagaagaacgaccctgcaacgtgacacaatgtttaaaacaataatacccaaccagcatgtttgctactgggaaacactatcttgacatctttatttttttttttttctttttttttttttttttttttttttttttttttttagcagagtctagctctgttgcccaggctggagtccagtgatgcgatctcagcttactgcaacctctgcctccagggttcaagcaattctcctacctcagcctcctgagtagctgggattacaggcacacaccacaatgcccagctaatttgtttatttgtagagacagggttttgccatgttggccaggctgctctcaaactcctgacctcatgtgatccacctgcctgggcctcccaaagtgctggaattacatgcgtgagccaccgcacctggcctatctttacctcattgagggtgctgttggctggccttgctggctggggagctctgagctttacctctggtagacagtgacacctgttgacaacaacgcattattgcaagaatctattttactattttagaaatcaggctatttttatttttactttttttttttaaagacttgtccttcagttttacacttcccagattatttttctttctgatgttcattgaaaaaaacagactgaaaaactgcctggctgattcatcctagactttattaagagttttttttgtttttttttttaagagacagtgtcccactctgttgcccagggtggagtgcagtggtgcaatcatagctcactgtagccacagactcctgggctcaaggaatcttcccacttcggcctcctgagtatctaggattacaggcaggcaccatcatgcccagctaattttaaaaatgttttgtagtgatgggatctcattgtgttgacaaggctggtatcaaactcctgatctcaagcaattcttctgccttggcctttcaaagtactgggactacaagcgtgagccaccatactgagcctggagctttttacagaaaaaaattcatatggaaacagtaaaaaaatctgatacaaagatttttttaagacaatattaatttataggatgaaaaattagaacacaaatccataatagttatgagtgtaggccaggcacggtggctcacgcctgtaatcgtagccctttgggaggccaaggcgggcggatcaccaggtcaggagatcgagaccatcctggctagcatggtgaaaccccgtctctactaaaaatacaaaaaattagctgggtatggtggcgggcgcatgtagtcccagctactccggaggctgaggcagaagaatggcatgaacccggaaggcggagcttgcagtgagccgagatcgcgccactgcactccatcctgggcgacagagcgagactccgtctcaaaaaaaaaaaaaaaaaatagttttgagtgtatacgtatctctaaataatatttggcatatttctttaatttaaccctgtggaatccatctgtgtagacaggtagagaagattcagtaactggagttatacatatagtgtcttataacacgctatttttcaatggaaccctacattttatctgtaacggtgatagaattgcatacggtgttgtagagttcacacggtagtcacagaaaagctgctccaaattgtgatttttaaaatatataccggcgtaccttcaagatattgagggtttggtttcagaccattgcaataaaataaagagtgctaaaaagtaacacaattcttttggttttccaatgcgtataaaaattaatgtttatattataggtactataaggtagtctatttagagtgcaatagtattgtctaaaaaacaaatgtatataccttaatttaaaaatggtttagccagggatggtggctcacacctgtaatcccaacactttgggagtctgaggtgggaggattgcttgaatccaggagttcaagaccagcctgagccacatagcaagaccccatatctacaaaaaaattaaaagttagccaagcatagtggcatgtccttgtggtcccagctacttggaaggctaaggcaggaggatcgcttgagcctgggagatcaaggctacagtgagccatgattatgccactgcactccagcctaggcgacagagtgagaccctgtctcaaaaaatatatatactttattgctaaaaattgctaaccatcatctgagccttcagtaagtggtaatctttttgctgttagagggtcttgcctcaatgctgatggttgctgactgatctgggtggtgattgctgaaagttggggtggctgcaacaatttcttaaaataagacaatgaagattaccacagtaattggctcttcataaaagatttctctgtagcatgtgatgctgtttgatagcattttactcacactagaacttctttcaaaattagggtcaatcctttcaaactctgttgctgctttatcagctaagtttatggaatattctacatccttggttgtcatttcaacggtgttcacagtatcttcaccaggagtagattctatctcaagaaaccattttctttgttcacccataagatgtagctcctcatctgttaaaattttacaatgagattgcagtaattcagtcacatcttcaggctcacttctagttacagttattgctatttctaccacatctgcagtgacttcctccactgaagtcttgaacctctcaaagtcatacttgattattggaatcaatttctgccaaactcctgttaaggttggcaacattttgacttcctcctatgaatcacaaatgttcattttttttttttttttttgagacagggtctcactctgtcacccaggctgctggagtgcagagcacagctcactacagcctcaaccacccaggcgtaagtgatcctcccatcttagcctcccaagtagctgggactacaggcgcatgccaccacacctggctaacttttttattacttatggagatagtgtctcatcatgttgcccaggctggtctcgaactcctgggctcaagtgatactcctgcctcagcctcccaaatgctgggattacaggagtgagccactgcacctggcccacaaatgttcttaatggaatctagaataacgaatcctttccggaatattttcaatttattttgccagatccatcagaggaatcactatctatggcagctaatgccttagaaaatgtatttcttaaacaataagacttgaaagtcaaaattactccttgatccataggctgaagaatgaatgttttattagcaggcatgaaaacaacattaatctccttgtacatttccatcagagctcttgggtgaccaagtacactatcaatgagcaataatattttgaaggactcttttttcctgagcagtaggtctcaatagtggggttaaaatattcagtaaaccgtgctataaacaggtgtgctgtcatccaggatttgtgttccatttctagagcataagcagaatagatttagcataatttgtaagggccctaggattttcagaatggcaaataaacattggcttcaacttaaagtcaccagcagcattagcctctaacaagagcatcagcctgttctttgaagccaggcattgacttctcctctctagctatggacatcctagatggcatcctcttctaatagacggctgttttgtctatattgaaaatctgttgtttagtgtagccaccttcatcaatgattttagctaggtctcctgggtaacttgctgcagcttctacattagcacttgctgcattaccttgcactttcatgttatggagatggcttctttccttaaacctcatgaaccaacctttgctagcttccagtgtttcttctgcagcttccacacctctctcagctttcacagaattgaagagagttagggccttgctctgggttaggctttggcttaaggggatatcatggctggctcaatcttctatccagaccattcaaactttctccatattagcaataaggctgttttgctttcttatcatttgtgagttcactgaggtagcacttttaatttccatcaagagcttttctttcacattcataacttggctgtttagtccaagagacctgctttcggcctgtcctggcttttgatttgctttcctcactaagtttagtcattactagcttttgacttaaagtgagagacgtgcatttttttctttttacctgaacacttagaggccattatagggttattaattggcctaatttcaatattgtagtgtctcagggaatagggaggctagaggagagggaaagagacaggggaagggccagtgggctgagcagtcagaacacacgtgtttatcagttaagttcaccatcttatatggatgtggttcatactgccccaaaacaattactgtagtaacatcaaagaccactgatcacagatcaccataacagatataataataatgaaaatgtttgaaatattgggagaattgccaaaatgtgacagagacatgaagtaagcacatgctgttggaaaaatggcgccaaaagacttgcctgatgcagggttgccataaaccttcaatttgtaaaaaacagactctgcgaagagcaataaggtgaagcactatataacgagctatgcctctgttatgcttcagtggtggtcaggcagcaacacattagaaagaccacacttcggaagcagctgaagtgtatttaaatttatttatttatttatttttgagacggagtctcactctgttgcccaggttggagtgcagtggcacgatctcggctcactgcaacctccacctcccaggttcaagtgattctcgtgcttcagtctcccaagtagctgggactataggcgtgtaccaccacaccccgctaatttttttgtatttttagtacagacggggtttcaccatgctgaccaggctggtctgaaactcctaacctcaagtgatctgcccaccttggcttcccaagatgctgggattacagacatgaaccaccgtgcccagcccaaatcccatatattttagattttgctaattgcatacatgagatcccatttttaacatttatcatacttttggggaagccaaaaataaaaacccatctctggtgttcactatgctaattagcaaaccaagcgatgtggatcaagatggtgatactaggcgtccttgtgatatgtgctcctgaagtgtggtctttttaatgtgttgctgcctgaccatcatggaagcctagaattctcagtttgtgtgagtagaatcgaagcttatgtactactaccacattcataatattacattttgtatgctgaagtaggttaatgtatgttacagcaatcatacaggttctccagttccagcaggtggaactccagtttgtagcctttttgtataggaattcatgccagctttgtaggagtctccattctagcaggggagaggtatcatttgaggaaggataaacggatagaggaacagaagtgtggttgtgttctgggaatgcactgcagagtgtgcagccaaatggaagaagtgatgcctttccccgtacagatcctaaaactgacactgagacaggatacggtgatggcggaaaactttaactgctagtgactgctggagacccactctgctaatggcagtgcatctcaattactttcaacgtgacttgctgattttctccctcagacatcgatgaagtaacaaagaaaacgaccactttctacctaaactctaagctatatggaacaatttagattatgaggtgaaactgatgggaatcctagaagagagcgcatgttcagcttaggttactttgacaaacatttaataaatgccaggcattatgctgggcattggtgatcaaaaaattaccgaggaaagtatgaggaccaacaaatccaaattgggtgggtcaggaaatactttccaaaacatgaattgagtcttaaaaatgagtgatgtgtgccaagtgaagaagaaagaatgtggtgatggtgctggtgggggtagtgttccgggcagcagggacaacagcaacaaagtcatagaagcatggcatagccttagggctcagaagtcttacaaaatattggatactgttggattttttgaagcgcaaggcagggagagcaggggaaggaagctagaaggaaagaagaaattagccataaaagaccttgtttaccatgctaagaaatttggaatttgcctagaaggaatcaataaaaggtgttaaacagaagagtgacattgttagaatgcattttagataacatacactggttggatgctgggacaggtagagcaggactggaggcagggagatggggggaagctatcctaatagttcagaagtgatgaaggttaaaggaagcattttaataggatgggagaacatttgagcatatgtataggatgaaggaagaaactagtagtaagggaaatctgggagatgggataattagttggagcagtcagaagtgttagagctgaagtattaatagaagaattaaattaggcttaaatcattcctctgaaaccaacaggacagagataaaagagagcagaatgggaccttgggtcaggaagtaatagcatgataacaagtgatggttagggttcatggaggcagtcaagataacttacattttaggaaagtagatttaaataagtttagaataaagttacgatcccacagttttgagtcttgcactttgtgaggtgtgcaaaaataaaagccagactttacaactacaaactattatagtgaaaagaaaagagagcaatttattaacaaagacttctttggagtctctccttagaaaccagaatttgggaggagttgtgtacttgacttttgttgaaaagaggactttataaacaagttcgcacgagtcaaaggctgcctgagagtgccgagaccagctcggtcgggcagaccctaacccagcggcgctagaggaattaaagacacacacacagaaatgagctgagagccccgaacagagatttacccacgtatttattaacagcaagccagtcattagcattgtttctatagctattaaattaactaaaagtatcccttacgggaaatgaagggatgggccgaattaaaggaataggttgggctagttaactgcatcaggagcatgtccttaaggcacaaatctctcatgctattgtttgtggcttaagaatgcctttaagcagttttccgccctgggcgggccaggtgttccttgccctcattccggtaagcccacaaccttccagcgtgggctttatggccatcgtgaacacgtcacagtgctgcagagatttagttgatggccagttttggggccagtttatggccagattttgggggtcttgttcccaacagagagtcacccccaataagctaaaacttggaggaaatggtaaggccaacaaaaagagctctttaaaagttatcttcatagaaaaaaaattaaaaatttgcagtgccactgatttggagaaaaggcataatgttcacaaatggaaatgacagagacgaaacatacaattccctttatttccaaatttttgctcaaggagcatgatcatcatatagaaacaagtgtaacaactatttaataggaatgctgataactggaccatatccagaggagagatatggcatgtgaagaatggctgaaagaaatgacaatgtttatccctgagtgcattacggggcacaagagctaccttttcatattgaaatgctgtcttttagaagaagagttagttatttctgttgtatgttgtagatgggtgaggaagagagaaggacaaggggagaaagaaagaaaatggtcaatttataaaaattacaggaagttgaattttaagtcaaatcaagtaatcacctttcacctattgggtttcttcatacatagtttcccccaaaacaatttttttttttttttgagacagggtctctctctgttacctagactgcagtgatacaatcatagctcactgcaaccttgacctcctgggctcatgtaatcctccttcctcaaccactggagtagctgggactgtaggcgcatgccaccatgccctcctaatttttgtgttttttgtagagatgtggtcttgccatgttgtgcaggctggtcttgaactcctgggctcaagctatcctcttacctgggcctcccaaagtgctgggattacaggcatgagccactgtgcctggtcccaacattttgttaggaaataattttgaacacacagcaaagctgaacaaattttacagtgaatacccatttacaatgaacctagattctaccatctagattctaccattatattttaccattatattctaccattatattttactatatttggttaatcacatatttatccatctatgcgcccctaaatccatcttattttttagatacattttaaaggaaattttatatacttttgtctgacactgggaaggcaatgcaccttaatcccacaagctttcttacagaggctaatagctgtttactggggacactgtagtgaggatttctgcattgagtaggtgaagaggaccataactgtggctttcaaacttttctgactgctacccttactaagaaatgtatttcacattcctatccagtgtacaccacatacatactgaagtaaaaattttgggacacaatatttaccctttacatgtgtgaagcatgctgatattttctattttatttcatttaaaaagatgctgggcatgcttccctaacttgatttagatacccactaatgtactgtaatttaccatttgaaaatcattgtacttagtccaactccaagaagatttttctttttaaaagaatcctgtggctactactagaattttccttatgttcccaattatcaagaacctgttttgagtctcagcacagtacttacttaacatgcatggcgttaaggcacgtgtaattaagagaaaaaccttaaatgcctgctaagacttctggatagagccaattcaaagattctttattagtaagtttaccaattattattattttttttttgagacggagtctcgctctttcgcccaggcgggactgcggtggccctatcttggctcactgcaagctccacctcccgggttcacgccattctcctgcctcagactctccagtagctgggactacagaagcccgccaccgcgcccggctaattttttttgtatttttagtagagacggggtttcaccgtgttagccatgatggtctcgatctcctgacctcgtgatccgcccgcctcggcctcccaaggtgctgggattacaggcgtgagccaccgcgcccggccccaattatttttacaaagagtaagataaagatatgtactcttggatgggtgggagggttcagtgctcatatagtcttctgttaaattaggttattaatgcctgcggtggttccaacaaagtagagaagaagatcaaataagaaaatggatgggaaagtactttgaaaactaatgttttattaatactgttgtgtgatgccaggaagaaagggatgttgcgatcaagctctagggaggcagtgtttcagtattttaaaaactgtttttgtggaactgttaagttaacctccccaagccccaataactacgctttgacgcaagattctcagaagagggtagaagctatgaacttggagaggtttggtcgcgagttcaagcgtactgccccgttggcgcatgctcaagagcgactcgggcctccttgctgggttaggcagaacacggagggcggagttcggaccacgtggggtctcgtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtagggtacgtgtgtgtgtccaccttgtgtgaggaaattcctagaggaggagggctggggaggggccaggtaggtgtggtaggaaggaggggtgagtagttgcctggaggagcgcccgcccggccgcgatggcgggtgaaggtggttcctccgggcaaggtggagttggcgagacgccggcccggagccctggggccggttggcgggtgtggcctgcggggtccctcttggggtacatgtctgttgcttactaaggtaggaaagcgagagtctagtcgcaggctctagagttcagttcaggacctgaattgtttgtggaacacagttatttaaacctttattgcacagtgcagtgtgagtctgtccaaactcggtgggtatgtcctccaagcaatttatctatttacgatattccctgtctcaataacaatatttagtgctaccaaagacattttctgttggcaagacacttttacatacttcatttgtactttggattattttaaaattatcctgaacttgaggaacctaggaaactattggttctagatttttctgaggggtgaggaggtacagcctgtcttgagcaatcagaacccggagacttaccagacagtagctgaacttccaaagccttccagaattggcttgttaaatttctgagaccttgaaactggatacttggctctgaactgaactatttgtgatttccatagagggagtttctggttgaattttgaatttgaaaataacgatgttgtgctcagggtagtaattgagaggtattttacaccagatttaagcctgtgcttttatcttcaaagatatgctacttaaaattgggggaaagtgtacagaatggaactgtatggatatggatttttagaatagtgcacacacctcaagtgtgtatttatttcattaatttcccccaaactgagtacctcctatgtgttaggcactggacaaaacagtaaacaaaatagtaaacaaaagaataaaaatccctgccatcatgaagttccactttggggatggggtgagaagacattgatacaaaaattaaggtacagtctttcctgtccctcggcatctgtgggagattggttccaggacctcccttggataccaaagtcctcaaatgctcaagtccctgatataaaatggtgtagtgtttgcagataacctatgcacatcctcctatctttagttcaactctgcattatttataatgcgcaatacaacttaaatgctgtataaatagttgttatggtgtattgtttagggaataatgacaaaaaagagtctatacatgttcagtactgacttttttttccttccccgaatattttttcatccatgattggttgaatacaaggacgaagaacccatgggtaggaagggccaactgtgtacgtcaagtggcggaaagtgctagagaaaaaaaccaaagcagtgcaggggtatagggaatgccaagagatgggagtggtggccatagaaaagatgatattaacttggaggcctacgggtgataaagaagggtgccacttggaaggagctgccactgaagccctgaagcaggcgcatactagctagtttgactggaaaataatgaacaagagggaaagaagtagtggatacttaggtggaaatggggccaagtcatttaggagcatgtgggaatttataagaaccttaatttgtactttgaatgagttgggttttgagtaagcagtgagttgatctaacttgtgttttaaaagatctgattgctatgttgactgtatgcagcaggtgcagaaataagagttgttagtaggccattgactgcatttatccaggttaaaggtcgaggtgacttgaatcagggtagtaatagtggcggtagtgcgaaatgaccagattctagacttttgagagcagtcaggtagaagaagggtcaaggacgactccaagggttacggactgagcaactaaagaatataacttggccgggcgtgatggctcatgcttgtaataccatctttgagagaatccccagcctgggcgacataacgagaccctgtctctacaaaaaaataaaaaattagctgggcatagtggcatgagcctgtagtcctggctacttgggaagctgagatgggaggggaggatcacttgacccccttgagctcaaggttacagtgacccatgatccttcactgtagtccatcctgggtgacagcaagaccctgtctctttaaaaaaaaaaaaaaaaaaaaaaaaaaggacttttccacttagcgaaacggaaaagaccacagagtgataatgataggagaactttttgttgggaggccaaggcgggcggatcacgaggtcaggagaccgagaccatcctggctaacacggtgaaaccccgtctctactaaaaagacaaaaaaacaaacaaacaaaaaaaacaaacccgagcctggtggcaagcgcttgtagtcccagccactgggaggctgaagcaggagaatggcatgaacccgggaggcagagcttgcagagagccgagattgcgccactgcactccagcctgggcgacagagcgagaccccgtctcaaaataaaataaaataaatgataggagagaggaggaaggaagatctgaaatggttttccgttttgcatatgttaaatttctaaatggaaatgtcatatgtggtggtatatgtgaagccagccagttcaaaagagaagtctggacagaagataaaactgtgggagtgtaaatgtataagtgttatttaaaaccatgtgagagatcttcaagggagtggttcaaggactgagtcctggggcatttcaacatttacagtttggagagatttacaaaatttcctccctcccagggtgggactgttgagtaaaattcctcttgagaatcactgattcacagtacctggatagaaggaaatagaaagcaaggtcattagctgagagagaggaggaggaggaggaagaagtgaacatttgagggaggagaaggtatagaatagtgatgtaggaaagtgggagaataaatggactagggaagagtaggaaactagtgtttatgaatttaaaggaagaccagccagcatagattataattttttttctgtttacacgcttagtttagtaagtatttgatatttctaggtagttgggggttttgtcagtgaaaattacttcaggtagtaggttagtttttcttggtatgtagtgtgaaagaaactattatgcattatattgttgtcacaccgtgccattttctgaatgactgattggttaacagatgttgttggtgggcacctactctgtcccaggctctgaactagatgcagaaaatagaagtcaataatagcccctgccctcaagaaacttacttctagtagattgcgtcacaggttggagtttctttatttccaagacagttccttgaaattggatggtgattggatggtgtagtgtatgtaggagagggaaaatctttctaaaataacaaaatatgccgaatttaaagtgcgactatactgatttggagaggagtttagggagaaaatttcttaagtagctagattcatatatttatatatttttccccattatttaacaaaaatttcaaagcctactatgtgctaactgtactaatattggtgataagaaggtacttatgactaaattttgctgtcaaagaactcccagttcaatgtggggaggggcaggagacagataagataaacagataactacattgcatgatagtgcatgctattaaagaagtaattagactagaggctgcataggggaaaacttcccaaggagctgatattaagccgacacttaagaggattaagagttggccaggcgcggtggctcacgcctgtaatcccagcactttgggaggccgaggcaggcggatcatgaggtcaggagatcgagaccatcctggctaacacggtgaaatcccgtctctactaaaaatacaaaaaattagcttggcgcggtggcgggcgcctgtagtcccagctactcgggaggctgaggcaggagaatggcgtgaacccgggagacggagcttgcagtgagccgagatggcgccactgcactccatcctgagcgacagagcgagactccgtctcaaaaaaaaaaaaaagagttgacccagagaggataaaagagttggccaaaagaggagggaaaaagtgttcaagcagaggggccatggaaatatgaggaaactgtgtactaaaaacatacattgtttattgagtggttaccaaatgtactaaacacctaacagccctgtgaaaattataattatcttcattttacaaatatgagagtcaaagaggatgggtttgttgttcaagacacgtaactaataggtggaaatcagggtttaaacccatgtcagtctgatttcaaagccccttaactattttattgtattttgcatgctgtcagcatctaaatcttccctgcccttgttctttatccctcatttttcatcaacttctctttcttccttggaaagactcatctgtttctcaccagtccatgactacctctctaggtcaggcactcattactttttgccttagttgctgaaattactacctggctagcctctctgactcaaggctctcccttctgtgcactgctaccagataattgtttttattttaccattctaaaaccggtaggcactataggactggtggatgagattgagattccccctcagtcttctgtttggtatgtttcatggtctagtctcattttatttacatttatagatttgacattagagggataataattgcttgcatttcctagcacttaccatgtgtccattattgtatcaaacactttatggatttttttttttttcagaacagccttttgacttgggtaatattaattccacttcacaagtaaggaaattgaagcttagtgaagtaaagtgacttgcctaaaggtcacgtgtgatgttaagacaggttatggtatcagctctttcattatctattaatactactctcaacccaaaatttccttaaaagttggcatatatattgcacctgcccacttaatacctttattgatgctattttggcctgttagaatatttgtcatctttttgcctgtccatattctacccattcttcaagttccacatcttttaaaattatttgaacactataggatgtattaatatctccaacccctcctctttcccctgccccatgaaaactctcacagagtaacatttaattataccatggacataatggatgttttggagttgggagggatgatggcaatcaatatagtatgatggaaagaatgtgagattagaaacctgagttaggatgtggcttctaattttggctccgccatttattagctacaagattttagaaaaatcatctgacatcctcatctcaaatttatcatttgtaaaatgggaacatataggcttgtgtgtatcacatgtgaggtaatgtaaaatgtatagtgtttctggagttacttgatatttaaagtagtatataatctactgttaactaatttttattatctaatctcacctgcttacctcattttttgggattctgtttggttctgtagttttatattcatacactgtctttccaacaaattcaaattcagtaagcattttttgagcacctactgaattccagataccattccaagtatcagaggtgaaaagatgaatgagatatgatccttctccctaacggaatctattacagtctgctggaggagacgtacaaataaatactattgataaaaacttacaagggtagaggaaaagtagaggtgccaagagaaaacaaggcgagttctgcctgaatcatgtgtagaagaaaggttattttgagctgggtcctaaagcatgtttaagttgaaagataaggtaaagaaggctgctttagggtaagggtaccaccagcatgggcaaaggcacagaaaggacagaaagtgcatagtatgtttagtagatttggagattatactttgttaatgattgaggtttttaaaagtccattattcttcttctagcacctgccacacagctaggcatatcaaacgattaaatatttgactctaaattgcatattattagcagtgtttactgcaaaatttttagcttttttatacctataattactacttatgttatataatgcttttgattattattagtttttgaagtctttaaatgttgacttttaaacatttttgagacatgttcttgttctgtaaattataatagtagataacctttatagtacatattatatgatagacattgttcaagtgctttacatgtattcatttaattcttgtatctaatgtggtaagtgctgttttcccatgttacagatgagaaaacagaaatagagaagttaaatgacttacttgaggttacactgtaagtggtggagctggttttggctccagacagtctggctccacattttacatttctaacttctactgtatagtgcttctcaagagttaaattttgttttattgcctctttaaaaaagtattattgaaaacttaacatcctttagttttattcatgtatccccaatttttcttacatatttttaaagttaagtgtattcactggagacatgctttcttatataatttattataggtaagcattaatattgaaagattaacattttaagatcctataaatttgggtctgtgtattttgaggcagtaagcagccttgtttgcagttttcataaatctgttttgcagagtttgtttgttttgcaacatttgtatcagctctactacattatacctttagctgccttggctgagttagttcttcccttgaggtcttgcaaaaaatatacatgtaagcaacaatggtatatgggaaataaagtaccaatttatctttcactagtttttgtacttaaaatcctactgtagaactttggtaaactttgctggaacgtaagactttaaaactcaagcctgtagttggagtcttgaggtgttctgccttctaagtctatatttgtatctcttttgggaagggactcagaagcagcattggtcattcattttactgttcgtgacatgtggaagggagaaacagaagagaatgttatggaaagaaagagcaggatggtcagggttctcgtctggcagcctagaggggagagaagggagccacactcacatgcatgatgttttggtttatgatgatccctgcctattaataaacatgtcaagtggtgtcctggaatctgaccaatcagattactattcctccttgagaggacagtgcttgaagaggagggaagagcaattgtcttggattatattttctatctgcttcttctgagaagaaaaataatatcaatagtgacaatatagtgacttcaactttaagcttgtaattaacttttattaaatatttttagtagaggaactcttcgtctcaaattatttttctcttcatcatcaaaaggtgaatctcagttgcagctgttgactaactggatgtatcatggctgcagaaacaactgcataccacctttatatcagattcaattttagatttacttatttgtcataacctagatttcattattttttgccactagtgaattcactttaaaaagagcaagctattaatgtaatcaggacgtagtgaggtctttcctattttcagtgagttaattttgtgtcatttgtaaacttggaaattttttgccaaatgcagaaactcaatagtttgaatttgtagcctatcagtgtggaatgatatgaagtttacatgcatgtatatcattcgcttaaagtagttgtttttatggatatattttaataaaagttaaaacactagtagtatgctggaaagagcactggactcagtttaataaccagaattcttgttgcctagtacttttatgttggacatattttttccacctcttgcagtttacgtacctgtagatgacattgcatccagttgacctccaactttttctttctttaactaattaatttataccatcttaatgtcattggtcagtggaagaggaaaaaaaagggaaataagctccttgaataattcagtgttaataatttatatttggctaaactcgtaagattatttagagtgttttcataggctacattgtgatagattatgaattagctgcctatcaaagatgagaaatattatttggataagtatattgaatcttagtatccaggtgccacatgttgagttactctaagtgtatattatcaacaatatttatttcagcatttactcatatcgtgtattgtgatgtgttattcagttgcagaatattagcattggaaggcacttggatattacagaggtcaaaagccatgtccttatgccatacctagaatattgttttgcagatctagtgctatatttgtggtatagagaatattctgagagatccaagtggaagcatttactgtttcactggggccagagggctgtgagcatggtttgcagagtagggatttgaataagtgagagaggagcatactaggtaggggaatagtaggatacagagaaaggtgttcagggggccacttttggtagagggtttacaaaaggaagtacagtaattaaaatggaagtattggtgggattaaattgtagagaggatgaaatttagaatggggaatgggtttatagaaagattttttccccaatgtgaaagagatattttctaagatgggagagtagttttgcaggaagagaggagaaactatctggagtaggaaaaggtgaatatattggacggggcaggggtaaatgcgagaatgatcctttggagttggactgtcaggattcacagggtataggtgaagctcctctttaggtaagcagtagactcttctgggcttgaaagactgatgcagatacagtttcattttgactgtggttcagtacttaaatatgcaatgaatattactggcatatgtaattttgatctgattcctttacataagtaataattttacatttagaatttgttgtactcttttctttgaatttatactaaagattggtgatcatcgttttttttttttgaagtggataatctttatggcatggattttttaaaataatcttttgttttctagcaggttcattcatcgttgcaaggatctgactaatgctcttcattttattttcagtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatgtaagtacattgattgtggcaaatgggatatttaaccttgtccatttttgtaagaaaaagctgtaagaacttggaggccattatgtaacgttttagatacagctaattcatgcttattttggaaaaaaaattaacacagataagcataaagaaggaaataatcacctctaatgctaccactcagaggacaaaaccactgtcagcatgttgtcatgatgcgttctggactttgttttccttacatgtatgtgggtatgttaatggaatcatcagctatggtgccttcttgactttctttttcttatgcatatattcatatataataaatgtatgataatggaataataagatgtgcttttttaataggaagagatattgaaaataataggttcagattgtattcttttgtagttaggagattctaagcaactgtttgttaaaagtgtttttatagcttaaagaacatataaacatgcacacatacacacacacgatacgttcactgagctattgtatgttatatgtgagctaatatgtaatatatatttaatatatattataaattgcacatagacttgcaggtgtgagttaatggattatgtattttacaaacacttttcaaatgtcttctgattttggtgtgctttgtttcccttttctaagtgcatgtataatcccagtttatgcctctgtcagagatgacatcctgcctgttcactgaatagcccataataggcaaagatattctcaattgtcgttactgttttttctttttgtgtctcaggtatgcattctagtgtttacctggagatgatgtggaaaagtagaagtgtatttgtgatgaggaaatgcttcttctgtttcactttaatgaagtctgccctttgctttccccctcatctctctgagaggcagtgctgctcctcagcctgctccagctacggaaagtcagattactggaggaagctacttattaaggagcccattcgctcactttttgggtataggactgtttttttgtttttgttttcctctgtgcatcctcagcatctggcacaggctcctcaagtggtactactcggtgcatgaatgtttccccaggctcatgttgggattttgtttgaaatcatctttatgggttttcttactagaaatgatagttttagagaagttcggcaatcttgttactggtactcaagcttatatacacgtgagtaatcttaactttggaaatatcaaccgttttctgtctagaaaaacatccacagttaaaaaccaagtatggtcatagttttatttttagaagaatttcatttgttagaggtattttttctgttcttgttctgtaatataggttaggataccattttttttttccaaacaagtttttgctgttttaattacaacttttaaccttcattggctttgtaatagtatataagagtatgtgagagtataagagtatatttggccaaattgacaacaactgaaaaataatttaagtctgtttacttttatttatttatttatttattatttattttgagacagtctcaccctgttgcccaggctggagggggcagtagtgccatctcggctcactgcaacctccctctcctgggttcaaatgattctcatgcctcagcttcccaagtaactaggattataggcatgtgccatcatgctcggttaatttttagatttttagtagagacagggtttcgctatgttggccaggctggtctcaaactcctgaccttaagtgatctgcccgcctcggccttccaaaatgcccggattacaggcatgagctactccacccagcctgtttacttttaaatcaaactctaatgtttgacatacttcctaaagttagagaaatttcatgtaaagaatacagtattttttctttatagacctgtttaaattggaaaagacttgtgagcactagagcgtaagttgttttctagtgtttctaatcaaattgaaaatggcaagagtgtttacagtaactgtaggagaaagaggattgtcttgtcttataggtaattggttttttcttgaattcttcctaattcttcacccagagaaacctcttatacagtcatgatttgtgtttttgaagactgttgggtgactggcatataataaacataaaacaaaaaactggaatttaaaaccatatggcacaatccaaattttgctatttaaatatgtacatgcttaagtgtaagttaatacgtacaaggaagaaaatatataaaacatcagtgatggctagtcttagaattacagatgaggattttagtgccaatatagctgtagttcagataatatgtcccttgctgtcaattaagcttgaacatatttttaatattaatagtacatatattcctcttttctgcattttgatttgttgcctctgtgcataatctttccgcctatatcctatatgtttatcactgagcattatgttttatttttcagagaatattggtaaggaaatttgtagaaactagataacttttcaatttgtattttttcgtttatgttcatttaaactgttgcttttcatttagattatccagtataaaaacacatatactcatttggattgctattttgtgacttgtttctagaggaaatcatgattggacccatggtcatcaatgtcatggacccttaacattaggcagcgatccgtttatgtatccttagtcaggtgtctgccctattccactatgactatgtctctgagccctgacctcttccttcactctgaacaggtgacctcacttcctctttcatgaagaaaagagaaatgatatgataggtgtgataggacctcccttaactttctgtcaccaaatctgcaaaacctatctgcatcccacacatttacttctctttccctcctgttataatggaagaagtattcttccttctaggcaaggcccagccctctatcttctgccttctcaggaagctggtggtatctgatcttctcccacctccacctctgccttctctgtttattttactttcaacttcttatctgctggctccttcacagtttttagtgttgtcataaatccttcctatcctgaaacaacaaccttctgttgaccccatctctcaactttggcttttcctccatggctagacttcttaaaaaggttgcttatagtcattctctgccttccacctcctaccagttagttttctgtaatcacattttcatactattccaagaaaactgttcttgccaaagtcactaatggtatttttttagccaagctcagagtctgtttgttaattttcatttgctttatctcagcagtgtttgatgttgttggttgcttctcccatcttgtggcattgtcctgttagccctgcagtgctcagtatccttggttttgcttttgcctgtctggtttttatgtgtgtgtgtgtgtgtgtgtgtgtgtgtgtgtgtgtagtcttttttgccagatctttctcctttgtttattccttaatattggtatttcttagggctctgctttcttttttttcacttcactttttaccccctggagttcttgtccatttttatgtctttgtcaagcatttatatcttgacaattcccaatatttttctccagagctccaaacctatatatttgtctgctggagatcctcacttagatgtcttataggagctcaaactatgtatgttagaaactggactcatcagctttccccccaaaaaaatctggtcctctgcattattttattcccttcctgttttggcaagaagaactactcttacttgaaacctgggactcatcgtttggtgcttccttccttctctcttatcccagatagtcggtaacttactccagagacctcagtgtctctcagacttatctgatccctttcatcccccactgctacagcctagaccagactactgcttaaaaactgatcaggccaggcacagtggctcacgcctgtaatcccagcactttgggaggccaaggtgggtggatcacctgaggtcaggagtttgagaccagcctggccaacatggtgaaacccatctctactaaaaatacaaaaaattagcccggtgtggtggtggacacctgtaatcccagctacctgggagactgaggcaggagaatcacttgaacctgggaggtagacgttgcagtgagccgagatcttgcctttgtactccagcctgggtgagaagagtgaaactccatctcaaaaaaaaaaaaaaagaaggagatcaaattgcacagtagtaaccagtttcctgcttttagttttcccttctttccattttctagtctgcagttggagtgatcttttcaaatcacatgtctgatcttgtcacttgcttgcttaaaacctttgtggcttttcatcatttttaggatctttcatttagtttacaaggttctcgataatctggctcctggcttcctcagcactattctgtcttaactctgtaccttcctatcatattcagcatcttagacttcactcaaatgtgcccatctttgtttctttgtattcattccatgccttttgtcttgcagtgtcccctgtttggaaaaggcagaggtatctcccatacctacacacacccagacttccacactcacccatgttcatttcactcctatttgtcttttgactctttgccttaagatacacttcgtgtcaaggcctcccgtgaaactcaagatcaggttaaattcctttgctacttgctcttataacattctttacttcctccctgcattaatcacatttgtaattttgtttttttgtatcttttttgctgtctaacctgtatgctgtataaggggaaggactcttctgtctctttcaatgttgtatcctcattgcctagtatgatgctttacacattggagtggaacagaattctagtatgttttacttctatttttgtcctagaaaggtctctaattttaaaattgaaaattgttggacagaattggacttggcataaagaattaaaattatgggcaacttttttggaaacataagtattccatataattgcataaaatatgtattcttttaagctgtatagataaaaatgaatcacttgtatcagagtcatggaatactttatactagggctaaatgaggaataagagaatgatagtttccattgtagctgacagtatttccaaatgtggttaatcttattcaaagtaaaagaactaaaagaacattgaagacatatgttaagtgaaataaaccaggcactaaaggacaaatattatatggttccacttaaataaggtacctagagtagtcaaattcatagagatagaaagtaaaatggtggttactgggagctggggaagcagggaatggggagctactgtttaatacgtacagtttccatttagcatgatgaaaaagttctggagatggatagtgaatgtatttagtattactaaactgtacacttaaaaatggtttaaatggtaaattttatactaggtatattttaccacattgaaaaaaaaagaacttaaaccaatgaaatacacctaagaaaaacaatgagtagtatatatagtctgcaggtaaaagacaagaagatgatgtcttttcattgttgttttcatttttatttgtttaaatatttcctaggtaaattgtatctatatgtactatagaatagtcattcttaaatcttagagtgatttcttagtgtttctatggatatattagttaaagattactcccacaggccaaacggaacagaaaattgcagctacatttcagtgtggattctgccttaaaaatgagtattcttttaaaattacagttgttggctctgcctcacttaaccattggcatctctgactcattcagcaaatatttattgtgtgcctcctttaaagcaggcactattttgggcagtggaaatgtagcattgaacaaaacagacaaaaattcctgtcttaattgaggttatagtctaatgttcttttttccttattgtaaaaaatattttatttcataaaaatcatttgtgagttctttagcaattttgagtgaagccaaggcatgtaatacaacactctccaaaatcaggagctgatatatccatacccattagctgtggtgtttcttccctcctactgtctccataagttaatattgttttctacagaatagattactatgtaatgcccattaatcatttttaaattaaagttcaaggtttgctaaaagagaccttattagactaatagattatacttacatatttttgaaaacagctagtttgcgacgctgttttgcttttttaaagagactttaatgtcacatctgtatttgtcatttctgaaagactacactgaatcttttctctgccatttatttaagaatagcatgatattggcaagttatttaaaacaggggcgataatacttcctgtgggggaaaaactgctttttcttatattaaatagtaagaattcctttttctttcttcactaatcacagttatttctttataaaagaataacttatattctgttgaatgcataatactattcagcagcttgttcatagtatttagttccttgtattccatactggagcatgccaactatctccctcccatacccctgtattctgtagcccctaggatcaatgtcacgttctcctacctagttggttggtacctattatcttggactcccatgattaaatataaattccttcaaccagaatatctctttctgtatatatttgtcagcttagtagttctacttgatttattagtcaaaagatatcaccttgaataaaaagcatgaaagatgatgcggttataaaagcagccaaaagaataacaaagcagttttatcagcaaaagaaatcagacacttaggaaagcaagaaatggctagagtgtctactgcaaaggaggaaaaccataaatttttgccaagctccttcttttatctacttgtcggttctttatataaatcataattgattttccaaaacactcctgttttatttttgggtaccttttctggggaaaaaacactgaccaggttcttcatactgtttttttttgaggctttacctagctcagcattctctctcagccttcaaaacatgatggactggttgagaagatttgattgataagtcaaagtatactttagaacttgagttgattatcttcttagaacagtttaattgactcagatgaatcattttaatttttaagttaaattttatagaaccaataagtatcctaaatagtatgacatctaattacatttttatttagtgttataggaagattgtagatagatttgtgttgatcattctgggcatttatgtggtaagctgtgcttaaagtaatggccccataagaaatattaaaacatcttaacctttaacctttgatcttctataaaaagcagtagactttgtgtgggatattcaaaataatgcaaagaacacggctgtttttccttaaaattcaaaaacctacttagtattttttaaaaataataactagtaaataaatacggttttacaaattttcatttcagttgcttttgccaagagtaagttatttgacgttggtaactgacaaagtgaaaaagcactttcagaaggttatgagacaagaagacattagtgagatatggtttgaatatgaaggcacaccactgaaatggtgagtgaatttttctgcattattaagcattaagtatatactagctttaaaaaggtatagtgccctgaaacaattgtaaaaaaagtcctgcgaggatagaagtcattagtctagctcatacaatatgtgaagtttagactattactagaatacgttattgaaaatatttctgccttctgtttggatgcatggatgactggacagattcatatatttttagcaatagatttttatatggtacaataagaatatatttggttatgggctattttcagatatatttaaaactcccttatgaaaagtcatctcttgacattattcaattttatttctgacaccaaaatatttataacatctttatatacatgattaccttaagtggcattgttcaaactgattgccatatttagttgaccactgtgccagaaacacatcttaactaggcttggtttagagtatttaaaatatattgatttcctttttacgtgaaaaataaatttgatgttttgcatttttaagaagggtattgaactgataagaacagatactacacgaatcccagcactttgggaggccgaggctggcggatcacctggggccaggagttcgagaccagcctgaccaacatggagaaaccccatctctactaaaaatacaaaattagttgggcgtggtggcacatgcctgtaatccgggctatttgggaggctgaggcaggagaaatgcttgaacctgggaggtggaggttgcggtgagctatcacaacattccactccagcctgggcaataagagtgaaactctgtctcaaaaaaaaaaaaaaaaaaaagggtattgaaatcaaatcctaaacctgtgcttatccatgtactaatgatgttttttggtgcttcctctgttattgggagttttgttcattgtgcttccaaaaatatttaatgaaactggaaattacagagagaagaatgtaaaaaaaaaatagttgaaggtatgctggatgttaatgttgaaatgctatcatttggatacagttgaatgaaaaaaatacaggctaagacagatttaaatgaaacatgaaaaatacaaattggttaaaaatggacttgctctctgaatcggggaatattaaaatgaagagtttttgaaagagctttaggacagatgaaaggaagctacttaggtgtttaataaatgcagctgatgtgaatcaaaggactatttattagcaaggagagaaattttggaactcaccttgtgctgatgagatcccaagaatgagtagatttttcataatggattacaaacataacaaggttgtattttgggtcccgtctctaatcctttgagatggttctgggaatttatgacacagttgtcttgttatagcattctttctttaaatcaaaacaatactgagcttcatgatcatgtatcagactcctctgattcttcttgtgtagttctagacctcacgcagcatagataaggcaatgcttcccatttctttttatttctcaggagaattggagattttggaatgggaaggcgacttaaaggaagtgtaaacagagcaacaattattaaatagaagagtagaatgacaggatggacggggaaacagtgtgggagagtagcaatgggatgtatgtatgcacttgacatttctagctatagttatttacattgtattgcattatatgtattacagattatctcagaattttgtgtgactagcggggcttttcagttttattgtaaagcaggatttctcaatagggtcactactgacattttgaatttgataattctttgttgtggtgggctaccctgtacattataggatgtttaacagcagctctggcctcttcctacaagtgccagtagcacttcctccagtcttgattatcaaaaatgttgccagatgtccctgaatggaggcagaaccgcccccagttgaggaactctggaaaatttgggaaacctcaatttagcttgtaaagtaagtgattgctaagtcatcatctttcagctgctgttttatgctgtccctcatggtggttattcttgtattcaatatggcttatattttataggtttatgggtaaatagtgtttggacccatttctccttgtcactgcaaaacaatgattttggcttaaatattattataccatgttcttactttgtcagtatttatccctttggaaagtcttttattaaagagtggagttcttttcccttttagagagcttatgtgaaagtaattatattcaagtatctttatggtagttttgggggtgttaactttttatgtgttatatcacttccacagttatgtcatgctgtaagctcattgtagctatatgacttttgatgcatcttttcctttagtgtttttaagtactccatatatatgaggcgtgaataacttccagagccataaatgtaatccagggcctctgggcttagtcttgatcttttctctctttgcttccagtaatagcagttttctctcatgttaaaaaatgtatcttcctggaaataggctatcaatataagaatatctggcatttaagtagtgggcttcgcaaaataggatagttctgtgaatttccatcagtggaggaaagcagctaccactgaagtgttggaagacttggacttttgagaccatacaagtgtcttaaggatagagaagcatttatttgagttgaataataacgtccttcctatatttattcttcggagttttaaataagttcaggtaggaaaggaaattagtcgccagttgagacaactcataagtgagggaagaaagaacagaaattgatgtttcttctctctttataaccttgtcactgattctgtccctgaattcaattaagtttgtcttttcataaggtgacagttctcaatgacaagaaaaaaaaactaaagtccttgacaaatcatgactttcatcatactcagttgggaaaaatatgactttatcttcctgttggtaggacatagatgaagagtaccgggggctttgttttttaaacaaatgcttggttttaaagattttttaaagaaatagtacatatagtaaagttagttatagataatagcagaatggagtattcttaaaacaaattatttttcctttactgttaattctttcttactattctttgttcatctacttggctagcagactctgtgtgagaagggaaaaataatcccaagcatataattaatgtggaataaaattcatcttttttttttttttttgagacggagttttgctcttgtcgcccaggctggagtgcaatggcatgatttcggctcactgcaacctccacctcccgggttcaagtgattctcctgcctcagcctcctgagtagctggaattgcaggcttccgccaccacgccagctaatttttgtatttgtagtagagacagggtttcaccatattggccaggctggtcttgaactcctgagcttaggtgctccacctgcctgggcctcccaaagtgctgggattacaggtgtgagccaccgtgcctggccaattcatcttttttggagtatggtttgaagagttttcaaacaattgtgtacagttgtgtagctacttacaaaatcaagataataagatatttaatttcacaaaattccctggtactcctttacagttacctcttccttcccccaactcacagtaattactgatctgatttccatctcagttgttttacctttttcagaatgccatataaatgggctcatgtagtatgtagcctttcgtgtctgaattttacctcgagtaatgtttttgagactcatcctttttgcgtgtatcagtggttttttcctttttgttgctgagttgctgagtatcccactgtatggttataccacaaattgtttattcattaactgatggacattggattgtttccattctgggactatattgagaaaagctgctgaaaacacctagaggtctttctgtgtcaagccacatatattgtaaaagataaaaattaattttgttttctgaatgttcctttattttttatttttataatttaaaaaaattttactgtggagcgcttcacaaatttgggtgtcatcgttgtgcagggccatgctaatctctgtatcgttctaattttagtacatgtgctgccaaaacgagcgtgaatgttcatttttagtatatggaaaatgttattgatttttgtgttctgcaaccttgctgaactcacacactagttctaggtgtttttttggtagatcctttggggttttctatgtaaacagtcttgacatctgcaaatagaaattatataatttttccaatctgtaggccttttatttcttttcttctttttttttttttccttattggagtagctagaacttctagtactgtgttggataagagtggtgagagtggacatcttctggtgttcttaattttatggggaatgtattagtctttcacaattgtcatgaatagatgttggattttgtcagatgccttttctgtgctaattatatgattgtatcacttttcttccttagctggttgctataatagatgacatttatggatttttgatgttggaccaaccttgtatacatttaataaatcttatttggtcacggaatgtaataagttttatacattgttggattcagtttgccaaataatatttcgttgaggatttttgtgtcttatgttcataagagggattgtagttttctgttttttctattgtctgatttagcattagggttatacgggctttataaactgagttcgaaagtgttctgttctgatgtattttctggaaaaggtcgtgtaaaaatgctgtcaattctttaagtgtttgatagatatctttagtgaaaccacttgggtctggagatttctttttggggagcatgttaattaccaattcaatttctttgatatatatagatctactcagcttgcctatttcctcttcattgagtgttggtagtttatgggttttggggagttggtttgttttttctaagttgttaatttatgaacatagagttgtttatagtatttccttgtctgtgaatgactttaggatctgtagtgttgtcttcatttttgtcagctttgttagaggtttaccaattttacttatttttttgaagagccagtgttgtggttcatggatttttctctcctttttaaaatttccaattttgttggtttctgttttttgtttttaataatcttattccttctgctcctttggttttattatttttttctagtttcttgaaaagggacttaggttatttttttgagctcttaccttaatttcttttttaaattgtagtaaaatgcatgtaacaaaatttaccatcttaaccatggtagtgttaattacattcacaatgttgtacaagcatttagtgttacaaatatctatttcagccaggctttagtatagaccataaattttgatatgttctgtttttgttttcattcgggtctgtgtatttttaaaattttcttttgaggctttcttttggaatcttagttttttttagaaatgtgtttaatttccacatttagtggtttttctgttatcttttcattattgatttctagtttgattctattgtagtaaaaaaagagctcactgtaattttggatcttttaaatttgttgatgttcgtctccactcttgattccctcatcatctagcctctagattgtgattctggcttctaagtatgccttaaactccctgctttgtttttcgggattcaggcccatctgatttctcacatggattgttttagtggcctcttaatttgtcttcctgcttttaatactattacttttagtttatcttccccagtgccataatttttctttctgaaatgcagatctaacattgttattgtcctcaagaaccctattctgacttaccatcatctacagtataaagccaaacactaaagcatgatgtgtgtgtaaaggttgtccatgatcccacttctttccaggtctttccaggtgtactaagctacttgttttaatgaatgtgggataatgttttgggcttccgtttctttgctcatctaatttgataaatcttttttgctctttccagcatcctttgttttggttgtaattaattattcattcatatattccctcctgtagctcatacttctaacatctagcttaactatgaccttttttgtggttctttttagcccaaagtgatcatttctacgtttgtgccatctctacactacgtgtgtacttcctatattcttgtcatgttataactgtgtattgtaacataatggttattaaggatgctgactctggagtcagaaaccagatttcaaatcccagcttcatcacttactagcggtataaccttgggcaagttatttgacctttttgtatctcagttttcttgtctgtaaaacagcaatgataatggtaccttgtacttcgtaactttgtttcaagaattaagtgagttaatatgggttaagtatcctttatccaaaatggttgggaccagagtctttcagatttcagattttttcagattttggaatgtttgtattatatacttacagtattccaaatctgaaaatctgaaatgcgaaatgcttcaataagcagcagttcctttgagcatcatgtcagtgttaaaaaaggttcagattttggatcatttttctttgtacttaaaccagcagcatataggaggggataagtaaatgtttgttcagtgaatgaatgaatgaatgaatctaaatttgccccttgcttttatttggaaaaccgagactcaaataagtaaggtaacttgttcaaataagttaggacccagattttgagagtatcagttcagggctctttttaccacacctgctaacattttgtttaaaaatttttctcccatcttatctgttctctctaattgcttatatcaatttgtccaaattagaattaaaaaaatttaagaacagtggtatacttataatgaatactcaatacatttgttgttgtcgatttgtagagagcttacaaggaggttatgtctgattagagctttatctttgcatctttagcttttaaaaattacatgggaaatggaaagtgctggcctaactcaaaatagagtctctttcttcagactgagatgttagtcagcagagggtgctctaacattgtattttaaggggtgaagtttcttattaccacaactggtgttcacattttatatttgttagttttatattagaattatgttaagagaccagttcttggtccttccgaagaatactttgtaagtaaaccctaattttggtttagatcttagaccttcaagcacgaaatttagaacaagcttctcattttgtcaactgtaaaataaataactttaatgggaaatttttctctgcaaattgactttcaggacaggtggtaaaaggaagaagttgaaattactttttgaattgtaaaaaaaaatacatactcttgggctacatgattttggtcaatgatggaccgcatttaggatggtggtcccagaagatgataatctgtatttttatagtatcctttctgtgtttagatgcatacatacttatcattgtgttacagttgtctagagtattcagtgtagtaacatgatgtacaggattatagcctaggaacattaggctacaccatgtagcctaggtacgtagtaggctatggcatctaggtttgtgtaagtacactgtgatgtttgaacagcgaatgaaattgcttaacaatgcatttctcggaacatatccatgttgttaaatgtcccatggctgtattgatgttgatcttaaacatagacatgatagaatgactcagaatttaatactctttgtgatttcaaaagtagattttagcaaaatgctttagtgaaaacctgtgtataattttttaaaaaacatttaacattttaatcataaatgctaacagattcttctgtcttatttccagtctttttaaggttgtgaatttctggaacttaacccatttatgcaggagattaaaattttttgtgtgtgaaaaatcagaccttgtcagtgaccttgaacagtttacataactcccacaagcttagcgttccaataatggaaaactaggcataaaggagttaacaatgtattctgtaaactagatttttgaaatgtgacttacatagattttatatatgtggtatcccttcattatttttgaactttttcatatataagaatgggcttagaaagctgtgaaacacattgctactctatagttgtttgtgtttgtcctacatatagagtaagtcagtattcacagcaatcatcaaattactttggtttgcatttgtagttacatgcttgcagttacaatgaaatgtaatcccgtttccagtgaatcagaatgcagcaactttccgaataggaggcatttattttagtgacatgaacttgggcagtagttctccagtatggggaaaattctttcagtgctgattttagaatacttgtattagtttgctatctgagtacagatatttatactagaatcatgtcccttctgagaatatccattattgctacaccatgtgccaatgtgcacacatgcacaaacatacacacacacataaatggagtaatgaataaaaaacaaaaagcaaagaaatattaaaatatattcatttcgagaattgaatatggaagactagagcaatgtaaagaagaaaaagaacaaagtgtaaaaatagacctaatactgttcttatgcagtcattttctatagggcaatacactgagtctttagctagttgggtcctcttatttacacagaaaatacagttctggataagagttggtgttctgtatccatgggttctgcatccatggattcaaccaaccatggattgaaaatatttgggggaaaaaagcaataactaataataatacaacaataaaaatgaaatcacaaaaagtccaatatggtataacaactatttacgtagcacttacattgtaataggtattataagtaatctagcaataatttaaagtatacgggagaatgtgtgtaggttatatgcaaatactatgccatttaatataagggtttaagcatctgcgaattttggtatccagctaggtccaggaaccaatccccacacgtaccaagggtggaccgtattccaggttcaaatccttactacttgcttttctattaaatttaagttagatggtagaagtagcaacataatagccaatggttacgttatgatttacttagggtatatgtggtttctgtgttgtgggttagaaggcttctcacaaaactgtatataatatctgtttagaagacttgtacaaattagtacttttgaaatccttgatgtaaatcagattaaagtgtaagagaaactcagtacctttaatttttgccagttctgttttcttttatagattgtgttgaatatcagtagattcattagaaataagcaatctgggaaccagtgaattcagatagcatatttgtttggaattaatatctttgcatgaaaataattctaacataaaaatttgtattgaaccgcatgttaattatggaatttgacaatagaaataagtaaatggttatcttactccttcgtttttctggttcatttttatttttaaaaaatcataacaggatgattattcatttttataatatttagaatgtttttatgttaatactttatttattttttttatggagatggagtctccctctgtcgcccaggctggagtgcagtcgcactatcttggctcactgcaacctccgcctcccgggttcaagcaattctcccacttcagcctcccaagtagctgggactacaggtgcatgccaccacgcccagctaatttaaatttaaatataattttaaggaagcatatgtttaaatttatctcctaattcttaatatgccaagacaaaggagttgtcgtcatttaccatctgggaccaatgaaatttaaaaaaaaattttaagattttgacaggctagcgctgggtgcagtggcccatgactgtaatcccagcactttgggaggccgaggcggacagatcatgaggtcagaagttcaagactagcctggccaacagaaaccccatctctactaaaaatacaaacattagccaggtgtggtggtacgcgcctgtaatcccagctactcgggaggctgaggcaggagaatcgcttgaacctgggaggcagaggttgtagtgagccaagatcgcacaactgcattccatcctgggcgacagaacgagactctgtctcaaaaaaaaaaaaaaaaatagattttgacagggtctccctctgttgagtacagatcatgcctggctaattttttttgtagagacagggttttgccatgttgctcaggctagtgtcgaactcctgggctcaagcaatccacctgcctcagccttccatagtgctaggattacaggcataagccaccatgcccagccccaatgaactttaaaatatatatgtgtgtgtgtgtgtgtgtgtgtgtgtgtgtgtgtgtgtgtgtgtgtgtttaagtcattttgcaaataatttagagaatttagaataaaggaatagtgtataacaactttattagaaattttaatacaggtttaagtacagcaaatttacattttcatttcatatttttctagttttaaaggtatctaaaatggtcaacatcccctgaatgcaactaattgctcattaatttttatacattcaaatatacctctgagaggttctagtttattacttctggcccttcttgcatctaatagtgttaataatacttgaagaaatctataaaccctttgccagctcatgatttcattatgaaatattttcttttttatgtgaatcaacaccaattagactgagcagcccagtactttttttcatttctatgtgatctaattccttcagtcttctttttatataaatagaacttttgcatttgcccactatcaaataaatttgtgtaaatagcataaaagatgaaataatattgtcacatgttcttttagtaaaaagaaatggtccaggtttttgtcataaaatatcatgtaatgaagttttttctgttgatgactaagctgttaagattaccatgtgttcctttttgtctttagaaatatattgttcttctattagttcttgagctatggaaaatttaagatatcatctaaagactcagagtttgagatttcacttaaatgatcaatttcactattgtcattaaagtctagagtactgctgtctctctttgtattttgtcctgatttgtctaataattgtgaaacatcttcctctgtcagtttttttctctgccattgttggtagaaaatgagaaacttggaattttcaactgtgttaatgatagctaaaaactgattccagaatggagtctgcttgcttttttcttttttctgagaccaagtctccctctgttgcctaggctggagtgcagtgttgcagtcttggctcactgcaacctccacctcccaggttcaagtaattcacctgtctcagcctcccgagtagctaggactacagacacatgcgaccacgcccagctaatttttgtattgttagtagagatggggtttcaccttattggtcagcctggtcttgaattcctaacctcaggtgaaccacccgcctcagcctcccaaagtgctgggattacaggcgtgagccaccacgcccagcctgcatgcttattttacactttattgaaagatgtttcaatactttaggcaacacataagaaaatgaaagaagggtacattcttctatcatccttctaggcatcatgttattttttcaaattcttactgttttagtgtcttattgggaataattgacaaataatgatgaaataagttctagagtgatgaaatagtaaaatgttttgatacataggaaacaataagatcattaagaccctaaaatatatcttagatttataaaagtgtccagtagctccatgtggtaattactacatggagtaagttttatctttttttttttaaagtgagttttttctgttctttggaatacctttaagaatgaataaaagtcatgaagtgtcaatcattaaaatagttggaactgctcaaaaaagaaactcagaacctaaaattggctccattagatctttatgttgtacctagggttagtctgtggacttcttcgatttatgcattcagcagttgtttattatgtactttgttcaagcttctgtgtatttataattttctcatttttaaaatatttatagttttctcgttttttaaatattgagggttaaaaaaataatttatgattgagtcttatgtttaacttgtattctgatccagatatttccttaaagagttatttgggctggacatagtggctcatgcctataatctcattactttgggtggccaaggtgggagtattgcttgagtccagaagtttgagaccagcctgggcaacatagttggacactatctctataaaaaataaaataattagctgggcatagtggcacatgtctgtagtcccagccactcaggaggctgaggtgggaggatcgcttgagcccaggaggtcaagattgtagtgagctctgactgcaccactgcactccagcctaggttacagagtaagaccctgtctcaaaaaaaaaaaaaaaaattacttgattttatattatagattgctttaagatatatttgttttagaatttgcttacaaattcacaaaagtgtttcacacatttgttaatggcagggaatatgtaaaacactggattgctagtaattttatgtgatctcgagtgaatcttatctaatagattagactattttgcctagcggagttctttgtgttttcagtgctgtttagaatttggaaagcaatatggtgtcacttttgaaatgttaagtctttttaatgaaatccaagtgaataaaactttaattaagtgcctacattcatctttaaccctgttgcagatacctaagagagatattctaaaaaataaattgaagacgttaaaaggtctgttttgtaaaagtataaggtattatttagagcttgttcaattttaatactttagagagaaggatcagaattggattaaatctataacttgtctatagtactatatatgtgtgtatatgtgtgtgtgtgtgtatgtatatttttttttaattttaggttttgactgaggcgagagtttttcctggttccagaattttcttcagtattagtttctggatatgaaaggattgattagagagaaatttaagggatattattaagagatataatgcatataagactaaaagtacccccactgctttatttttaccgaccgggcgttcatcctaaattcttttttttttttttttcttgagaaaaggtctcactctgtcgtccaggctggagtgcagtggcacagtcttggctcactgcagcctctgcctctcgggctcaagagagtctcccgcctcagcctcctgagtagctagggctgcaggtgtgtgccatcatgcccagctaattttttttttttttgtatttttgggtagagacagagtttcaccatgtcagtctcaggtactggaactggtctcgaactcctgacttcaagtcaagtgatccacccaccttggccccccaaagtgttgggattacaggcttgagttacagtacccagcccatcctaaattcctaccaaataaatacatgatctctagaaactgatgacttttccataattctatacaagtaagcaagcataaattatatatacaattatatatataaacatatatctatgtttatatatataagcaaatgtgtactgctccttgcagtgcagggctatcccataagcatcgtgcccagagtagcacaagcataaataatattaactgatatttgaatcttggtcagagttactcattttgagataaatttgatgtgttttcaaattttgcagctcttaaatctaggagtaactcattaatagattatacagataaagacaggactgtgtataacaccaagtagtcttctttttgcccttgttgtgagtacagggtgagcatcccaaatcccacaatttgaaatccagaatctaagactacaaaatccaaaacattttgagcactgacgtgacactcaaaggaagtgctcattccagcatttcagattttcagatttgtgatgctcaaatggtaagaatatgatgcaaatattccaaaatttgaagaaaaaaaaaaaagctgaaatctgaaacacttctctaatcccaagcattttggaaatgggatactcaacctgtattatttaattctgattaaccaagtaagctaatttactttagattttttaaaaggatgacttaaggtttgtccattgaaatctacaacatttgtattagtcatgtttatttattgctaagttatttacttcactgtgggtaatggttatattaggaaatgttctcttattttggaacttatttttttaaatttagaattaggtttcagaagaatattcagtggcttgggaaaatgttgacattatattatgtgaaaaaagttatagtacagtttgtaaaggatagtcctaatctgtatttagatatgtatgtgtaggtagaagactggaaatgtatatgctataatgttaatggtaataaccacagaataggtgatttgcatgcgttttagttgctcatcttggttcttacagttttttaaaattttaagttctaaaagtaaaaaacatatttaaataaatttacaaaaatcaactgtcctttatgaatacagggatgacaattagatgcaacagtactgtgacataacagttcacatggctgataaagaatgcctttgcccacaatcctattgtgcatattgaggtttctatgggaatggagtggttagaaggaaaccacctgatgcctggaaagtagatcatactagcctaggcacgtaactgtagaatgtagtcttcctgtgatttgtgattaaagcccctgacatttggtgttaaaatatgtgttggaaatttattttggccttgtagttataactttaaatatttattttctcaaaatatactgtttcatttttaggcattatccaattggtttgctatttgatcttcttgcatcaagttcagctcttccttggaacatcacagtacattttaaggtatagtaaattgcatttctccttcgtcccatttgtgatacataataaatagacttcgagtagaattttctttttaagtgaagttatttattgcttttcccctgacactgttttagttgctaagcttcgattagtatttgtctataagatacttttcaattttttcctaactcttggcagaaacacttaaacttttaatatatgaactgcttttctttattagtgctgaatacactttttaaaatttacgagtttttgggccagccttggtggctcacgcctgtaatcccagcactttgggaggccgaggtgagcccaggatttcaagaccagcctgggcaatgtagtgagaccctgcctctataaaaaataaaatttaaagttttgaaagttggtgttaatttttaaaagtcggctagaaaaaacaaaaatcttgcatgtagatgtggatatggaagtacagaggggacaacctaatactgttgagtaattctaaggctattttgaatgaattaagagaagggttaggagatagaattccaaagatttgatctacctctgttttgaaaaatgttcattcctgtagtttttaagaccagactgaatttagtgtgacctaattttgtctcattattttatgaagtgctggtccctcattcccttagccaccttgcttctgctctgttcccctcccccaattcacaaacaccatttggtttttgtgattggaaacacttatattaattgattacgaacagtaattcattctcaaatagcaatgattccaccatgtcggtctcttatattagttgatcacgaacagtgattcattctcaaatagcaatgatttcaccatgttggtctcaggtgcttgaactggtcttgaactcctgacctcaagtcaagtgatccacctgccttggcctctctccaatacattattggagagaggcatgtagagtttgaaaaagtcatttaggtgtctgagtttctttcccatcggggtgtccattcatagttactgcccaaaggttgctcattcattcttcatgtgatgcttttccttcctgttttactgaatttgagtttgtgggtcattagagcttatttccgtgtacatttattataatgtgctttgcacaataccatgttattaaacacgttagttaccaaagaacagtacagatagagcacatagtgttggtatgcatgaatttcatttaccatgttacatgcaaagcaaggaatgcttgcatatacaacaatttaagtttagagaggtgtggagataaaactacttcaaacatattaagggtaggggtgctatattgcctaacgagtcttttctgttaatgttggaaggtaattccaataattagatttttttgtgtgtgaaaaataagctctaaaatactttgaaatctagattaaaatatagctgtctccttgtttatttattcactcattcattcattcaacaaatatggagatccttctgtgtgtcgggttcctgaaaccctttcaatggattcatcaggtcaaatctgtttccatgatataataatatcaggatgttattggcccttcccgttgtgttaacatttacactgataatgcaacaacaatggtggttaaaactgtgggtgccttagcacaaagcagggcattgtacctcactgtactagttgtcattgttttctttataaccacacacttagagtaaaaagaacaccagtttaagacttttctggatgtagtagtacaaagtattaattattattaattttgactcttaagtacatgtctttttagtatcctgtatgatggaatgggaagtacacataaagctcctctgttgcatgccaaatatggttgtcttgaggaaaagcacttgcgtaattttttggttgccagctgaactggccacttatttttatgaaacaccattattttacttgaaagaatgattgacagacaaactgtggttgttgagactttgttatttgttagacattttcttgaaaaagaataaagtgaacctctcactgcagggaaaacaagtgatagtatttgttgtcagtggtaaaatttcaactttttagtgaaaatttgaattttggaaaacatgatgccactgtaaacttgaaagctttattcttaaataattttctgatgagatcggtggttattttaacatctgatgttttaaaagtttcatagtgaaagggtcaacatttggaatgcgtaaatcagtgaacatttccagatgaccagtgcttgatgttacaagatcatgcatgtgtaaaaagatccattcaaagtgcaacattagaataagaaatcttaatgtaacagagtagaaaatgttcactggtaatgtttcagattccacattattattacaataaactggatgggcatgatacctcacacctgcagtcctggcacattgggaggctgaggcaggaggattgcttgagcccagaagtttgagaccagcctgggcaacgtagaccccatctctacaaaaagtttaaaaattagctgggcgcagtggtgtgcacctgtagtcctagctacttgggaggctgaggcaggaggatcgctttagcccaggaattcgaggctggagtgagccatgatcagacaaccgcacttcatcctgggtgacagggcaaaactctctctaaaaataaatgaacgaatgaaagaatgaatgacagggcagactctgtatctaaaaataaaataaaataaaataaaataaataaaataaaataaaatagataaataaaataaaatatataaaataaataaaataaaataaaataaaataagccaagtatggtggcatgcacctctagtcccagctacttgggaagctgaagtggaaggatcacttgagcccaggagtttgaggttacattgagctgtaccactcacagtgattgcactctatcctgggtgacagagtgaaactctgtctcaaaataataataatataataaactgaacttgttaaatttggtgtagtattgaagaatatccacaaagccaaaaaggctattaaaatacttcttttaaactacatatctttgtgagcctgaattttctttatatacttcaaccaaaacaacatattgtagaatattgaacatagaagcaagtttaaggtaatccattggttgtctattaaggcattaaagttatttgcaaaaatacaaattagtgccagtgttcctgttttttttgttgttgttgttctgggaaacatagttgatttttgtggaaatacaattttagtgttaatgtatagtggttttattcttggtatttttaagtgaattaatgttttttttaaatgtttcagctctaatttctagtgtaaatatcagtaatataatccacataaatataaactctttgggatccttagtaggtcatacattttcttcccagtagaaaagtttattagcaaatagaaaaaagaatcttacagttaataaggaaattacagagaacatttagagtttgttcaagctatcagtgtgtttctttcagctgttcttacttattcttatcctggcctgttagaggaaagttattgcccagattttttttttttctgtatatactaagttccattcatttaggggagcatcaggacctaggttacttcaaaggttgtcttcacatgtttaattgatagcttgtactgattgatgtaggcctgcctctattgtactgccttatagatttttgattgattataatgaaactgggtaagtgttaattttcaggcagaaaatcaatgcttttagtgaggaagtggtttttaaagtttgtagaaaatagtttatacattcaacagattggatgtattgagtaacaattttgtgtcacttggtgtctctgcatttatcttctgtggtgttgtattgagtatgccagataatgttgatgttttaaccagacttcttagaatttcttttacaattgttttcaaaggttgtaatagattttgattagatttttttgtgcaatatcaaagcttctaagagatcctgttgcctctgccacacacacacacacatttggatcagtagttcagactaaactcttcaaaaaaacactgttaaacagttttcaaacagacatatttcctctaatttttaactgactttgatgtttgtgatttgtataggtttataatgtttataataaatgcattttaatgtctacaatagtgattttcaaactttaatgtgctttcaagttacctgtgtctcttactaaagtgcagtttctgattctgcagcattgggttggattcagagagattctgcatttcttacaagtgcataggtaatgctatgatattgttccaccagaccacatgttgattaacaagagttagagaacaatgaagatctaaaagttaatggtaattgtctgtagaaccaaaagcttttaagggtgaatcagaaaattaatatttttataggcatttttgtattttctattttctgggagataaatataattgtagagtgttaattgctttataacatatagatttggatgtatgttttgtttaccaaaacaatgaaaatggtaccttcttcaagcttttctcattggtttttaaggacattttgattcctaaacttggtgagactaccaagaaaattatctcatttctgtgtccccagttttttatattaaaaaatttaaacatatattagaaaaattaattgtgcggcagggcagtgactcatgcctgtaatcccagcaccttgggaggtgaggcaggtggatctcttgaggtcaggagtttgaggcctgcctggccaacatggtgaaaccctgtctctactaaaaatacaaaaattagctgggcatggtggtaggtgcctgtaatctcagcttctcgggaggctgaggcaggagaatcgcttgaacctggggggcggaggttgcagtgagccgagaccatgccactgcactccagcctgggcaacagagtagactccatctaaaaaaaaaaaaaaaagttaattgtggtccagtgaatactcataatacctttcacttggatttgctgctttttaacattttgccacctttgcgttttctctctgtattttttttcattaattctataggcatgctgcttgcaaagcgacattacagttaaaagattacttacagtatgtagattttttaaaattaaaaaaattttttctctctttgtccatgttgagaacagtgcatggaatttttaaaaaaggagttaatgtgattcaaaagtttaatgacatcaggtgaaaatagtggggtctttaaaatgcccagttctgttgcaaatcctaaataaagtttaatagagtaaacaaatcctataaaaccttggtgtttttctttcttcctcttggtaacatggtgctgatttggtgcgttttggttttgaggagaggagacattttaattttgaatgttgacagcaatgattaagggtaagagctcacatttgttaagtaaaataagatcaacattcagataagtgcttatgtgctgaactctgctgaatgccagagataacacaagttaggtttttgaaccaactgtctttcaagcacagcaggcaaatcctgttttgcttaccatgcttgaaaaagccctgcattggtcctgactgttccttgagtatttttgtgtgactgagcaagcttcttttctgatggacaagttttttcttgctaggccaagagccactgtgtttctttgaaggaatttatcatgtccctcctcctgttatgtgttgttgacataggtctgtggtagcttttctttcctgaagttcttgagtgtatttcatggtctctcctttgcttctatcactgcctgcacttcccagctataaatgttggtagctgttttatagtatctatcaatagtatgttgtattagttatctactattgtctgacaaattaccaccagcttaaaacaacatttgttctctgacagtttctgtgggtcaggattctgggcatagcttatacctggatcttctgcctaggttatgagggtgccatcagggtgttggctgggctgcgttcttaactggaagttcaactgagggagaatccacttgtagacttagtttgctggcagaattcatatcctatggttgtaggattgaggggcctatcttcttgttggctgtcagtaataagctgcattgaccacctaaagaccatgtgaagttcttgtcatgtggactttcccaacatgcctacttgcttcagggcaacaaagaaagtctagaggtagtctggtagtaagacagaatcttactgtataacatgacttaatcactggggtaacatcccatcacctttgccgcattctttgagttagaagcaagtcacaggttctgcccacatgcaagggggaagggattatagaaagataggaataccaggtggtggaaatcatggagggtcatgcaaacttagaactttatgaagtaaggcttgtttagtcatttattcatcagatatttattgatgttaacatatacttttagccgtgacagagtaactggtatttgagttttcctctagtcatcaacaattagaaaacaggaccaaaaatatgaaatagagctgtttttagcactgaaccttagaaagggaacaaacaaggtgagccccatgtgctttggaacggttgcctgacggtggtacggagagtggagctcaagcagagcaaagaagttcagttgagctgaggatgcacaaattggagttctgggctgctgaagtggttggaacttgctaggcagggtatcagagaaggaggagccaaagtgtacgtgtatgttctccctgggtgcttggctgaggcctgggttgcacatgcatagctgatactctgcaaggtctagtagatagtggatgttgtagggttaagagtggacaaaagatactgaacgtcttatgatgctgggaaatgttggattccagctcattcaaagtggagagacatctggctacatactaggcagttacttgagatgccagaaaggccatgattttggagtaaggatcatacatcagagcaggagttggcaaatgtggtccactgactgtttttgcatggcctgtgatataagagtagtttttacatttttaagtggttagaaaaaaatttaaaaaaatattttgtgacgtgaaaattgcatgaaatacagatttagtgatgaccataaataaagttgcattgaaatgcatccactcatggaaattcatatacatattgtctatgactgctttgcggctacaacagcctagttgagtatttgggatagagactgtatgacctgcacagtgttaaatatttactgtctaatcctttacagaaagtttgccaatctctattgccagtctttaaccctagagtaagagttgctctggacctgcctttttaggattaaggagagctgccagtaagttaactgccagccagaacaaaacttagcatcttaaaggaagacagtataatctagaatccttacaacatattcacagtgtccaccatacaatcaacaactacttgacttgcaaataagcaagaaaatatggtccatatcaaataaaaaaaaattttactctcaatagaaactgacctaagagaatccacatcttggtactaccggaaaaatgaattaaagcaactattataaattcagtaacttaaaaaaaccacaaaattgtagaactgcttagaaaaatatctgaaatgaggaatttactacatgggcttaacagcaaattaaagatggcagaagtaaggttctttgaactcaaagacagatcgatagaagttacccagtttggagaatagagagatggaaattggtatagaggaaaaacagagcctctgggataatatcaggcagtctgcatgtaattggattcaaggagaggagagagaatgggtcagaagaaatatttttaagaaataatggttacactcctcagtgtcaaagctataataatcaagactgtgtgtgggttgcctacagaaagggagaaaatatttgcaaatcatatactatctaataacagtttaatatacggaatatggaaataacttgataataaaaagaaacccaattaaaaattagtcaaaggattcgaatagacatttctgtaaagttctataaatggccagtaaacacatgaaaagatgttcagcataactggtttttagggaaaagcaaaaaaaaaaaacaaaaaaaaccccacacaacgagttaccccttcacgccctctagattggttatcatcaaaaagatgatgtacaaggctgggtgtggtggctcatgcctataatcccagcactttgtggggatgaggcagttgtatcacttgagctcaggattttgagaccagtgtggtcaacataacgagaactcatctctactaaaataatattttaaaaaatagcctggtgtggtggcatgtgcctatagtcccagctatttggaaggctgaggtgtgaggatctcttgagcctgggaggagcagtgattcctgatggcatgtctgcaacccagcctgggtgacaagagtgcaaccctgtctccaaaaaaaaacaacaaaatacagaaaacagtaacacatgatggagagggtataggttaattagacccttcacacgttgctgatgagaatgtaaaatggtgtagcctttttggaaagcagtttggtatgtcatcaaatgatatacttaccacattacacagcagttctattcctagtaatattcccaagagaactgaatatgtaattctgatatgcaaaatagggaaataacttgcgtccacacaaaagcttatacatgaatgttcataataggcaaagtggaaataacccaatgtccatcagctgatgaataaacaaaatactgtatgtatccttacaatggagtataatttggtcatgaaaaggagtgaattactgataatatgctacaaccttgaaaataccatgttaagtgaaagaagacacaaaagactgcacattatataatgcatttatattaattgaataaataactttgtgccaataaatttgacagatggacaaattcaatgaaaacacaagtcaccaaaaccgacataagaaataacagaaatgaatagctgttgataagtaactttgatttgtaattttaaaagcctcagagagtaaaacaccctgcacagatcgtttcattggtgaagtctataaaatacctaagaactagtcgggcgcggtggcacatgcctgttgtcccagctactcagaagactgaggtgggaggaacgcttgagcccaggagttctgggccgtagtgtgctatgccgattgaatttccacactaagttcagcatcaatacggtgacctcctgggagcaagagaccaccaggttacctaaggaaaggtgaaacagcccaggtcagaaatggagcaggtcaaaactcccgtgctgattagtactgggagtgcacctgtgagtagccactgcactccagcctgggcagcataatgagaccctgtctctaaaaataaaaataaaataaaatatttaagaaataatattacaaactttacaagctttgttactctgtacaaactttttccagaaatgagacacttgccaacttgtgttagaggccagaataaccctgatactgaaacctgataaagacattaaaagaaaattataagccagtatatttcatgatcatggatgcaagagccttcaacagagtactagcaaattgaatctcgtaataattaaaaaggatggtacacaccatgactgagttgagtttatcctaggagtacaaaattgattcaacattcaaatctcaatccgtgtaggccaggtgcagtggctcatgcccgtaatcccagtactttgggaggctgaaccaggaggattacttgaacccagaagttcaagaccagcctgggcgacatagggagacctcatctctacaaaaaaaaattaaaaaaattagctgagtgtggtggtgtacacctgtggttccagctactcaggaggctgaattgggaggatcgcttgggccccagaggttgaggctgcaataaggtgtgattgtgccactgtgctccagcctgggtggcacagtgagaccctctcaaaataaaaaaatctcaatccatgtaaatcacagaataaaatagaaaaatcaatagatacagaaaaagtcattcatggacagaatttaatacgtgtttgtcatcaaaacttatagcaagcttaggaatagaagggaatttacttaatttgacaaaggatagatatgaaaagcctacagttaaagtcatgctacatgatggtttatcgaatgttttaccaaactaagatcaggaaaaaggcaagaatgtctgctcagtgtaagcacttccataatgcatcgtatgtgttcttaactttgctattaaaaattgtacagtaaaaaccacaggacttttggaggaaagggttacttctggggcaaagggttaggggcacaacatccacaaacttacactgataaaaaaacaggaacctagtaaaaaccataccacagttttacacaggtaaaatgtatgagaaatgcataaatactacaataaatatggcatttcatgttgcaaagactggaactttgcttgcagaaatggacatagaagacttgcgccgtgacaggtgaagtgaaaggaggattttctggaatcggacaagaaattgtagcacctgatgtagatgagtacagctcataacatgaattgaagtagctggtccattttggaggtgtgcacatgtgtgcattgtatgttttcctagctgattggtttagctaggtgaaattttctgttcacctagcaattcttgtgaacagtatttacatatgcaaccataaaattcacattatactcaacttgttctctattagttgcttttaaacaaatgcaaaaaaacttagttcacagaacatatatgaatttaccaacaaacatgaaaaggcactcaacatctttagtcatcatggaaatgtaaattaaaaccacaaagagacattacattacactcactagaatgactaaaatgaaaaagattgacagtagcaagtttgaggacacggagtaaccagaactcttatacattgctagtgggagtgtaaaattgtacatcatgttgaaaaatagtttggcagtttttaagtaaagttagaacatacacttactctatgacccagcatttctttttccagctgtatacccaagaaagatgaagacgtgtctataaaagacttgtgtattaatgttcatagcagctttttaaataatagccagtatctagaaacaatcccagtgtctattaacaagtttttagataaacagattgtggtgtattcattaaatggcctgctactcagcaacaaaaaggaattaattactgatatgtgtagtaacaggaatgaatctcaaaaatatgctaagtgaaagatactaagttacataatactgcaattctgtttatatgagattttattacaggcaaaactaatctggtgttatgtcattatcagtaattccttgggaagggaatgagggaactgactgcaaagggcacagaggaacttttgtgggtgatggtaatgctgtatacttgggctgacagttactcattgtcaaaactcatttaattgtactcttgatttctgcatttcactgtatgtgaatcataagtttgacttttaaaaaagtttattgagagagatgaggaatggtatctttaatcactttcaattaattcctgctttccatcagtgtttcatagtcactcaggagcttctttctttatcttttcatttcattctttttatgaaggctccatgacagggttaattgaatgttgtttgtgaatacagtaaccggagtaggctataactaaatgctgtttttttgccatttttagctccttttaaatttattaaaggacatataggataataactttgtaaaataatgtttgaatataatgattatcttaaatatttaagtctttggaggaagtgatattgtacagtggttaaaatgtaggacttgagtcaaattagccttaaatcctagccccatgactatcaagctgaatgacacttgcgacttgagacattccctaagctttaatttttttatctgtaaaatagcaataataataatgtttacctcaagtgttgttaggattaaataagataatccatataaaaagttttaatacggtgtcacagtaagtgttcagtaactgttagctgttattatctttttttcagtgaaaagtgcatcagtcgtctcatttacctaactccctatatgtccaatgatcattgctttagctgcctaaaagaatcagtgaagttatagaatgtaaatttagctatttgactttaaaatctacttttttaacagctttattgaggtctaattgacttatagtaagcttaacctagtcaaagtgaataagtttatgccacaatttatatgttcatttacctgttgatatttagatttgttttctgtttggggctgttacaaataaaactattgtgaacattcatgtagcaagtccttaaatggacatatggacataatacttttttcttttctttcttttttttttttttttgacataatactttcatttctcttaggtaaatgcctagttgtggaatggctgggtcagatggtaggtgtctgtttactcttcttaagaaactaccagacttttccaaagtggttatactattttacatttctgttagtagtgtgtgagggctccattccacatctttgccaatattggtatggtcagttgaaaagctatttttcagattattaccctttgatgcctttttttcatgttgttataaaacacataagaattatttgggaaaagtacaaaatgggccaaatagctaaagatttttaagttaaattttaaagtattttgggttatttcagtgctaagagatagtttactagaaatattgaaaaactgggggatatagttctcttttaagaggttaattttgtaatgtgtgtatcctgttttatatgtatattttttcctttgatagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatggtaagtataatagtgtttaattttagaataccactttataaaatatgatacagccataaccctgtgagtagttgatacattttagaattggtggtacaagtttaaattgtagcctctgtgcccagatttgcacagaagctacttttagtcatcccttacattctgctcttttggtgtccctctgttcatggattctctagcattagactgattgctcagcccctaacatatggcatatgtcatataaacttgggtatagcttctgaaggaaatgccattactctaaggatgtggtctttattccttagtcatgacccttctgtggtcacagtggaaaattctgggtatgtacaaagatacctccacgtgtggggattgaactccaacctctgctttctcaggacagtagacttgctttgtgcttcaattccctttctccttgctgtggtttagaaaatactcccaaggaaaaagctaagtggaatgtggtgctcatctctgtatccctcatattttggagaatgtaaataactctgtgatcttgcctgcattgatcaccctctagtgccttcaaacagttattttatgtacagatagtcctccctttccatggttccagtatgcatgaatttcagttatcatggtttagttaagtaacaccaggtccccaactgtatggttcaaatttcaattactgtggtatattaaccgcagataattacataaaatgcaaactttattgctagtttagtccaggaatcattacataacaacagatgagcttatgatcggtgataaattatgtcacttctttccatgtctgtcagtgattggcctctctatgtctgttattcattttacccacagatagcaaagcacatagtcgtgttgcctccttgtctccagcaataagcccatgtaacattttataaaaatggataattgaaaaaagggaattggccaagagagatgtaaatccaacaaagaaacaaactgataatgttgggaatgaaatttgaatagaaagaaatggagttatggaagcaatagctgactttggaaatgttgacatggctgcccttcaagagactagattatgcagccaggggaacttactgaggaacttatatgcagtaaaggtgaacttattgacataaataaggaaagtagttgtgacaaaaggatgaagatgtcccaaaggaagtgatgctataaaaaatttcatattaaaggaactctcagatattttatgacattgaaatacaaataataaaatattagaagttgattaaaatgtagaaaaatgacttcagttcaccaaggcatgggaaagatgcttgcccataagttatatgttgagaaagcaagcactcttcaaactatagttcttaagtttttacaaagaaataaaacatttttggctgggtgtggtggctcattcctgtaatcccagcattctttaggaggcccaactgggaggatcacttgaggctaggagttggagaccagcctgggcaacatagcaagacctcatcactgcaaaaaaatctaaacattagccagggcatggtcgcatgtgccgacagtcctaggcaggctgaggcaggaggattgcttgagcccaaggagttcaaggttacagtgagccatgattgtgccaccacactccactctgagtgacagagtgagaccctgtctctaaaaaaaaataattaataaaatttaaaaataaaacagttctcagtgtttctaatgtgttaaattataagtactaaataaatattaggatttcttttaacttgttattgttcagtatacatttattgtggtgttttgttttgttttgttgagacgaagtttcactctgtcacccaggctggaatgcagtggcacaatctcagctcactgcatcctttgccttccaggttcaagcgattatcatgtctcagccttctgagtagctgggattacaagcatgtgccaacatgcacagctaattttgtgtttttagtagaaacagggttttgccatgttggccaggctggtctcgaattcctggcctcaagtgatctgcccgccttggcctcccaaagtgctgggattataggcatgagctaccatgctcagcctctagtgtatatttataaccaacggtaagagtttttaatgttttgacaaaattttttaaagattgtggaacaatcgtaattgtccccattagttattaagatcactttgcttagttttaacttgcatgattacttctgcagtcccatcctatgatgcaaagtgagggcatgtcctgtaattcctgtgtcttcaacagtgtttttggccagggagttagtccagtagatgttctttcatggcaatgactagaataaaacagaagaaaaccttcacctgccataatttttaaaaactgtgatctagttttaacttttggactatgctattaccacatcaaatgggtgtttgtaggtatttagtatttgttaaactttccttttacaaaattagggcatttctgtggtatcaagagcaagtaaggcatgcattttatgacagtgtatactgtaaattacattttttcatttctcatttctttgttttaaaatttttagattttacctaggttacatggagtcactccttagtttcatatttatacatctggcatttctcaactaggttataagctttgcaaagttaagcactaggccccgtaccacatttttattactgagttcacaaattcttattaaatgattacaataatttacacctccttaagaaggtgtagtgccttgtttcttgctggtgatttgaagattaaatgatattttaggagacttgtaaataagaagatagcctaaatagaaaaagatgaggatcgtgtaaagagagaaggatttgagttaacttcacaattgaagttaataatttaattagacagttaagtaggtgttcttagagtctattgtgaatggctgagtctgttaaaaagaactcaggggttcagcagaggattctaaaactgatttaaatgttttatttggggcattggaagattgggtatggaggataatgattaagtgttagaagaacaacaaaggcctggtttttagtttcaggtcttagtagtccttaggtcaagtcaactgctttgagcttcagtttcttttttttttttttttggagacagagtctcgctctgtcgcccaggctggagtgcagtggcatgatctcggctcactgcaagctccgcttcccgggttcacgccattctcctgcctcagcctcccgaatagctgggactacaggtggctgccaccgtgcctggctaattttttgtatttttagtagagacggggtttcaccatgttagccaggatggtctcgatctcctgacctcgtgatccacccgcctcggcctcccaaagtgctgggattacaggcgtgagccaccgcgcccggcccagtttcttaatctataaaacaagagaatatctgttaggtttgcttcattgatatctgtagaggccttatgaaacactaatacagtttgtgtgaaagtatttgaaagggagtaaagcggtcttgatgaaaagagttagtgagaagtcacttttagattccaggagagggctggcaaatacgatcatgggccagccatctgcttttgtaaataaagatttactggaacccggccacactcattcacttatgtattgtcgttggctactttcggtagcagagttaaatcattatgaggagactatgtggcccacaagcctaacatatttattgtctggccttttaagaaaatgcttgtcagcccataaaaggttggttaaccaagctacagctcatgtttatctttgacctgaagtctgactcaaaatgttacacattcagaactgggtataacataatgtagctgacttagtctaataactgcatttattacaattttttggggcataaaattactttttttctatttctgccttggctcatattgtttcttatgtgactgttgtaaagttttctttattaaattttattaaattaattttaaagtgacgtttgattaaatccaacttaataatgtttggttaaaatatactttattccattttgtttttggttataaattatttttgtagctattatgtttggttttatttgtgatgattatgaataagcttacactactgtaattgagctaacatacttctaagactgagtagtcttgtgagagatctccacagcaaagtctaatgagaggtatgctgtggatactggagtccttggtactttattttctgtttattcagaatgagaatattcatttcggaaatctttagcttggtaaatgttgcttgtagaaaatatattttggagtaaaatgctgaatgttaattaatgtaaatgggtaaaaggtggatgttttctattctgtttcttttatcaggaatacttttttccctttaactcctactgatgctttaatgctcatctcagttgtcactttctataagaagctttccttcttttattgttttagtcaacagatatttattgagcaccttgtgtatatctgacattatgctaggggctagtgatcatccagcactgatgggacaaacatggctcctgtcttcacagagctttatagaaaagtggaggcagaactgttaatgctttcaactttcatgaccttttgtccatttaggcatttttttctcttgtattttatcacactctggtatagttatatggtttatgtattttgctggcctatcagttagcctggttggggtacatcttacatttttgtatccccagcacctagtgtggtctttggcagagagtagagaaactaaatattaactgcatgacttctttattttattcctttctaatactaacaggaaataatattaacaatttttcataagtagtttcctattaaactaaaggaagtgtcttgtttgaatttatttatggaattggattttatgtagagttttttcttccaaaagaagtttttattaatttgtgaagtcagagatattaaacctttctgttagtgcaattgtaaatttctcaatattgtgacataatagatggcacatttatttcatttagaactgcacttgtagattataacagctaaacaacagtttaaacaatttttgaatactttcaaatgctaattttaatttctcagaactctgtgaaagagaaataagaaaagcttatgaaaccaagaaaactcatttaggacatactgtgcctttcagtgttttttttatgagttttcattttatatataaaaatatttaacctctctgtgaaataaagttaatggccacaagaaataaaagaaagtagcatttttatttatgagcagttgttactgcaagtgcaggctattacctatttaatatcaagttgtttttcttataagctagtgatttgaggaaatctataaaaaatgtttttaccatgacttagtttcttgcttttcggagtatacaatcccaaaaaggcggggagggttggcattagatacgttctgtagacctgcaaataaacgcaaggtttaactgctaatatgttaaaagtgtacagtgtttctaaaatgtggttaggctttttcaactaattaatattttagagacaataattatttgatagtgtgccattttaacttaaaactggtttttaagaggagatggtgattagctaatggtaattttataacaagtcacgacatttggaaaatacttttgtttggtaggtaacataaaagttaaatgcagccgttccagctctttggaggtttgtgtgatatagactggtgggttgtcattgcattgccttgtttttactacttctgcttatagtagaataagtagactgagaaattattgttttgagatggagcaccagacctgatctatttatttattgctgtgtctcttatcagttgtatgatcatggcaggtcacttttctctctaagctggacttttctttcttttcttttctaccccttccccaattcccttcccttcccctaggtgatgtctgtaaagctggagttttattacaaatacgaaggtggtaatgcctcataagactcaaattcaaggattgtaaagcaataatcacatacaccttaattctgatgatagatgttttcagttcatttcaaaaggacttcctgggtgaataatatttattgttctcccatccccctccttctcggtctttttaagcaggacttactaggtagaaggaaatagataactttccagaaataactgtggtaacatagaaaaactactaaaacagaaacaagagtttttagacttgatgcagctactacctgtgtatctattttgagtctttaatttctgtgttttttgttacagtgtcaggttctgttgtagttgcaggtggtgtaaaagtagattcctaagtagaactgtaggaggcataactactcttcttgaaccttttttctcattgaaagactgatattggataagcttccttttttacagtctttagcaaaattcagatttttatcagtctttggaacactgagattacattgtataaataagagcaaagaaaatagtagaatgaatctatatcggtcactcagtctcatctgttaccagtatatggccagccttgtttcatctattatttttcattccttgtctgtgtgagtttttggaaatttttctttcttccattgccacaaatatttctcacagattttatactctcatgtttaatcaagtcttggaaacaacattcattgtctttgatcttcatggctgcaaattcagtcttcattataggagaatcatgcccggaccgtagtagtgtggattagctagccagtataagaacctactatgtgccagcctctgtgctaagcacaggggacgctggggtaaatatgacaggcacgatcccttccctctgaatgtgtagggtagcagaggagccaggcattaaacagatcacttttacgtaattgttacatttataactggagttgtagaggaaggaggaagggctagagagagtggtgtggttgtgatgaaagttgtttcaggctgagggaatgatctgggctaggttcagaagcaaagagcctactaagttctgagaactgactagaatgtggtgatcaagatcgagagtggtaaggaggtcaaactggaagtcaggcagagacgctgcctgttcagggctttgtaggccattttaacaatattgaacttaatccctggcaggaggaacagagagtgggatggtaggagaccagtgaaacattttaagcagacctataacagaatcagatttccctttttaagacatccctttggctgcagtatggttaatgaattagaaagaagcaaatgggaattgaaaaggaccaagtgggagtctataccagtggtcatatcagaccagtggtctataccagtggtgatatgtattatgtgtcctatgatgatgagtgccatgagagaaaaagcaaaggaagatgagaaaggactttgttgggaaagggcgttgttattttaaataggatggtcagggaagtcctcactgattggatgacattaaatgaagacctgaagcagtttaggagatcatgcatatttatctgggattaaaaacttcctaggcagagggaacagcaagagcaaaggcactaaagtgggaatattctaggcacttccagagaactaatcctatgcatagcttttaaaagtgtagataaacacaggtttttcttcaaggatacccttctctatttcccaccatttttttttttaaagcattctgtgtagcaaaaatggcacttgtctatatctagttcttgtgggatgcaaagcatttttttggcagttggttttatgctgtttgccattagcaattatcatgtcttggatgaacctcattggttatgatattgccagtacacaaagcttcgtttatactattttgaaagcaataaagtgctgagaatattgaccaattagaattggacctgtttacattaaggtgattagggaagacgtctgattattttcacaatctagcggctagagagtccaagaggaaggtgcctgcaattcagtgtctgatgagggccctcttcctgattcatagctatcttctctttgtgtcctcacagactaaaacagagctttctctggggtctgttttctaaggacagtaattccatttatgaggactccgcccttatgacctaatcagctcccaaatgccccaccactttatctatcatgttggaggttaggatttcaacatgaattatagggggatgtaaacattcagtccacaataggtatgttttgagaagtcaaaagaagataagcatgtcttaggtgtagtgactgaggaggaagtgtggcccgagatgagtttggagagatgagaaagaaccaaattatctaaggccttgtaggccaaggaaaacaatttggattttaagctattggaggacttttaagcaggggagtgatgagatgtagaatatgatataagagctgttcaatgtagaatggaataggagtccagaatgaaagtggctctagtaatagtcttaggtataagaatatggtgatatttagggtgatgttgggagagatggagaaaagtcagtaaatttggggcttattttagaggtagattggcagagcctgttgttaggctggatgtagaggatgggttaaaaacaaggaaggaattattcctgggttatgatttgggcagctgcatggagagtggtgctttatactgagatatgaaatattagataatgagatgggaagtaaagcctatttgagaggccatcttggaggctaaaagtttgagatgtctaatgaggcattcatgtagagatacactgaattagattttgctaaaattaaatattgtgagtgtgggacagcagatggagaatgcataatagactagaatctaatgctgcagcttctagtttcgtactgtgtttactttgcaaattagtataggaattttagcttcaggaatatggcagtgaatgtgtcacagtcatacaaagcaatgaaatatggagccacctcatttatgtttgctttttttgtacatatagctgagctaattaggtcatttttgttattattattatttgcctgtagtacgttttgcaggaaggtgaataattccaacctgaaactctgtgtgtggcatttaagaatctacaacttcgtgagaaagttgcttaaagcaaatttgtaacctgcttgagcattcaattaagttttactatggaacaaacaagcattttactatatatattatatattttaaatcagtctcttggtgttctttctgtaattaaaaataatggtgagatttttagagttcatgcatttgcattttaatataaagcagtaaaaaatttgctaagcttctggagaaggattgctcctgaaattacttgatttaagtgaataaattaactttgtaataatttggactatagccttctacagtgttttgggtagacttggcagtgagtatcatggataataaaacttggtgaaacatttaggcagttatttcgcagtgcaatacagattatactaatgagaggtgacagcgtgctggcagtcctcacagcccttgctcgctctcggcgtctcctctgcctgggctcctactttgggggcacttgagcccttcagcccaccgctgcactgtgggagcccctttctgggctggccaaggctggagccggctccctcagcatgcagggaggtgtggagggagaggcgcgagcgggaaccggggatgtgcgcggcgcttgcgggccagctggagttccgggtgggtgtgggcttggcggaccccgcactcggagcagccggccggccctgccggccccgggcaatgaggggcttagcacccgggccagcggctgcggagggtgtactgggtcccccagcagtgacggcccaccggcgctgcactcgatttctcacctggccttagctgccttcccgcggggcagggctcgggacctgcagcccgccatgcctgagcctcccaccccttccatgggctcctgtgcggccaagcctccctgacgagtgccgccctctgctccacggcgcccagtcccatcgaccacccaagggctgaggagtgcggggcacggcgcgggactggcaggcagctccaccagcagccccggtgaagccagctgggctcctgagtctggtggggacgtggagaacctttatgtctagctcaggggttgtaaatacaccaatcagcactctgtatctagctcaaggtttgtaaacacaccaatcagcaccctgtgtctagctcagggtttgtgaatgcaccaatcgacactctgtaactagctactctggtggggacttggagaacctttgtgtcgacactttgtatctagctaatctagtggggatgtggagaacctttgtgtctagctcagggattgtaaacgcaccaatcagagaatggaaaacttttattttattttactttaagttctaggatacatgtgcagaaggtgcaggtttgttacataggtatgcatgtgccatggtggtttgctgcacctatcaacccgtcatctatgttttaagccttgcatacattaggtatttgtcctaatgttccccctctgcttgcccccaacccaccgacaggcccccgtgtgtgtgatgttcctctccctgtgtcccatgtgttcttgttgttcagctcccactaatgagtgagaacatgtggtgtttggttttctgttcctgtgttagtttgccgaggataatggcttctagcttcattcatgtctctgcagaggatacaaaatcattcttttttatggctgcgtagtattccatggtatatatgtgacacattttctctatccagtctaacattgatgggcatttgggttggttccaagtctttgctattgtaaatagtgctgcagtaaacatacatttgcatgtgtctttatagtagaatgatttataatcctttgggaatatactcagtaatgggattgctgggtcaaatggtatttctggctgtagatccttgaggaattgccacactgttccacaatggttgaactaatttacactcgcaccaacagtgtaaaagtgttcctatttctccacaaccttgccagcatctgttgtttcctgactttttaataatccccattctaactggtgtaagatagtatctcattgtggttttgatttgcatttctctaatgatcagtgaagatgagctttttttcatgtttgtttgccacataaatgtcttcttttgagaagtgcctgctcatatccttcgcccactttttgatgggtttctttttttcttgtaaatttgtttaagttccttgtagattctagatattagacctttgtctgataggtagattgcagaaattttctcccattctgtaggttgcctcttcactctgatgatagtttcttttgctgtgcagaagctgtttagtcactctgatgatagtttcttttgctgtgcagaagctgtttagtttgattacatcccatttgtcaattttggtttttgttcccattgcttttggtgttttagtcatgaagtcttttcccatgcctatgtcctgaatggtattacctatgttttcttgtagggtttttatggttttgggcttgacatttaagtctttttatccaccttgagttcatttttgtataaggtgtaaggaataggtccaattcctgttttctgcatatggctagccagttttcccagaaccatttattaaataggaatcctttccccattgcttgtttttgtctggtttgtcgaagatcagatggttgtagatttgtggtggtatttctgaggtctctgttctgttccattggtctatatatctgttttggtaccagtaccatgctgttttggttactgtggccttgtaatatagtttgaagtcaggtagcatgatgcctccagcttcgttctttttgcttaggattgtcttggctatacaggctcttttttggttccatatgaaatttaaagtagtttttttgtaattctgcaaagaaagtcaatggtagcttgatgggaatagcgttgaatctgtaaattactttgggcagtatggccattttcatgatactgattcttcctatccatgagcatggaatgtttttccatttgtttgtgtcctctcatttccttgagcagtggtttgtagttcttgaagaggtccttcatgtcacttgtaagttggattcctaggtatttcattgtctttgtagcaattgtgaatgggagttcactcatgatttgactctctgcttctttgctgttggtgtataggaatgcttgtgatttttgcaaatagattttgtatgctgagactttgctgaagtttattaacagcttaaggagtttttgggctgagacgatggggttttctaagtatacaatcatgtcatctgcaaacagagacaattagacttcctatttgaataccctttattttttctcttgcctgattgccctggccagaacttccagtactatgttgaataggagtggtgagagagggcatccttgtcttgtggccgttttcaaagggaatgcttccagcttttgcccattccgtatgatattgactatgggtttgtcataaatagctcttactattttgagatatgttccatcaatacctagcttattgagagtttttagcatgaagggatgttgaattttacctaaggccttttctgcatctattgagagaatcatgtggtttttgtcattggttctgtttatgtgatggattacatttattgatttgtgtgtgttgaatcagccttgcatcccagggatgaagccaacatgatcgtggtggataagctttttgatgtgctgctggattcggtttgccagaattttcttgaggattttcacattgatgttcatcagggatattggcctgaaattttctttttttgttgtgtctctgccaggttttggtatcataaaatgagttagggcctcataaaatgagttagggaggagtccctctttttctattgtttggaatagtttcagaaggaatggtggtaccagttcctctttgtacctgtggtagaattcagctgtgaatccgtctggtcctggacttttttggttggtaggctattaattactgcctcaatttcagaacttgttattgttctagtcagggattcaacttcttctggtttagtcttggcagtgtgtatgtgtccaataatttatccatttcttctagaatgtctagtttatttacatagaggtgtttataatattctctgatggtggtttgtatttttgtgagatcagtgatgatatcccctttatcattttttattgtgtctatttgattcttctctcttttcttctttattagtctagctagtggtctattttgttaatcttttcaaaaaaccagctgctggattcattgattttttttttttgagggtttttcatgtctccatctccttcaattctgctctgatcttaattattcttgtcttgtgctagcttttgaatttgtttgctcttgcttctctaattcttttgattgtgatgttagggtgtcgattttagatctttcgagctttctgatgtgggcatttagtgctataaatttccctcttagcactgctttagctgtgtctcagagattctggtacgttgtctcttttttctcattgatttcaaagcacttctttatttctgccttaatttcgttatttaccaagtagttatttaggagcggttttcatgtagttgtacagttttgagttagtttcttcatcttgagttctaatttgattgcactgtggtctgtgagagtgtttattatgatttccattattttgcacttgcagaggagtgttttactttcaattatgtggtcgattttagaatacacatgctatgtggtgctgagaagaatgtgtattctgttgatttgggatggagagttctgttgatgtctattaggtccacttggtccagagctgagttcaagtcctgaatatccttgttaattttatgtctcgttgatctgtgtaatattgacagtggggggttaaaatcccccactattattgtgtgggagttcaagtctcttcgtagatcttgaagaacttgttttatgaatctggatgctcctgtattgggtgcacatatatttaggatagttagctcttgttgttgcattgatccctttaccattatgtcatgcccttctttgtcttttttgatctttgttggtttaaagtctgttttatcagggactaggattgcaacccctgctttttttttttttttttttgctttccatttgcttggtaaatattcctcaatctctttattttgaacctatgtgtgtctttgcatgtgagatgggtctcctgaatacagcacactgatgggtcttgacgctttatccagtttgccagtctgtgtcttttaattggagcatttatcccatttacatttaaggttaatattgttatgtgtgaatttgatcctgccatcatgatactagctggtttttttgcccattagttgatgcagttttttcatagtgttggtctttatattttggtgtgttttttgcagtggctggtactggtttttcctttctatatgtagtgcttccttcaggagctcttgtagggcaggcctggtgatgacaaaatcccttagcatttgcttgtctctaaaggattctatttctccttcgcttatgaagcttagtttggctggatatgaaattctgggttgaaaattcttttctttaagaatgttgaatatattggctcccactgtcttctggcttgtagggtttctgcagagagatccgctgttagtctgatgggcttccccttgtaggaaacctaacctttctctctggctgcccttaacattttttccttcatttcaaccttagagaatctgatgattatgtgtcttggggttgctcttctttaggagtatcttagtggtgttctctgtatttcctgaatttgaatgttggcctgtcttgcttggtgggggaagttctcctggataataccccgaagtgtgttttccaacttggttccattttccccatcattttcaggtacaccgattgtaagtttggtcttttcacatagtcccatatttcttggaggcttcattcgttcctttttattcttttttctctaatcttgtgttcatactttttttcagtaagttgatcttcaatctctgatatcctttcttccacttgatcagtttggctattgatacttgtatatgcttcacaaagttcttgtgctgtgtttttcagctccatcaggtcatttgtgttcctctcaaaacgggttattctagttagcatttcctataaccttttatcaagattcttagcttccttgcattgggttagaacatgctcctttagctcagaagagtttgttattacccaccttctgaagccttcttctgtcaattcatcaacttcattcttcatccagttttgtgcccttgctggagaggaattgagatcatttggagaagaggcattctggttttttgaatcttcagcatttttgtgctgtttttttttttttttccatctttgtggatttatctacctttgatcttggaggctaatgacctttggatggagtttttttgtgggggtcctttatgttgatgttgatgttgtattttctttttgttagggcccctcttctgcaggtctgctgcagtttgctggaagtccactctagaccctgttcgcctgggtatcaccagtggaggctgtagaacagcaaagattgctgcctgctacttcctctggaagcttcgtcccagaggggcaccggcctgatgccagccagagctctcttgtttgaggtgtctgctgacccctgttgggaggtctctcccagtcaggaggcatggggatcagagacccacttgaggcagtcggtcccttagcagagctggtgttctgtgctgggagaatccgtcttgtcaggatcagctcctctcttcagagtcagcaggcaggaatgattaaatccgctggagctgcacccacagccgccccttcccccaggtgctgtgtcccagggagatgggggttttgtctgttagcccatgagtggggccattacctttccttcagagatgccctgcccaatgaggaggaatctagagaaggactctggccacagccactttgttggactgtggtgaattccgctcagtccagacctcccagactccttagcactgtcagaggaaaactgcctagtaaagcctcagtaatgtcagatgcccctccccgcaccaagcttgatcattccaggtcgactttagactgctgtgctggcagtgagagtttcaagccagtggttcttagcttgctgggctccgtaggagtgggacccactgagcgagaccacttgactctgtggcttcagcaccctttccaggggaatgaatggttctgtctctctggggttccaggcgccactgaagtacgaaaaagactcctgcagctagctcggtgtctgcccaaatggctgcccagttttgtgcttgaaacccagggccctggtggtgtaggctacatgagggaatctcctgatctgcagattgcagaaaccatgggaaaagtgtagtaacccagccgggtagcacagtacctcatggcttcccttggctgggggagggaggctccctggcttcttgcacatcctgggtgaaggaatgccccaccctgcttctggtcaccctccatgggttggatccactgcctaaccggtcccaacaagatgacctgggtacctcagttggaaatgcagaaatcacctgccgccttctgtgtttgtctcgctgggagctgcagaccggaacttttcctattcagccatcttatcaactcgagaatggaaaactttttaagaactttatgattttctttaagagaatggaaaactttagatgtacttacttttctaatccttttttgttttgtctgttagcttcttaccacctttctgtagatcagtgtttcccaaagtgtgccaaaagcattagtgttacttgggaactgattagaaatataccctagaccggccgggtgcagtggctcatgcctgtaatcccagcactttgggaggccgaggtgagtggatcacaaggtcaggagttcaagaccagcctgaccaacgtggtgaaaccccatctctactaaaaatataaaaattaggcatggcacacgcctctaatccgagctactcaggaggctgaggcaggagaatcacttgaacctgggaggcggaggttgaagtgagtcgagatggtgccactgcactccagcctgggtgacagagcgagactctgccctagatcagctgaatcagaaactctgggtaagtcccagcagcctgtttcagcaagtcttccagaaggttttgactcactaaagtttgggaaccactcctgtggagcagggtttcccaacctctgcactgttgacttttttggactggataattctttgatgtggctgtgagggttggggctgtcctgtgcattgtgtaatctttagcagcacttctggcctctacagactagatgccagtagcacactgcccgctcccccggtaataattgtttcatttttttcaacccaacttctacatccagcctaacaataggctctgtcaatactacctccaaaataaacccctatttattgacttttcatctctaccattatcaccctaattaccaccatactcttaggagaaccactactctagagggaaatgatgtggagttaataggtaaaactgcttctcatttaaagtagcagtgaccacttgttgagtgcattttaactcattccaagttctgttctgggtacttcacgtgaattatcactgccatcacaacagctgtgccagatatgtttcaaagttcacagtgtgggctaacccatttatgaagtttctcatctattccagcaattcttcccttgagaactagtatgtcctgttgtcataatgacttatttggctgcatgtgtaactatattcttttttaaacaaagggatttagctgggattgtaggtgtgaactgttttgcctggtgaactatgtaaacttctcattgcaaacttaaccataactgtttctggatgatggtgattatttactttttctgaggtgactactaaatgacaaatgaatcaatagtatgctgtcgttgcagtaagacattctgcttacattttttgaaataatgtgtgttctgtgtattttcctttcagctctagctcacttgatctatctctgcatattttaacaactcttctttcccactctttaactctaatttaaacttgcctagtctctgttccattcctttattacctttctagggtatggatggctagatacacattttaactcaacaatcagtagttaatgctggttcatgtattacgcatttccaggtgtcacatgcttttaaacaaaagcctagaaatcatttgtattgagaatgtcaagcccccacacctgacccctgtgacattttatgttcttgaacttggcctgtatagaccagttctgattagtggctatagtgatgaattctggctgttaaaattctgtatattaataatgtcatctcctgaatcaagaaagtcagtgcagttctgttgcagtgctagtttcttgttactcattggatactgtttctcttttactactttagaagctatgtaacgttcagaatccttttatgtgaaaatcacatttaagactaaaactatctgtgccactggtattttaattagcattcagagaattgcaaggtttttacccaaacactggaaaaaataagcaacttatgaaaaagaggggtaaaatgaacacgtttgttcatctaaaataaagcatgtttagtcctgattatcgtcttcaaagtgcttttctacttaagaagcatttcttcgcacagtatccctttagtatccagactatgcttaagttcctggagctcttttacatttagtgtatttctctctttcccgttagaaggatataaaagtatcccaaacagcatttcaaattggagttaattttcataattctaattgtagttaaatttcaaattccaagccacactcagaatgtcaagattttgtggctattttttcttttttaaaaaattatactttaagttctagggtacatgtgcacaacgtgcaggtttgttacataagtatacatgtgccatgttggtttgctgcacccataaacttgtcatttacattggatatttctcctaatgctatcccttcccccaggcccccacccaccgacaggcctcagtgtgtgatgttccctgccctgtgtccaagtgtctgatttttcagttcccccctatgagtgagaacatgcagtgtctggttttctgtgcttgtgatagtttgctgagaatgatggtttccagcttcatccatgtccctgcaaaggacatgaacacatcctttttatggctgcatagtattccatggtttatatgtgccacattgtcttaatccagtctatcattgatagacatttgggttccaactctttgctaccgtgaatagtgcttttgcaactattttttcttaaactatcttcttgtttttgttaatgcttagattttgtcccacaggtattttaacctgcatgtacttttcatgtatttaaaagtcattatttttatgtaagatttaaaaaactctataactcttttacatattttttgaaagatgaaaaaggattaatatttgtctacctagaatgtaagaaaggagcagaagagacaaggtgatgaagggaaatataggaagtgagaagagaaggaaaacaacttcatggacttgttgaaaggggaaatgctttacaattataatacagctcattctcaccagtatttttagcattatttattttcaggtgttagtactcagtagagtaatgcaattcagatatctgagctgtaaatgaaaaaatttgagaaacactgggaggataatttcaaattttaataactttattcttatttttactgttaggattcctggaaatcctgattgaagttttggacctaacaggatacactatgtatatcacgtatccctaaaagttatgggatacatttaaaacaataatatttagtccacaataagccaattataggtaataaagtataatttgtaaaattctgggtgggccatatgttttgagaaatatatataattttcagccaacttgttttgcagtgaattagttgttatataacagttttgaggaaaatacttcttgaacagtccagtagctaaaagttgaactaagatgagatttttcagtttcactcattattgtccttgtcttcttttaaagaatagttactgagtaatattttcaattgattatcacaatgcctttcttcatgtactcattgaagaattatggcttaatgaacatgttgaaacaagtaatatttatttctgtagtagcagctactgctagctgtgctgttctgtcatctctaaatactacaggagatgagatttgttgaattactataccagatgttaccataatttttgaagcatagaaccctggaatttttgataatatgaacatgccattcattaatagtttcccagatctcagtcataagttatcctgaattggctgaacattgaatgttagcaaacaagctgttttatttatagaaatgtaactaaaaatcttctgtgtcatggtatcacccactagcagctactagcctgatgaccctgggcatgtcatgtagctgctttgagctgcaattttctcctctctacaatgaggagagctatatcagtaagttgtgtgaaaattaaacaatataaaatcctagggttttttaaattgctaaattctttacaagtgtataagttattgataaaagtcatcactggtcccactgtaatgagaaccaacagcttttccctatttctcactctagtattgtttgtttttaatagcacttttgactagccttttttttttattcagggcctccttgctctgtcacccaggctaagatgcagtggtaaggtcatggctcactgcagccttgacctcctgggttcaggcaatcagtcttcccatatcagtctcccaagtagctggtactactggcatacaccaccaatgcttggctaattttttttttttgttagagacgggatctacctatgttgtattacttggtcatctctgccgtttgaggagatggggagtgggggtgggtgggaaggacttgagccatcaagcattacaagtgcaaaataaaggattcatcagacttattagaaattgtgataacttgtgtcaatttggcttccccaactacatgttaagtgaaaggaacaatctcttgtgtacttgttttattttggtttttgctttttaattctctacagctcctgttactcaattaagtgcataatgggagcaaggggtttgatagatttcactctacacaggtcctacaaaataaaaacttgtttgagcatgctgttttttctatctcctgttttaattaaactccagattcacaatatgaactgtttgcaaattgggaacttctttatagaggtattttccatgtagctaccatgtacagattaggtagatttgaaatagaatggaggagcttattaggcttactaaattcctgtgatatcccaggcctagagtgattcctcacaagaattagataaatattaccatctttgcaaatgaggaaatgagttcacagaactaccaagaggtggaaccagaatttgaacctagatccctgattctgaagtgaatgtacaatcatgctctgcattatgatgtttcagtcaacagtggactgcatgtatgatagtggtcccttaagattataatggaactgaaaaattcttatggcctagtaacctgatagcccttgtaccatcatagcacaatgcattactcatagatttgtggtgatactgtcataaacaaatgtgctgccagttggataaatgtctagcacatataattatgtacagtaattgataatgataaacgactatgttactatttacttttttcattattttagagtgttcaccttctacttattagaaaaagttagctgtaaaataggaaggtccttcaagaggtattctggaaggcatcgttttcattggagatgacagcttcactcatgttattgcccctaaagactttgcagtgggacaagatgtggaggtggaagacagtgatattgatgatcctcccactttgtaggcctaggctaatgtgtgtatttgtgtcttagtttttaacaaaaagtcttaagttaaaaaaataaatttttaaataagtttcatagaataaggatataaaaaatgtttttatgcggctgtacgtgtttgttttaagctaagtgttattacaaaagactcaaaagttgaaaatgtttataaagtgaaaaagctatagtaagcttaagttaatttttaaataaattcaatgtaacttaaatgtacagtgtttacaaagtctacagtagagtatagtaatgtcctaggccttcacattcactcatcactcacttgttgactcacccagagtcagccctgcaagctccattgatggtacgtgcactatacaggggtgccttttaaaaatattttatatggtatttttactgtaccttttcctggtttgcacataccatataggtttatagcctaggagcaataggttataccatatagcctagttgtgtagtaatctgtactctctaggttttctaagtacattctatgatgttcgcatgatgaaattgcctgatgcatttctcagaatctatcctcatcgttaaatgaagcatgactatgttttttgttacatctggaggttgttaacgctggctatatattagaatcatctggggagctttcaaaagtacagatgccagggaaatcaggtaattggtctggagtgggtcctgcacattagtattttttaaaagctcttcagatgatcctatcctggtgagaagcaaaagttaagaaatgttgcattgcatactgcatctccagtgaccattggtggcccctttgttttgaaagcttgtgttatttgtcagtggataatcattaacagattaatagtgttttctactttacactttctctccagaagcataaaggatttgtattaaagagagaattacctacataataaatgttggaaagattacagtgaacataatgggggtatctttttgtcagtctttcaaaaattaaaatatttttgtttttaccttatgactttggcttgctttctgagtgaagtaaaaatgaactcaattgcatattaaatttgtttctggccctctgcatctaggaaagtaataaactaatttcggccaagagaaataacattttcttaatatacagtagttttaaaaagtaatagaacaggaggttattggttataaatctatagatgattgtaacaggaatacatttagataattagtcctggcctaccactgtgctgtagctctgtaaatctctttttgacaagctgctttaaagattgtcatggatgaagggaaaatgggagtatagttgaagatcattattattagaaattttaatataagcacatagaacaacagaataatttgttttttacattatgaaatttttgagttttgaatcttttttattacctggcttaaaaatacatttgaaataaattattcttaattggttagaatacgataattgaatcctgtctacttaaaaatgaaggcagttactgggattgactcttggaatacgtttaaagatgttgtaacttacagtcatggtttattggctggtgatgttgaaattggaatttacagtctgcttttctcaatacttaataagattaattttctttaaatttccaagcagtagtttttaacgatttacagagttttcatgaggtagctagtttttactgactccatttataaagctatgctgtaataaggtgtagcaattgtgaacctctcatcttttcagattaacaagaaccccttcccccatcatgcttatgtcctctcccctactatattaagacatgttagaagaagaaggggttggaaaggaatggttatctaggtcttaagcgatagagttggaactcagacttgcttgtcaagactggaggactcctcagatgttggcccagatgttcttggaccaccattcttattcccaccgttacatgatatggctggagatgaatgcagtgaaattgatgggaggtaaatggcaactaaattgtgcccacagggtgagaagatagaaccttatatggtggttgaaaaagttggaggaagcaaaagggacatagagggtatttggttgtaaatattgcagctatactgtgttagggcttttattctcccaattatggctagcaaaggctgctcaattgcataactccaacaggcaacattcacatagaatttgatgtgagtgatgcagactccctggctctgagccagactgaacagtccagcagttctgtaatgatggggttttggcagggccacttttccatactggtcctgacacttcttacctggtagaatctagaagctcagtgccttctcttgttgaatctgaggcagcctaaaagataatgataataggaaacacttatgtagcacttaatttgtgtcaggcacagtaagtgtcttgctaaaactcacacaactattaaataaatgacaaagctgggaaacaaacccaggcagtgtggctccagactgtctactttttccactatgccacactttgtttgctattcccttgtttttattgtctccattgcctagtcattcatttagctattagtgattaacaaacattcgttgagtatgtactatgtgcatactcatagtacattaactttctagggctgaagtacgtagaactttctagggctgaagataaagtctttgccctcatgggacttacattttggttgagggagagcgacagtacatacttaaacatgtaaattgcataatttgaagtaacgataagtatttagaataaaatagagtgatggtatagggaatgattggaaagtgggactgtcttacctaggattatgaaagaaatctttctgagggggtaacactattgagacttgaatgatgagaagcagttatgtaaagattaggaaagtggggattctaggctgctaaaactgaaatgggagcaagtttggtatttactagggaccgaaaagaaaaatagcatgacttagagcttagtaagtaaggtaggtagtaacttagtaagttagtaaggtagacagtgagatctcagagaaatgcagcaataactttccaagggggtggaatgggcctggtaggaatctgcttctaggggaagaggtattttgttactcacattatttatggttgcctgcatgtagagtttggtcagggagcagtctgccccagatgcaggcagtaaggagatgcagtgggttgcatatttttaaaaatgattttagtacataacttaaaataaccatatcattaatgtgcatcataaagcattatgttttatggcccattagaaaatatttgaaaatttactcgttgatgatttatactttaaaagagctttctggatgctgtgcacaggggataaacataggacagtgaccaagtaggaggctattgtgttggctcagagaggtgaaagtggtagtggtgaacacggagagaagtaattgcagtctaaatatatattgattactgttcttgatgccaattttctaagactgtggcacttactttgtagggtaaaggagtaaatgtcttctctcagttaattttcagacagttactgtccaggtcacaattgtccaggaatttggattttattgcttttgtgattcactgaaaccacagatttccctgggtagaaaccttctgccaagatgtgtgtttatggacaggatgaaggatgaacttcctccaggactggcactgctcagccctgacgcagaggctagcccactgggcccacctacttctgtgttcatgatgaattttcaagggctgattctcttaatttgacctggctcataaggcagatgagtttgaagatacaggtcacttactgaaaacctgcttttggcagcctaccagtaattactacttgttcatttttatttttctcctgttttgtcttacagagatgtttaacatattacgtatgaagagattaattcatatgggtctatatttgaatgtgttttctgttacataccttgaaagcctctgattaaaacaatacaattattacatgatcacttgtagtactgatttgaataatactgttgacagatggaaaattttgtgaagagtgggttcccttctgtagtgattttcagccatttgcttttccttccaaagacaagcttacagtctgtcttctatgtgctgtcacaatccgacatttatttgaaatgctgtaactctgctctcccttggcttcttagatgttaaagaccaggaggtgaatagtgtatgcatgtggagaccatttcatcggtttcctgcatgagggtcctagccagctgaattgagcctgagtagcaatccctacactctccttatatgtcctccatgtctcccgtgggggattttagacatgttatttgtggcataagaattattttgccttgagtttttacctctcgtaaagcttaagtggaagaataggtaaatcctttaaagttatcactttttcctgcagtttgtccatgtgagtaacaaagaatacaaattaacttggtatcttatgcattttagagagctctgaaattaaaaaaaaaataacattttttccaggtgttttaaaatttgcaagaccaatataaaagcttaattcagcagagagagagaggaaaaatggatgaccatcaggatttttgaggaatggtatttttcatcttttttttttttaattgattgaatatttctgtagaacagtccttcagttttatgcttttgatttgatagccttcttaaatgttaagttttataaaaagaaactaacatcagtaatattgcttgtagctctggcgagaagtatatatattatcttcctcccaatgtgaataagctaagtgactgctagttttaattttctcctacttagtctttgttttgtttggctctgcacggtggctcatgcctgtaatccagcactttgggaggccaaggcagatggatcacttgaggtcagaagtccaagaccagcctggccaacatggtgaaatcccgtctctactaaaaatacaaaaattagccgggcgtgatgatgcatgcctataaccccagctacttgggaggctgaggtgggagaacctcttgaacctgggaggtggaggttgcagtgagcagagatctcgccactgcactccagctggggtgacagagcgagactctgtctctttttaaaaggaacaaaaaaatccattgtgaaagacacttggttattccttcaatctcaacactgattttctctcctccttttcttttcttcttttctttttctttctttcttttctttctttctttctctttctctttctttctttctttttctctttctttttctgtctttctttctctccccctccccctcccttcctccctccctccctctctctctctctgattagggtgtttttagctattgctgggaaaatacctttttaatataagaatatagcgtttctataagaagattaaagttaatatcaattaatacagattttttttttatcgtgtcttccttttaaacatagttgtatttgggcctaatcagtgggttaagcaggctaagttttatgtgaagaattaataaactctgataaaagagtgtctataaaatataagaaaactatatattttaccttagggctgagagaggaagaccaaacttgtaaggggtcccacctgcaaaggctagggctcagacttcactggaggaggtatattcagctcattgaattagtagaaaagttccctcttcccgccaggccagagttggtatgtagtacattggcagtcagggcaacctggaatgcaggtgatcaacaacatgtggcatggttgtgcagagggagtggcagctgggtgggaaaccacagatgggcagcccatgcaggcctccagagcaagcaaattgagatgttgataagggcaagcgcccattagtgtgcctatgcaagcaggaagcctttggagtgctagattctgtcttgagggctggttaaccctgggccaggctcctgctgccaccttgctgagagacttgcgtatctggacattgggcagaaccgtttctcctacaacttcttttagcattttctgctgagaaatcttaagatagttgttgcagtagagatgcttaaaggatttgtgaccatatagcgatgcatatattgaagggtgaatttggagaagagagtcatacaattgataactggcacaatcatgtttctttttccagtttacttttatgagaaattatgttcatagtgttctatccattctttgattcaagagcacatactatgcatgcaccatgctaggtgcttgagatttcatgacaaggcagcaaagtaaaattttaagtatgcatgaagaatcattatatttagctgtcacattcttgcttgatacttgatggtagaaagacacttttttaagcattgacagaataattgcttcatatgtgagaggactatgtcaaagtagtattcttcacattaagataaagtttcgtggcagcaactgttgaagcaattggggactttgaatcggaagaccaagattctggtcttggttattaattaaacatataataatctgggccttagttatcatctgtgaaattgtgctggacttactggattcagaattttctctcacaccatttctaatatactgcgagtcttccttcacattggagttgaagattagagtaaggaaggcctaaagcctgtcacagtcttttaggacaggggtgtaagaagaaattttttaaaaatatacagttaggatggtttaagcagaatcaatagattgccagtagattggattcaaacaggtctagtaatagaaaaataccaagctgaactgtaattctggatgtatttccttgctttatagagataagattttgatacaaatttctgaatataaaatattttattataaggtgggattctgggtgagttaaaaaaaaaggagttgcttaaaaaacaatgtacagaacgggagaaaatatgtgagtcatagataaggggtttgtattcagaatttataaagaactcttataactcaacaataaaaagacaactggtttaaaagggaaagtgatttgataggcatttctgcaaagatgcacaaatggccattgagcacatgagaagatgctcagcatagtcattaaggaaatgcaaatcaaaaccacaatgagatacttcttgatgcctgccagaatgattataattaaaaagaccagtagtagcaagcattggcaaggatgtggactaattggaatccaaatacattgctggtggaaatgtaaggtagtacactcactttggaaaacagtatggcagttcctcaaaacacagttaccatgtatcagttaaatagagttacctaatgacccagtagttctactcctaggtacatacccaagagaactgaaaacatatgtccacacgaaaatgtgtttacaaatgttcatagtagcattatttataatagataaaaagcggaaactacttaaatgtcagtcaactgagagaacaaaaatctggtaactccacataatggaatattattcagccgtaaaagcaaatgaagttctgatacatactacaacatgaatggacaccaaaaatattatgccaagcgaaaaacccagatgcaaaagaaccacatattatattacttcatttatatgaaatgtctggaataggcaaactatagagatagaaagtagtgatttttcaggggctggggcaagggggagtgggaagtgactattaatagttacaggtttctttttgggatgctgaaaatgttctgaactctgaatatactgaaaaccactaagttgtatactttaaaaggggtgaattttatggtatgcaaattatatctcaagttgtttatttaaaaaatttgaaattgaaaagtttttaaaaagagcttaattggtctgagattaagctgcagttggcacttcataagtgccagttccatgtttctttcaaagcttttttaaaaaaatctttggtatttaatgtttactgtgttcagtattttgactttatttttatttttatttttgagacggagtttcgctcttgttgcccaggctggagtgcaatggcgtgatctcggctcaccacaacctctgtctcccaggttcaagcaattctcctgcctcagcctcccaagtagctgggaatacaggcatgcaccaccacgcctggctaattttgtatttttaatagagacggggtttctccatgttggtcaggctggtcaggaacgcctgacctcaggtgatctgcccgcctcagcctcctcctaaagtgctgtgattacaggcgtgggccactgcaccctgcgactttatttctttacacaacttctagttaacatttaggctacttgaagctgtacctttgtagctcagcaattagaagtagtaccaggagagtcaagacatctatcctctacctggtgtgttttttgccttgataacacaagtagtcgtatgtttatatgtttacagtttttcttatgagaaaaaaatggctgtgcgaatatctagggagaggatgcaataatgtagaaaaaaattaattttatatttgctttatgtttatggaaagataagtttaataaaaataagaaaatatatgtgatgtcctttcagaaacttctagagggatatttaaaactttcatctcttcatgtgaggtattccattataatgttgttcatttttaataacaaataatttatatcattacagacagatttgaccagttttgggccatcaatcggaaactcatggaatatcctgcagaagaaaatggatttcgttatatcccctttagaatatatcaggtaggaaataacattttaaaaaacatccatttatgaaagcctcagacatcttaattgaagcactctagtgtagaactctttgtctgcatagtaactaaacggtatttattaggggttttccaaactgtgtctttcagtggcaatcaagtcagataccgcactgaaatatttgactcatatgcatttggtactcattatttgtagatttcatattggcagattcacatgcttactaaaatttatgtgtaaccccaaagtcagtacttggagcacttttacggtcattcagagtggtgaaaaattgattcacctgatgctcatttcccagcagaggttgatcaaagcgaggctctaccttcttgtctcagctgtcatactataaacaagccttcttgtcacagtgtatgtagtgccatgcttttacatttttgtgctttttgttagtgattttgctgtttaaaacagactccaaatgtagcactgaagtgctctttttaaacagaaacacacatagaacaaggttatgtattgatcagttaatgaacatgttgtgaccgagggctcacggaaacataaccttgtattcccccaggagcgatgatttcagtgtttgtggtaaccttatagaacagaactactgcaaatcacaagaatttactaagtctgtttgttttggatggtgagtcttcagtgttgtaccacaaagtaggcaataggctcttaagtctttctcacagcatatttgcatgaggtaaagaaactccatgtttctgtactttaaaagtgctggcataaatattgacatttagcaaatattaaatatttttttaatgaatggcattccaggaagtaagttacatactattaatgagaaaagcatttaagaacaagaaccagaagcataatgtcacaggcttagactctaatctagtaggacttccattcaaactcagaggttttgtcataactttctttgtagccatttttagtatcccacagtctttaccaatagttccttctatagttattttaaaatcttttatagagccatcacataactatgtgttcagagaggaaagcaaattgtctaattgaaagtaaacatctcaatatactggaagaatgaagaatatttatttagtgttgcaggtataattttcaaatagtccatatttttcatgaaggcggggttattgttaggttcatgctttgtgtccaggttctagaaaagtgcccggcatttgaatttctaatttattaaatcatttatcatttgtcaattttattttaattatttatattctttctattttaccatgagctccacagtaacatgccgtaaggcattcccacagcccagcaaaatatcttacttgtataatttagttgaagaaaatatatcgcagactctgaagacatttcacaaagagtccggaaactgttttgagatttatacctctcagcacttatttgggtcaagttctggcatatatatttatacaagagattctttactgtaacttctttaaactcctgtagggaaaatgtattatacttaatttaggaattattattgtcagaatatagtgcatgtgtacagaggaaaggttttcctttttgaatttattctgttttaggggaaaattgtcagattaatccatacctagtgttgtgttattataatacagataagtttcagagagagagagagagaaagggtgtgtgtgtgtgtgtgtgtgtgtgtgtgtgtgtgtgtgagagagagagagagagagagacagagacagagagagaatggtttttataaagtgctataattagatagaaagtgggagggtagagaattctcaaaatttgcttgacaaaacctggctgccagatggggactctcggcagaacctcctgcttgatctttaatgtgtcaaggcacttgggcagtttttccttaaacagaaagcaacaaagagcctaaggacaatataggttctcatttgacctacataactttccttttggctttatctcagttccattttggtttttatttgaatttaattaaagttttagaagtgagatatgaaaatgaatataaaaattaaggagtccagtttttgctaatttgccatttcctggcttttcctatttccctatttggtattcagtcttcaaccatggccttgaccaaaggaggatggaactctatttttgtttgcctaattgtgtgatctaaaggcaacatcagatttctgttgctgacttctttatatctgattagtttgtatggttgtgatattctgtttgttaaatgtagcatttatttgtgcagcattttgattaacacctttcatttctttaaaatactagatacaaatctctataatatttgagcccttaagttactaagtaaatttaaggaaaatctgaaaatctagattcattaataaagggcataatttttactgaaatatttattttactttgcagaatcctaatagaatttctgcataaccggagagagagagacagagtactgagcatgcttgagtgaggcccatcttatcttgttgaagcctcaaaaccatcttaggaataggaatcattatctgattttacatgtgaggaaactgaggctagggaattttaagtcacttgcctcagtgaacaaatgaaaaatggaagaactagaatccagacctaggcctgatttatgagcaaactatgacttttgtttgtaatcattaagtttgtagaattttcagaacataattatcatgaaaagtgaagtctgccctgaccaaataagttgataggagcctagaatacctgtgactggtggtattctttgaagataaacttttgtaaagattgtcatcaaactatttatttttcatctgtaattcatttatcatgagctcaaaatgactatagtcaggtgaccgatttttagtggtaaaagttgaattggtccaaaagccatctagagatgttgcagaccaaaatgtgtcatttctgtcatttacataacagtttagtttggtgtgttagtttcaggtttgtgttcctgaagtccaggtgcttcatattagccagtattctagagatgacattaagtgcaggaaatgttacagaatgtaaccaaaatgttatttagcacttgtaaacaggtggtgattaatgaaggcatttgtcaaaaagatttgtaaaatgactgtgaattccttaggcattggtatttgagatgtaaaatgaaaattaagcacatcatatctgtttttcaagaagcaatagattgataaatgttatcctgccattatactttgggtaagaaaagtgtgtctcattgattcattcaacaagtttatttacacacatatttgcctgccatgccctgtgctatgcacaagggatacaactgatgatcgatattatgtgtgaccccttagaaggttatagtctaaaggtggaaagaaacaaatcaactaagaatacaaatataacattggaactgtgattgctgtgaagaagagacatacagtgcaataaaaacctaatgccccaggaagaatttgttctagtttgggaggagagaaggctaccttgaggaaatgttgcattcccagagatttgacagataggtgaacttaagataggcaaagagtcatgagaagagctttgtaggcaaagggggacgttgtaagtataaggacaacctgtttgtcttgaccacagagtttggataaggctgcaaaggtaaaagtcaggccatattaacgagttttctctgtatcctgtaaagaatgggagatcttaagagatttttaattatttgaatatccattcatatttattcaacaaagatcattcagtcatctactttgttctacatgttattcttaaggttataaataaatttagagaatcttcatagaaacaacctagcagtgttatttttagttttaaaaaaacaagaagctgataaaacaatgcttgttttctaataaagttaaaatgagaccagcctggatacaacatagtgagaccccacctctacaaaaaaatttttttaaatgagccggatggggtggtaagcacctgtagtcccagctacttgggaggctgaggtaggagagtcacttgtatttgagaggtcaaggttgcagtgagccatgatcatgccactacactcaagcctgggcatcagaaacagaccctatctttaaaaaaaaaaaaaaaaaaaaaaaaaaaggatggttcctacttatctttgttttatttttatatattttttaattttatttacttacttatttatttattttgagatgaagtcttgctctgtcgcccaggctggagtgcactagtgcaatctcggctcactgaaacctccgcctcttgggttcaggcgattttcctgcctcagcctcccgagtagctaggattacaattgcccaccaccatgcctggctaatttttgtatttttagtagagacagggtttcaccatattggtcaggctggtctagaactcctgacctcaggtgaaccacctgcctcagcctcccaaagtgctggaattacaagtgtgagccactgcgcccagcctattttttttttttttttccccagagagggtcttgctctgtcacccaggcttgagtgcagtgatgtgatctcagctcactacagcctctgccttcccggctcaagcgatccacccacttcagccttccaagtaaccaggactacaggcatgtgccatgcctggctaatttttgtatttcctacttgtctttggaagaagttgttcattagttacaaaaaagtaaaataaagtagaatttgaacttcgttttgtttactttcataatcctcagaattctgcttcctttcccattgacgattgaatgtaaagttgttcatttgtatcattaaagcgccattaatattttaattcttttgggaggtttactggctattttggttaagcaaatctatttaacttctatgtgctaaaaatatttaagaatctagataccggtttggggagagaaaaagtacatttttgaaaatggaaactaggatgtcagggattaacttggcaccttctaaactgaagaaggagccaaattttagactctgttttgtttccagaaatgttgatttctggattttgaaaagtgaggacagtagaaatatgtggcaaattatggccatgtttgttaggattcttcccctccagggttttagcgatgttgataagaaattataattttgccttttcagttgttttccattttagtagatatcttgcaataacatcttacagaaaagtcaggaaccatgaaagaaggacttactggttagtaaactgaatattattgcttttaatttagtttttcagtcatttcaaaaagatacacaacatcatttgtaataaattttgaactgcagatatatctctagcagaataggatgtattctgtttcccaggtgaatgtaagttgcttgaggtgttttttttgttgttgttatttatagtatttttccttaatattattttgttttaatttttaatcatggtaaaataaatgtaacataaaatttataatcttaaccattttcagtagtgttaattatgttcacactgttgtacattcattctccaaaactcttttcttcttgcaaaacaaactctatacccattaaacaactctctgtttccccattctactttatggatttgacatccataggtacctcatacaagaggaatcatacactaattgcctttttgtgacaggcttatttcgcatatcatgatgtcctcattgtttatctatattgtattatgtgtcagaatgtcctttttttggctgggtgtggtggctcacacatgtaatctcagcactttgggaagctgaggcaggcggtttgcttgagcccaggagttcgagaccagccttgacaacatggtgaaaccctgtcttctataaatgtgtgtgtgtgtgtgtgagtatgtgtgtatagatatagatagatataatttccactttttaaaggcttaataatattccattgtatatacataccacattttgcttctccattcatctgctggagttgcttccaccttttggctattgtgaataatgctgccatgaacaggggtgtattagcattctccagagaaacagaaccatcatggtggtggtggtagtgtgtgtgtgtgtttgtgtagagagagatttattttaatgaattggctttcctggttttggcagctcttccttgagtctgcagcctacctcatcagaccctggactcaccaagccagggtgatgggatgggctgttgactcaaggaagagttgcagttgagtccaaaggcagtctgttgcctgaattctttcttgctcaagggaggtcagtctttttctgtaagaccttcaactgagtagatgaggcccacctacattgtggatggtaatctgctgtactcagaatccaccaatttaaatgttaacctcagccaaaaaacatatatatagaagcatccagaagaatatttgaacaaatatctgggtattctggcccagttgaattgacatgtaaatgttgaaatgggtgtacaccctgttttcagttatttggggtatttacccagaaatgcatattcctatcataagataattttatttttattttcttgaggaatggccatactgttttccgtagtagctgtaccactttacattcccaccaacagtgcacaaaggtttctgtttttcagatcttcaccaatatttattattttctgttcttcatactagccatcctaatgcatgtgggatgtaatcactaatgaatagtgctctgcatcttttcatgtgcttgtttatcatccttgaagaaatgtctattcaagtcctttgcccatttttgaattgggtttgggtatttttgttgatgagttgtagggtttaatttgttctttttgttgagacagagtctcgttctgtcacctggactggaatgctgtggcatgatcttggctcactgcaatctctgtctcccaggctcaagtgattctcctgcctcagcctcctgagtagctgggactacaggtgcccaccaccatgcccgactaatttttgtattttttgtagagccagggttttgccatgttggccaggctggtctcgaactcctggcctcaagtgatccgcctgctttggcctcccaaagtgctgggattacgggcatgagccaccgcacccagcctaatttattcttttttaatggctgcattatgtttaatctgtagatgcactgtaatttgttcagtattcactatcaagttttctttttttctagtttttaccattataaacagtactacagtaagcatatgtattttttttaaggtatggaataggtacccaaaaatgagtttttgcatcaaaaggtagagattaaaaaaaaaattgccagcttacttttcaaaaatgtattagtttaaattttcactaacagtatatgagagcatgcttctccccttacatctccaccagcaatagggcattataactctgatttttagtagtattgtgggtatagagagatatttttactttaactaataattctctcacacttagtgagtttataaatctgttttatctttgttgaccatttggacttggttttctgtaaattgcactgtattttgttttgcctatcttttcttcttaactttttattttataaaataattttatagatattttatattataatatctataaatatattaaagatattttataaaataatttttatagatattaaacttttaccgtcaaacacattgcaaaatataactgtataattcatcttgatttttatgatatctatataaaaaatataaatatatatcaaatatgcccttctttttcttagtagtatgtggatttctttctctgttaaaaaggccccttagccaggcgtagtggcacacatctctcccagctgtttgggattctgtggtgggagcattacttgaacctgggaggttgaggctgcagtgagccatgatcatgccactacagtccagcctggtcaacagagcaagaccccgtctcaaaaaaaaaagaaggtcctttcccacaatgtgttgtgtgagataggtgtctatgagatagctgatcttttattatataaactaaggtttggcaaactttcttcaagggccagatagtagatattttcagctttgtagacaagatggtctctgttgaaactgtgtgattctgtaacatgaaaatatttatagacaatttgcaaatgataggcttggctttgtcccagtaaaactttatttgcaaaaataggcagaggccacaatttggccagtgggccatagtttactcacttcttactgtccttttcccactggatgaatatgccacccctggtttatagtaaagtagtttgacttactggaatctaattctggattctttattcattacatcagtatatgtattttcttatcctagtagtatttttatttaattttagcgttctgatatctgttggagcaattcatttgtctccttttttcatacttttcatggttattctcagttattaattttccatgacttttaaaatcacttattcagttccccatagtgtcctgtctgattagagatggaaatacattaaatttcgatttaaattttgatataattcactttcttatgatattaagtcttcccagacaagaacatgatatttctttttattcagattttgttttatgttctgcatagattttaaggttttcttcaaatagaccatttttctttttatttccaggtgttttgtagattttgtttttctttattttgtttccatttctagttatttatggcattggaaaaacaaaaatctcatcctattgtgtttttacaaacttttttttttcttgctttattgcattgctattatagtattgcattaccaagactgtgctgaataatgatggttctagtagacttttctgtgtttgttttctggtattaattgatacagtttaagtgtttcatcagttagaattatagcctagtctttatcagatctaagtgatttccttctagcgtttctaattagaaatgatactaagttatttgctagtttgatgaagttattgggttccccccctccacttttttttatgcttttaaatttggtacctctgtgttttcattccataacgttgaccttcccttttcctaaagctcattatcaggttattaaaaaatactacccattttactcatcaagaccctttattcttttacccctatttcaaagatacttatttagcatttgtatttcatatcccagatattttctcagtatcaaaggtatcaatacctggcagggctcttggtcgaagtctctttgttccctggtcttctctctgtctgcctcaggaatagaaaggattcagccttttattcagctttttctgttcgtatgcctgctagttcctcccagagaggaaaacactgtagaggttctagctttctccatgtacacccttccccaaccccaggagctgcttagctcaggagagctggtgtgttaataggagatggaatttggaggaaaggggagagagggatgggttagctcccagaatcccatccaagtatagttgttaatatgttctttttcatttagagatatatgttacagtaatatttggggtaagctgtctttaatacttaattcacaccctagttatggcagtagcatgctaggatacatgttgagaatctgtgcttaaaagtatgatttgttcacttgaaccctgggaagtggaggtggagattgtggtgagccaagatcatgccactgtactccagcctgggctacagagcaagactccgtctctaaaaaataaaagtaaataaaagttttaaaaatatgatttgtatctcatatgtaaagacaagaaagtatagaatggatgcttagtgcttaaaaggacttcacttctgattcaagtaaatataacagttataagataaatactggtatgttaaagacagatcactcaggcatctttttgtaatgatagtaatctaaggtcagtctatgaagttaatttcatttcttcccagaatactttaaatattgattaaatacccaagaagaagtcttctttagtaaatgtagagaagctaaggctctgtactgtgcttatgtctttatgctcctcacaatgcctctcacaaaatagggactgcataaatatataaactatatgaacaaactaaggaaatcctaaccaactatataagcagtgattatttggggctcgtaatatgatgtactataatgttcatatcatacattttatggaattcgggactggattttcaattaggcaataattgttattttctactattgctctaaaattgtacaacaaagtattatgggatgtagagtgatttttaaaatctgtattatagcactttatatcttgtaaaatacctttatgctaccttgtttgactttcataacacttctgtggggtagacaaggcaagtattattttttaagttggaggtcaatgaccagacaaaggacagccagccggtaagcaatggaacaaggactaaagtacaaatctgcctcaaaatagtatatactgcatgtgcatattataaagaaatatcttttttgcaagaagatgaatatgtttattgaggttttagcagttgcatatgagatctttcatgggcatagtttggttcagttaatgaagatttcattggagcattgtgtgatttgaattttaaaggattaaagaaatacagcccaactttctttcctcttattgggtttagttttgcttttatttaaaattttctttttatgtaatgtatttcattgttaactttcaaattatattttaaaattagttggaatcttaattatttaaaaaattaaatttgcctgatttaccaaagtagaacagtagggctatttcaggtacagtggatgtggagtggaacataaagatatgttaataatttgagaattcttcaaaccagaggctcaagaattagttttcttagatttgtgggtctaaaaattaatatatgtttatatgtgtgtatagatgtacatgcatgtagatgtatgtgcatgcatacacattaacatatttattgagttcatgctttgggcaagcacagttctatgtgctagtgatactcattagtgaaataagcactgtgtttgctttcatggggcatataataatagactaagcaaaccagacatacacagagtaaaacaacttatacaaaaaatgtctccactgtgtttaatttttcattccaagactgtagtttattcacttgagggaaataggcttactacctgaaactcaggaaagcacctttagttacaaatttaagttaactatttcacaaaagatataggaatggctaataagcacatgaaaagatacacgatattgttactcatcaggaaaatgaaaataacagtgagatactacttcacgttccctagattggataaattaaaaaggttgacagtactaaaaagattaacaaagtagtaaaaaggctgtggagcaaatataactctcatacattattagtaggagtgtaaaatggtacaaatcactttagacaagagtttaccagtttctttcaaaattcaacatatgcttactttctgatccaacagttctaacagctccactcaagaaaaatgaaaatatatgtccgagaaaacattgtacagaagtgttcatagcagaattattcataatatccatcataatagctcagatatctgtcaacaggtaaatgaataaacaattgcattatattcctaaaacagcatactattcaggattaaaaggaataatacatgcaataatatggataaatgtcacagaacattacattgagtaaaaagaaccaatacaaagagaacatactctatgattctgtttttaagaagttctagaacagacaaaactaatatgtagtgacaaaaaaatgattcttctgaggccaaggtctgggccaggtcaggagggtgtagtagagatggacccaaccagtaagggacaagaaggaacttttagggcatgatggaaatgcccaatatcttgttgaaggggtcctcttgaaactgtaacactgttacagtttgaactgtatacttaaaatgtattccttttattgtattaatttattcttcaattaagctattttttttttgcagttgcaatatttaatagagtgaagacagagagagctcccatacaaagggaggggacccaaagaaggtagccgttgccggcttgaatgcctgggtttatatcccgatcattgtccttcccgctgtgctctcaggcgatagatgattggctatttttttacctcctgtttttgtctaattagcattttagtgagctctctttactacctgattggtcgggtgtgagctaagttgcaagcccagtgtttaaaggtggatgtggtcaccttcccagctaggctttgggattcttagtcggcctaggaaatccagctaatcctgtctctcagtccccccactcaacaggaaaacccaagtgctgttggggaggttggctgacgaccagtctaactgcttcctgcggaattggggcatagtaggggttgtgcagttgagatttcctcgggaggggtgcgttcgatatcattacaattggagcatgggctagtaggccggtccaggggtccacggtagatcttagtcatggacttcatctggggttccatttgaagaacgatttgtagctttacaactttgattctggaagagacaaacttaacaaggaggttaaagatacagggtccaaagaggagtatcaatattagagctgctagagatcctaagaaggggagaatccagggcatccattggctgaggaggccccagggtctggtgtttttgaagctcctctgttctacgttgtattcaatctcgaatttcttcaactttctctgtgacaattcaggattgattaacataataacaacattcttccgctaaaataacataataacaacattcttcccctaaaaataaacagcttccccctctttcagaggttagcaagtctaaagctcttcaattttgaaggactactgatgctaggaagttaagttgatcttgcaaggtgaccagggagtcggcaacccattccatgtcaccattgagttcttgagatagtttgtagtagaactgagtagaggttgtggtaccgccaatgccagaacctagtccacctagcactcctgctccgataacaaaaggaagaatgagtactcttttgttgtggggcttaggtacaacataattgtataaatcttgttcagtgtaaatggtcatgggggcactaagaatgagaggaagcacatagattctgaagagccattcaaacaacgataggctaaggtaccacagacaaaaaatattcctgagggtaggcagactattcgtgtgggaggagttacccacctgatgcattgggagttggttgtgtctacagtattgctaaattttacacaggtgaggtttgaggtatgggttatttccagattggaaacaagaggtcctactaaaacggaagtggtgtttatttctgtgctgtagttgttccattgttcaggtacagggattgaaatgcatggcctgaagtacagggggaggcacatccaacagttagtagggttttgggccgagacctcatggagccgagtgagggtggtattaaataggcttaccaggcaagtatgggtatggagggtttcatgtagttttagagagatctagtcctttgtaggggctaggggtgctatgtacccgggtcagttgggagattacttcctttacatgtttttctcttgcctgatcttgaactccacccccctcagacataccagtatgggtgaagtaagtccgacagacagtggctccaagtcttccaggacaactaggattaatcattttccctgtccaataatgagtatttgcatgcatgcaaagagtggcagagttatagcagttgtggggcatatgggtgtgggcagtgaaggtggagtttcctttaggtaaactcctatttgatggggcatcaatatttctgggaagccgcattcttcatagaaactcttggtaaggggagctgctggttgtacagcagcatggagggggtgcagtgagagtgaaagggggtaagagaacagtaaagagaaaaatatgataagggagggccatggggatttacgattttagttactttcctcacggttgtctgacagccacaagtctcctttagcagtgagtatgccgttcacattatgagatgtctacacagatctcttccttgtattattttaactgcttcagatactaagactgctactgccgccactacccataaacaatgaggccaaccctttgccactacatcaatttccttactcaggtatgccatgggttgcaagctcatcgacctgtgtaaggactcctagagctatttctgtttttttctgtgacatgtaaagaaaagtcttgccccgttggcaagctaaacactggggcttgggttagggccttctttagggcctggaaagccgcttctgcttcaggtgtccatcttactaaatgggtattggctttctgagtttccttaattagtgtatataatggtctggctatttcgccgtacctgggaatccatatttggcagaaacctgttatgtcaaggaatcctcttagttgctttagggttttgggatgaggataagccagaataggcactgagggccctggtgcctttggataattttagccctaagtatttaacctgctgtgagcagagctgagcctttggtttggaaaccttgtagccacaggtagcgaggaaatttaagagcacttgggtgacttgatggcacaaggtttctgaactggcggctaaaagtaaaaatcatccacataccaaaggacaagagtgcccaggtatgagaaccggctcaagtcttgggctaatgcctggccaaatagatgggggctatccctgaacccttggggtgaaacagtccaggtgagttgagacattgggtttgaaggatcttcaaaggcaaataagaattgagagtcaggatgtacagggatgcagaaaaaggcatccttaaggtccaggtctgtaaaccactctgcttcctctggtatttgggaaagcagaatataagggttaggtacagctaggtatagagggacagtgacctcattgataatcctgagatcttgcactaacctccactgtccactgggtttctgtactcctaaagttggattattgtaggggctattgcatgcttttactaggccttgggcttttaggtccttaatcttttggagtccttgttgagcctcgggtctaagggggtactgcctttggtggggaaaggaggcagaatcctttagtttaacttgaacaggacgggcattctttgctcgtccatattgtccttctgttgcccagtcttcaagattaattccttcctcaagcaggggacaacaaacgggtgttctcctatgttcaggtgtataatggcccctgcttttgctagaatgtctctccctaacaagggagttgggctttcaggcataattagaaaagcatgtgaaaagagtgaagttccccagtcacaacttagtggctgggagaagtatctagtgactggctgtcctaggaccccttggatagtgacagatctggaggaccgttgtctgggacaggaaaataagactgagaaggccacaccagtgtccaggagacagttagcctcctggccgtcaatggtcaagcatacccagggctctgtgagggtgatggcatgggctggtgcttgccccgggcactctcagtcctgctgctggatcatctggttagtggcttctgactcagaggacctacgtcccctggggcagtgggccttacagtgattcccttgacacgaggtgcatggacgagggggcggcttatttctatttggacaatcttttttaaagtgtccttgtagaccgcactggaagcaaaccctattaggcatttgatttgcctagcttttcccttttccagtgcctccaaagtccgcttgcctgagggccatgactaaagcggtggccttttttttatcccatttgtcccattctgcctgctcatcctgatctctattataaaaaactgaggttgccaagttcaatagggtttctaagttttgttccgggcctaaggcagacttttgaagttttttcctaatgtctgtagctgactgagtgataaacttatcctttaagattagttggccttcagtagagtcagttgacagagagaggtatgcttcctcaatgcctccgttagtcactccagaaaggcggtaggattttcttcctttccctgtgttatagtggacatcattgaataactcacaggcttctttctagttttccttagtccttctagcacgcaagttagcaaatgtctgcggcaccaatctccatgttctgattctgtgtcccagtgagggtctacactgggaactgcctgctggcctgtggggaatcgttctctttcctctgttgtcgacctatcattgacctgactgagataccagagatcgccaaactctcaggctgcagttacggcgacacttctgtcatttggggttagtgtctgatttagcagtaacattatatctctccatatcagatcaaaggattgtcctaaaccttgtaaaacatcaatatagccattagggttatctgagaatttacctaggtctattttaatttaaagtctgagagagaaaaaggtacgtgcactctggctgggccgaattctcctcccaccgcttggagggggcataatcggggaatattggcattctttggttagttgtttacccctttgtctatctccttttggaccgtttgggttgaaggggggtccttattatttggggaaggagtctgggggatgctggggtagggaggtagactctgagggcttcctgtagggcataaatcacactttttacataattgcgagttgtctcttaatgaaaagaaagtttgtacgtatgacacttcacaccatttgccttcttttctacaaaagaggtctagctgtaagatggtgttataatttatgcttccctcaggatgccaggtttctcccccttaaagagtatatcgttgccaggcggtactgcagaagaatatgtcttttttttcttagcatctgagagtcaaattggtcccaattctccagaatacatcttaggggtgtttttgccttgaggggaacgtttcctatctgaaaaaagaacatagggatgccagcaccactagtcattttccgatgagcattagtcctagagcgtcctctatggtcctaatgcttattcctttccggggtgtgtaaccacccatggacctctgcttatcggattagttatgctcactgatgtagcagccctcaccccttttcccgcctttcttgatcacaaagaaaggggtccgggctgctggattctagtggtcctttaccagcgtgcccaacattgcctttgtgctcaggggtgagtcctagagctaggctgagttcctgagtatttcataacaacccagctgctccatcaagatgcattcccataaacaacagttcttaggcaaattcgtttcagagagggtataagtaagcttttgagtcaggattgagatagtctttttgattcggtaagtacgttaaggcttggctgagtgcaaacagctctgacatttgaggagaccaattattaggcaatttttctaactctgcttccacaagagtctccctatcaattactgaatacccattgtggttttttcctcagtcatttgggaggaaccatctatcatcctgtcctgaagggagttcctcctaggtctggtcggacctttgtatggtaattaagatttaaatcccctgtaaggaaatctgcagggttaagggaattatcagtggttagtgttaaattacctttttctgacagaatagccccatactttaatatttttgagttaataagctacctttttgcttttttgacttagaataattctgaaccggtgaggtgtgctcacaatgaggtttcctctaaaagttacttttctacttttttctgttagcaaagcagttgccgctacagattgaatgcatttgggccatccgcaggtcactggatgttaaggatttttgataggaaggctatgggttgtcagtggtcttagtgttttcaggctacgcccttgtttacgctgacaacaaggtagtattggagtgttatagggtcgcggagaagaccttcaattatcaattataggttttacatttaccctggcttttaaaggaatagggcacactgtttttttttactatttctatctttgtctttctttctctgactccctgtttgtctctctgcctctttctcctctttgtctctctccctctcctctctgtctctctccctgtcctccctgtctctctctctctcctctctgtctctctctctctctgtctctgtctgtctctcactgtctctttctctctgtctctctctgtttcctctcttagccatttacaaacttggggccctggcaagggtggtggggaacaggtcccacataactgcccatgtctagagctgtatacctaaatcaggagggacaccagggacaagactccctgggtttatagcctagatgcctaagggcgcagcatagagcttccttagatccctttggagatacaacttgctagaggaaatgaaagtctcaaccattagtacctaggaggcagggatcagaggaagtagattcagaggtaaggagaattttggggctacactttcaagaaagtcgtggttgggacccaggaggtgtgggacagaagggaaggtaggagcgcacgcatgggcgactgttgagtagagacttctggctgcgacatgatctcaaccggctaatgccgggagttcgggacgacagctttctgcctctagtcagcccttggcttccccaggaaaattgaaagtggaagctggctccaggcagaccaaggttcccaacccagaagggttgagggttgttagaaagcccttccccagatagcctcatacctgagtctaaagtctggcggccatgctaatcgtttttaaccggccgacaggtgcccagtattttcctccaattctaagggataggccagagtagcaagcaaaagtggtccaatattaccgctttggagatcccttcatggttgcgggttcaggtccctttgtggtcgccaaattgttaccagggggtccttgctcccagaactccgaagatggtggcgggctgcttctaagatgatggcaagcctcgtgttctctgacctggggttcttggcctcatggattccaataaatggaatcttgggccacgcggtgagtgttatagctctattagaagccacgggtcacagaagagaaccgtggaacccagtgactagtgttcagctcaattaggatgaacccgggcacttagccgcgtaggaacaatggcaagtctttagcccagtcgggatcggcaatgggcgtctcactggatcaggagcacaacggacaccctgctagatccagagggatggaagtcagtggcaggcctgcgatggcggcaaacagcagtggtggatggagagtgaaagctcagctcgagccgtaacaaacacggaccagaagagtgcagttgcaagatttaatagagtgaaaacagagctcccatacaaagggaggggacccaaagagggtagcccaataaagctattttctaataaccaaatagtttatggactggtgaaactcctgaaagttttttgtgggataattgcacccaagctgtaaaataatcagtttaagcccctccttgttagattaggttcttacgatatgcttaggttctgagttgttttatttccctgtttgttttaccttaagcttttttacaattcattgctgcctggtttgagttggttccttattccttctccttcaagttgaattacaactagtaattgcttgcctaactttacctgataagattttatatcctgttctgtattctgtatttcagtcatcagtttgtgctcatagcttgacaataaccagaacagtgcaagaacagttacagtattatgtgtagttatcaaacaaggctgtcttaattttcttacattcctaaatactaaattattttctatggtattgatctacagtcttaagcaccttcagagcttcaaggtactgatcatttcttgaagtgcagtttttctgcatgtagtttttggttgacattttttctttatagagacagggtctccactgcaagagtgcagtggcacagtcatagctcactgcagcctccaactcctgggctcaagcgatctttccaccttagccgcctgagtagctgggactacaggtccacaccaccacattcagccaatctttttattctttgtagagacagagcctctttctgctgcccaggctggtcttcaactccttgcctcaagtgatcctcccaccttggccacccaaaatactgagattacaggtgtccaccagcattccaggtcccagacattctacttctttcagtgctttgattatgtcatctgattgcctattgacaacatcatttctgatgagaaatttgttattaatctgaagatgttttgtacataagtcccttgcctgttttgagagtctctctttatatttcagtcatttgattatgatgtacctaggtgtggatcgctttgattttattctttttagtttgtttatcttcttggatgtgtagattaatttttggggtcaagttcgggaagtttagggccattattttttcagatactctgaccctttttctgcatcttcttctgggcctctcattatatgtatattggtatgcctgatggtgtctcttgggtctctgagcctcctttccttccttccttccttcttccctctctttctcgcaattgacctatctttagatttgctgattcattcttctggctgcccaaatcagctgttgagcccctcaagttaattcagtttttgtgcttttcaactccagaatttttgtttggtacttttttgtaactcctatttatctctataatttctatttctgtttgggaatgatacatgcaacaacatggataaatctcacacaacattgtgttgagtaaaaagagctgatataaagagaatatactctatgattctgtttttaagaagttctagaccagacagaactaatctgtagtgacaaaaagtggttcttctgaaggatcagaaatattgttctgatactttcctgtagttctttagataaacttttttttagttctttgcgcatatttaaaataactctcttaaagtctttgtccagtaagtccagcatctggtctttttcagggccagtttctgctgctttttccccccagtttgtggcttatacttgtttctttgcatgtctttgtaattttgttgttgttgagacctgaatattttatatagtataacagaataactctggaaaccagatgcttcccccctttcccaaggtctgtttttgttgttgctgttgcttgtttagtttctttcctgaactaattctttcaggtttttattttttatcacacaggcccctaaagttactgcttggtgagtttagtgatcatctgatgattagaagagattttcttgaatgcctagaactagagtatcttccaatctttgccaggggcctatgtgtgaatgttggggcattgccttcaatgatacggcaagcaatttataactggattttactttcttcttgtacagagcctcagggtttcccataggtgagagtttagggccttcgtagatgttttttgagcgtgtacacagctctatacatgtgtatggctttctggattatcagaaatatgttagaacttttcagaccccctttggatttcttatttcccaggtttttcttttaattttttggttagcttgtttgtcccatctgttattgctatctcatggcagatgtgatgtttaacaattgccactgattttccacaaactctcctggtgataaaattgtttgcactgagtgagctctgagtcaagtcaaataatgtcctatgagggaggtttttctagggaactggcagatcaaataatgacagttttctgagagtggggcttttgaaagatttcagaaaaagttcattttgagaatttttgtgttcttgttgcttttatggaggagagtatattcagggtcctcactctgctattactgatgatatcaccactttaatgattcaacctcaagtttggataaatggattttgttgaaatttggggaagagaataaaaactgaggtgttttttaaagttttaaaaaatgtattctttctaattatttataaaatataaaaatttcaactcagtatattgcttaagaacatgagtattgcaatagatgatcagtgattgctttctgtaaaagttacatatccttgattattttggaaatttttatctacataggttttccgataaccttgaaaaatctgaatgaattgaatctttgacatgcatcagtatagcatgtggttaagattgagagcttttgatttaggcagttctgagtttatattccaggtaactaggtgatttggctcgttcaccttacatctctgggcctccattttataatctgtaaaatagggttattgtgaaaattagaggtaatacctttaataaactattgtgcctggcacataataaattaaattgcacactatagctggaattattagatgttattgacttaaatcattataattttgctgtgagttattttaacagcaatgatgatggcttgtcatgcctcctgtattcttttgttttatgaccagtggaacatatctggtgaatagctcacttttttaattgatgtatttctgtgttttgttttgttttgtttgtttgttttttgagacaagagtttcgctctttttgcccagcctggagtgcaatggtgcgatctcagctcactgcaacctccgcctcccgggttcaagcgattctcctacctcagcctcctgagtagctgggattacaggcatgcaccaccacacctggctaattttgtattagtacagacaggggagacagggtttctccatctttgtcaggctggtcttgaactcctgacctcaggtgatccgcccacccaggcctcccaaagtgctgggattacaggcatgagccaccgcacctggccgtatttctggtcttaacatagttcctctctgtgaggttctaactggtcccaccaatctacttccattcactaccaaatacataatctacttcttctgtttcagtgtccagtttcctctttctttacttttcttcaagttaccaggtcaatactttggaataactcttttgatcacttttgttgagttgcagttctaatggaccagaactgtcttcatttattcccttcttgccatttgcactgatttagctcatgggtcctttatcttctagatgaactattttagtggttcttagatttttctacctgctttttctccctccattctgttgagttttatactgatattaatttgatgtttcctaaaatatagctagactgcaaccaaataacactgcatgctattcccctaaacatctttgatcttttattatctgactctgttaactcctgggaatagccttggctcccagagtgcttctaaagttacttcagatgtcaccttcctcaagaagtcttccttgatttcttcacatatgccccagcccttcatatcatatagatgttctttctgcgaagtctgtttttgaaacatttccttctaccttttgttttgacaaatgtaactgtggaatattagagccatagaggctggaagaattaactaatttaacctcctcattttgggaataagacagcttccccaaaactgacttgtacattgtttagcttattgtttgatggcagagccaacagtagaacttggatcttagatcttcagccttgttctttttctatagcaaacataatatcatagaggatatcatgagctatttttaaatatttcaccatgtatgtagtttctctgtaagcagtaaactattaattcctcaaggacaaggattgtttcatttctctctgtatctctatagatggttctcagagactgtttcctcctatagtgaatgcgtgaatgataatcatctgctttagcattaatattgttaatgtaaaacttgaatcatatttcctacttacacaccttttaaaagaaataggtaaattgagtcctgtagggggcagcccaacacagcaagttttgattgccctaagctatctactacgctgagattgagacttaggcaatttaggcttaaattgcttcctatgtggatttttgaaaactgaaaacaactattaattataagcttatttggcagatatgtttttccccttcctcctccagctttattggaatagtttaaaattacatttctattttctaggacttcagttgctttttccagcagatatattttaaaacaattgtcatgttataagagtaggaactatttgatgcagatgatttgccattttgtttttaaaacataagatgagagcaaaagttatgtattagaacttttttaggaaatgctttatttgttaacttcaaaataacagatcatctgatggcaaattatttgagttatttatagctggggaaattaaaatatgcaaagtgttatcccaaactactaaagttattattaaatgaaatcaacattttctcattatgaatttatttactaagctaggtcattgttttattcaatatttttaagattaaaaaatattgctggtaatgaaagtaaagtttagatgaataataatagcagctaacatttattgcgctttattgaataccaggtactgttttaaattattttacatgtatttatttaatccttattgtcctctgggttaaatgctgttactgtcccctttatatacctgaggtaattgagaaaaagattggtcattgaaacttgctcagggttacctacctagtaattagaagagccaggatttgaatccagggagtccagtctggctttatagcctatgctcttaatcattattacctttcatatattaagttcattacttttattttttatgcctcttctgtcataactttttatgatttgagactgttctccagttttcacacacatcaggcttcttattactcttccttttcggttgcttactgccctcagtccattttcttctaataaagaaagtgcatgcacagaaagtaaaaacataatgttctccccttaatatgaagagattgaaacagctaaaattctggaattttacagaaagttattttcctaatcatcaattaggaaatttttagtgatcacattaaaacatgaagtctcaaacttaggaataaaataacttcaattcccatgctcatgcatgtagtatatggggtaattttagaagccaaaatagttaatacctcattttgaaagatagattgtgaatgatgcagttttaattatttcactaaaaatgagttttctttacctctctccacaaataaattcttggttataataagacactttaggccagacgcagtggctcacgcatgtaatcctagcactttgggagtttgagaccatcctggccaaactcatggtttaacgtggtgaaaccctgtctctactgaaaatacaaaaattagctgggcagggtgacgcacacctgtaatcccagctactcaggaggctgaggcacaaggattgcttgaacctggaaggcagacattgcagtaagccatgattgcaccactgcactccagcctgggcaacagagcaagactctgtctcaaaaaaaaataataataagacactcatatttttattatgctagcctaatatatgtaaaaattgaccttactgacttactattttctttctcatcctcacctttttatgatttcatctctccttaagatgtctttgggaatataagtagatatagtaaacataagttggacctcaagtgatcagttttgatttttttttctttctttctttttttttttttttttgagacagggtctcactctgtcacccagggtggagtgcagtggcacgatctcagctcactgcagctttgatctcccaggccctggtgattctcctccctcagcctctctagtagctgggactacaggcgcacaccaccaggcgcagctaatttttgtattttttatagagatggggtttcaccatgttgcccaggttggtctcgaattcctgggctcaagtgatccgcccatcttggcctcccaaagtgctgggactacaggtgttagccaccgtacccggcctcagttttgacatttgataaaagtttaggttaaatgtgagatggcttaaaatgttataactgttgaaaatagagctgttctatagctaattatttgatagtatttatatcacaaataaaatcttaatgtacagctcttagaagaaaatattacaaaatgtaagtctactgcctggtttatattattttttaaaggacctcagattacagttgatgttagaatttcttggaagaattgtcaactctgataatatacgccagaggtagcctataccttagaatagttagaaccttgctgctgctttaatgattgatttcagtcctcccatttttcattggttgacatgggctttagtttcctaatttactgctggcataatacattcttggtagttgcaaacttcagcttagttcctgtccaaagaatgtttatttcttcaactttactattggatattggtttctttatgtcattagtgcattttactttcagtccctttccatcatagagaatgtcggcatccagaatgatgccccttagggtgattattgagtctgctgacaatttcatggtgtaagaaaatctgcttaatcacttacctatttccatagtgaaaactaccttctaatttttttttctgttcttctcataagtgattttcatgtaacatgccagaatacacaacacctgtctgttaagaacagaattactaggctttgattcttggtagtggttccttcttttgggtaaatatgagagttgcttttggtctaattactcatacttttaaaataactatttgctaataattttaagtaggtaatatatagggttatcattaaggaatattagaagaaaaaatcaatttaaaaatacaaagactaatgtcctatctttatttctaacctgagcctgggtaattttgtttgacatttcatatcaggatatcatactcattaatgaagtatacgcctcagttcttgtgtgtgatgcctgttttttggttttattaaattttcaaggttttttgggattttatattatacttttgctttgcagtgcatgcagattgtttgtaataattagtgctaaggagatgatataagtacagttacgtattgttgtgtgcattgattatattgatattacatattgatacagatattgacatatgcatacttgaaactcctgaaatctttaggcaagttgcttcttttgcagattgcttatggtatattaaaatgtaattctcagcttagaaatataatctagcataaacattcagttgtatcatctgactttgatatcttgggagcattttacagaatatgttctgtcttcaacagtatgtacttctcaatggttagctttttaaaaaaaggctatcaatttaaaggagggtcaatattggttcagagaaccactgttatattgcttggaggggataagcaggttggtagaggtcgcttatcaatggaatggtgagtttgattataattaaacaagattggatacacatttggaaaccgtatttgagtagaccatatgtctatcttgggtgtaatcttttcatgaaagtcacctgtctgcatgtatatgttgtgacacaattatgtgaacaacataaaattatactagttgtgaaataatgtgaatcctgaattcactgagtgatttatatatagccatctgtcgatacctctgggtgattagttccaggacctccctgggttaccaaattctactgatgtttgagagtctgatataaaatggtgtagtatttgcatataacctatgcataccctcttgtatactttaaattatctgtagattacttataatatttcatacacatgtacacactgtgaaaatagttgttatactgtagttagggaatgataacaagaaaaaaagcctgtacatgtttggtacaaaaacattttcgacccatggttagttgaatctgcagatgcagaacccctggatagggagggctgactgtgttagatgtgtggctgagttaatgtgcatgaaatttggaatagccaaactaatgtatgttatacttatttttgaacttcatttaaccatgttttacatcatattgaactttataacatttgcaaatagaaatgacatgaaatatagaaaattgacgtatgttaagaaacagcttgttttcagagctgaagacccggaaatccaatgtagtacttactcttaacattttgtctaaattttccaagcatagataagaggaacatagattatttcatagttataaaacaaaagaatttattctgctcgtttaaaatttgaaagaaataatatatttcaataggcctttctgtccttgtgttctttcctccttttctcttttctttccttcttcctttttttctttacatttttctcccacttttcctccctcatagaatccttccttttctttgcttcagtaatctaaaaagtatttttactacatagtagagcatttcctattttaatttaagttttgaagttttcttttaaaagcaaagctttgctaaagggaaaatacctgtattaacttacatttaaagtttttttcattatgccaaaggtaattatctgttacttctaagaagtaagtcatattctgactctgcatacatgtttaaagtaacttagaatcagcttgggacaattctgacgtctgcttatgtattgcagcattcatactcttcactaggtgttcattttagctgcggatgcttcatataaaacagggtagagtggctttcaaaggatctacacatcaaagtgtaacttgaactctgatttttacactgcttgaggaatgcttaatggagtagaactaacaaatttacttttggcccaaccattattagagtttttagtcctttttacctacatgcctttctaagccatatcacatacaattgaatagttttgttgctttagagtgtttttaaaatgttcacgttaaatattgtgattcatttttcctttagtaaggaagatttcatttaactatgatttctggggaatgaggctgctgcttttggagccttaaataaaattatttgaataaaacaccatattttaagttagaacaccacactcttgcactcttttctatagtttggttgatagttattcatgaggccatgtttatcatcttttaagacctggttctgaagagggatttaaaataagtacagtgattatagcttgtaactacagtataccctcttttgctagtgaattctttgacacagaatgctccttactcaaccccttaccaaagtctcttttgcatttctcagatggataaattgtcacctaaattatacaagaagcacattaatatttgatgtatactattttcttagaaccctgtttaataatcataagttaagcctgctatatattaaaatgtttatactattttaaaacttccattgtggaaaataagcatataatttgacttgatgaattggtggtattattattatctcaatctgaaatactgttgggatgtatcagcctactttggattcaatagaccattctctcttcagatattgtattccaaaattttgaatttttttgtggaaataggtacttacattgtaaataatagttaagttcctaggacaagccatataagtaatagtgaaatagaactataaactctgacctggatttataacattgttcttttgtaatgccagattctaattcagaaatctataaaaggaagagttcccttactatggcgtttctcttccccattcaggtcacagcagtgtgggtgggaatccagaggttccaagctagtgaggaagaaagtgaagatgaggagttcttggctaccctaactggtggcgagcgttctggaaaagctcgcaaacagtggacgcagtgagtccacaatgtgggtagcaatttgttagtaaggacatttttaatggtcccatatttgatacttttatttcatattactccttataatgaaattatgtattttagtaaacctttttaaactagcatattgtaatttcaaaacttttcagcttcattttcagtatcagaacatgaatattaaatgagttttggtgaacagttaagacaaagttatttaaattcctacaggtaacttaaaatcaccatgatgctatacaatttttaagaaaaaaacttgtaatttttctgaattgataaggtagaaatgtatctctgatctttgttgttttggggttcttgactttaatttttttaaaatttgtttttatgaaatataatttttttaaaaaacccacaaaatgcataaaacaaacataaggtatgatgcataggtataaatcaaatactgatgaagttagccatcatcccagaatgatttcccctgccacccatatgataacttttttttttttaataacagcttacttgaagtataatctcaatactacagaggtcacccttttatttatttatttgtttatttatttagagacatggtctgtgttgcccaggctggtgtgtatggtggctatttacaggtatgatcatagtgcagtacagcctggaactcctggctcaagtgatcctcttgcctcagcttcccaagtagctaggactatagccactatgctcagcaaaggtcaccttttaaagcatgctattcattggttttaggagtcactgaattctaagttacacagagttgtgcaaccattcccgtgataaaatttcagaacattttcatcaccctaaaaagaaaccccatgcccattggcagtcacttatatcattccccctccctccagcccttggcaactactaatttatttctcccttctggacattttatgtaattagcatcatgtaatatatggccttttgtgtctggtttcttttgcttgcatattgtttttaaggttcattcattttgtagcatgtatcaatacatcattctttttatggcccagtaatagttgtatgaagataccacattttgtttatcaattcaccaattgatagacatgtggattgtctccactttttggctattatgaataaaagctgcagttaatatttatgtacaaatgttttggtgaacatatattttcatttctcttgggtagatacttaggagtagaattgctgggttgcatggtaattccacgtttaaacctttggggtattgtcagactgttttccaaagcatctgcaccattttacatttctaccatcagtgtatgaggagggttccaatttgtccacatccttgccaacgcttattttctatagttttaattacagcagtcttagtgggtatgaaggagtatatcattttggtttttgctctttcctaatgaccagtgatgctaaacatcttttcatgcatttaactagccattcgtatttcttaggagaattgtcttcagatcctttgctcattttaaaattgacttctttaactttttatttataagttttacaaattctttacatattctgaatagtggtctcttatcagatatggtttgcaaatattttgtcccattctgtgggatttattttcttgatgatgtcatttgaagaacaaaagtttttaactttgatgaagtccagtttgtctgtttttttctttggttgcttgtatttttaggttgccgtatgtaagaaaccatttcctaatccaaggtcacgaaggtttcctcttatattttttttaaagaattttatagttttactatgttacctttttaatatatttttaatagtattcaagtgctatgtttttaaaatttgttgatcagattacgtaagtggtgaaatctgtaaaatatttatcacttgcctttatttgctacttctaaaaatttcaaaagaatttttatgaaatttccctttgatgttactttagtagaataaatttttaaaaattatttgtgttagaaacaaaataataaatattcccatgttataaactttagcgttcaccacagaacccatagaccattccttgaggggtgagggtaggtgagactgtttgaagagctccactagctcctagcccaggtttagaatcacttttccctgggttagacacttaactgggcatcaagagaacagaatttcacttttgaggtcagcacagctgcttttactcagacatttcttcttgctattttgatttctttgtttatactaattaaaagtgtttcttaattattttatgtaagtacaccaaaaggataaaacatgttcatatgcagaagtgccctttgattcttcagaggaaaatagtttattaattacattctttttgtattagtctttttagtgtggctttgggtagaattagcaaagatattttaaagctattatatataatgaaatttaaactatacttcccttggtatgatttttcagatcttttgggagaaaattttagagaatttacctaattattactaagaatatcaatcctagcacttttatatgaagcttcttttttggctagtctactgataagttcatataaaaatttaaaagcaataccatttgttctgtaaatgggcttataacaagcatcaaattgatctcgatcccaagaaagggaagtattacttctctgtaccacacgttattcagtcaaaggatacgaagaggaaacaaagtgttgcgcttatttgaagaaaatttgcctcaagtgtttgtatgacaaagtacatttggcactgtctagacagaattataataagtataacaatttaaataagacaaaacataaactccaaaccagattgtggatataattctgatggatgcttttatttaatcatagtatcaattaagaaacttctcctttggagattaagtgtccctgactataataatgacagcttttcaaatgttaattattattttttagtgttgtcaagactattaaaagtgggcttcagactctcaacataagtacagaaagtgcttattttcaactctcctatttctctacataaaggataaaagtagtctgataagtgctacagactcccacccactcccctctctgttccccctctttctaccaccaaaagactgtttactgtaaagctctaaaagcattcatttggaaatggtctgttctttttatttaatgaggtattgtatattgtgtacattcttaagctaattttaatgaatcttcttttgaaaaccatgtgatgtaaaatttgatatgcatgaatatatcttaagccaaatatgcatgggacagttgaagcagatatcatgtgtcattgttggtaaagtctggcagcatatcctgtgtaaacccctgttttctttttctttgtgccacataatatttattctcattaacaagacttcaaaggaaactgaagttagaataccagttattttttattctctcttaatgggttctgtaacaactaaatactgttacctttcttggttctacgtttcacaatggttcaagagaggaatgaaaagaactagtcattgttaagcacttgttacattagatatttcatatatctcatttaattatcacatcaattgttcaaagataagttttcctcatttttcagattcagaaacagtactcccaaaggttgatgtaatttgctctagatacacagtacgttgttgggagttgggattccaaccaaacctttgttatttccactacatttgacattccaagctctatatgctatggcctttagtccacttttctctccttatccactgatttctcagaagtaccattatattcagtctgccctctgaatactcaaatgactttatctctttctctatttaaaaaaaaatatgtatttcaagctggaagcttgaagaccttctatattccctccattatttttatcttcttttgaaattctctactgttgtaatattttactttctaccacaattagcatattttactttgtacctactgatatagcttccaactcttagaaaatgaaattaaccagttaggattgttttggttttgctctaaatgccagtaagtccagagttaaaatttgtgctcaagctttgtaatttttttcatagtgctttgtacatatttctgttatcacataacactgtattacagttgtttgcatgttatttatctttgtatccattagcatagtgataccctggtaaatgcatagtaaatatgtaatgaatgaagatttctgataaaatttattcctgccttctgatcattacttagagatcctgcacttgggtactactattaagataattctatccaggctacttatatgttagtagtagtagtcgttgttgtacctatgcttttgttaaacataggtaaaaccaaagcttttttaaaacatggacaggaaataaaaacaatattctttgttgtaatttgtttatatcattgtagtgcctattaccactattactcaactagcagctacttgattctctaaagtaatgtaccatagtatgcttggggtttttttgtttttgctaaagatctataagaaaagttttattgctattcatctttgtcaccatttcagcaatgaagcttcactaatatttattatgtaatattttcaaaaatagtaagttcggttcattatctcaaaattgtgtgtcaagtgaaaatatactgatttgatggccctagtaattgccaatagggttttttgagttttgttttgttttgtttaatatacggagtctcgctctgggctctcgcccaggctggagtgcagtgggacggtgtcagctcactgcaacctccgcctcacaggatcaagtgattctcctgcctcagcctcccgagtagctgggattacaagcacccgccacagcgcccggctaatttttgtatttttgttagagacgggttcaccatattggccaggctgatctcgaactcctgacctcaggtgatccgcccgccttggcctcccaaagtgctggaattacaggcatgagcctctgcacccagccatccaatagggtttttaattttggaaggtagcttttgggcatgaacaagcacactcatagttagttgtgttttattagagttataaattgtaaaatctagtttttctaaaatgccttttcagttcaattaatgctacttagaaatttagtaattgttgtacaaaaatgagagcagtctttttcacttcttgatatttccagagtccatcccttttctagatttaattcttaaataacacatagtactacttatatagttaggcaaatctaattatattcttgattaatcaataaatgaactttgctaattccagttatagtttagtatagctgattttttaagcacctgcaaatataacaagtgaaatcctgtgatacacttaagcaacccttgtaaatcaaataaattttacttataaatgtagtaaatcaccatcctgtttcaaaagacttaaaaacaaagcacacacacaaagtagctgatgaataaaaacttgttgctataccttgaaaaatacaacatacataaattatcaatataatatttgtttcttcagctcaaccaagaagactagaatgtccatctaagcctcactggagcaaatgatattatgcattcagtttacagggatttgggtctttgggagatcctgagcagtctcactctgttgcccaggctggagtgcagtgacatgatctcagctcactgcaacctttgcctcccaggttcaagtgattctcctgcctcagcctcctgagtagctgggactacagatgcacgccaccactcccggctaattttttttatttttagtagagatgaggtttcgccatgttggccaggctggcctcgaactcccgacctcatgatccacccgcctcagcctcccaaagtgctgggattacaggcgtgagccaccacgcccggcctgtccaatctctttttaaataaacttgagccccttgtcattgttacattctgcctgctgtgtccgtaggagactcccccagcacctccatccgtgcttggcttttaattaaggccattttaagttttacaacccagtgcattgtgcatctactgggcatctgttaagtttcacccctttggttattttatgtttttctctttcatagctttttatcactttgtttcagtgaatagaatctccttttactctgatggcattcttcctcctctttatggacattgactccacagtcagtgagccagatatatacccttctagccataaatggtcatttttaataaaccaacatttctaataattcttaatgtatgtaaaacaatatgtatgaccaaaacaacaaaactgacactagtaataacatagtaacagggttgactacaagaatagtatatgttattataatccttattttttttgacagctcaatacagaatacatattagaattcagtagagttctgttgagagtcaagtcacatttaaaaagaacaattataacactcattgagaattcactgtgctagacattgttctaaatactttatatgaattaattgtataaccttcacaaaaaaatctatgaggtatatactgttaatatcctcattttatagatgatacaattgacacacaagtaacacaagaaggtttaagtatttgactagggtcatataggtactaattgacagagctgggattggaaccataagctgaatccatcgtcatcaagtgccatccagagctagaatatgtgtcttctgactggctttaaatatcatgctcttattactgtaccaggccataaattatttgaaatacgaagggtcagttttggaaatagatgtttgtgactaggaagtatgaagagtaaaagactctagagcttttctcactataactgccattattagtatttacttagactacattcatttttatactttttaaaggattttcattatgtgcttagtgattttaattctgattttggttcttataagatttatacattgtaataattacctttgctctgttatagtatatattatctgccttttaaagatctccagtattataaacattacttttgttttgagccttaattgactgttctgggtttttcagccaggatggagaaaacatttcatcaggatcacctaaggggcttttcctgctacctgagtcttgagtccccacctttcctcactcatttgtgttgagagtcactgtccaaccgagcaactgttattgatgtgaattttgttatggccttcaagtgtgttagagtaggttgaaaggttaaaagtcattgttgtagactagtgcttctcaaactttaaacatgaatcacttggaaatcttgttaaaatgcggattccaattcaggaattccaatatgcagcctgagaatctacattttaataagatccaggtgataaccaaaatgctacaggtcctcagagaaaactttgattaacaaagctctagactagttgttttgaaattttgaaaaaaatttttattttgagataattacagattcacatgcaattgtaagaaataatacagaaagatctacatacccttcatctagtttcccccaattctaacatcttgcataattacagtacagtatcacaaccaggaaattgtattaatataatccacaaaccttactcagatttccttagttttacatatactgtgtgtgtgtatttagttctatgcaatctttatcacatatgtaaattcaccctatattcaaaatatacccgtttcaacagaaggatctcttaggctacccttttatagccacagccacctaccttactgcatttcttccctaacctctgacaactactaatttgttttccatttctaaaatttttgtcatttcactaatgttatatcagtggagtcatgcagtgtgtaaccttttgagattgacttttttcacataacataactcccttgagatctatccaagttgttgcatataccagtagtttgttcctttttattgctgagtagtattccgtgggacagacctattacagtcagtttataagcattcacctgttttaatgggtagccctgggattgctttctgtttttgactctcacgaataaaacagctatgaacgttcatgtataagttttttggagaagacatttttacttctgggaatattcaagagtataattacttggtcatatggtaagtgcatgtttagttttgtaagaaactgccatactcctttcctgagggactgtactgttttgcatttgtaccatcagtgtgtgaaggactatttttccacatgcgcaccagcatttggtgttaccactaatttttattttggatattttggtaggtgtgtaatgatatcacattgtggttttaatttgcatttctttaatggctaatgatgtgtgagatatgttttcatatgcttatttgccacctatatattctctttggtaaaatgtctgttcatgtcttttgcccattttctaattggattatttgctttttttaaaaactgttgaattttgggagttcttatatattatagacacaagacctttctcggaaatatggtttgcaaatattttctcccagcctgcggcttatgttttcattctcttcacaggatcttttgcagaacaaaagcttagctgttgttgttgttgtttaattttaattaagtctatttattagtattcccttttatgggtcatgcctttagtgttaagttctaggctgattttgaaagtagtgttaaaatgactttgcccttttttttttccttgccatatagaaaaacattaaaacgtaaacttctgaatttcatgattctggactttttagcttacaaacaactgaagagtaaatgaatgaaattaaaaggaaataaaaccttgagtgaacacagtttgcatagtattaaattagactatgcattacagtgttctaaaactagtggccctggtgatggtatgttttaagttacaaattgttatgtgtcagaattgtgttgtgcattttattatctcagaaactataatgtaggtattatctccatttatacatatacatatgtgtttacacagatgtatatatacacatatgtgtttacacagatgtatatatacacatatgtatatattcctgttttgcagttgaaaaaactgaggttcaggaaagataggtagttgtgtccatggttccataataaatgacagaaacaggacttgaatctaatactcttttttgagacagagtcttgctctgttgcccaggctagagtgcagtggcgcgatttcggctcactgcaacctccgccccctgggttcaagcaattctcctgcctcagcctcccgagtagctgggattacaggcacgtgccaccatgcctgactagtttttgtatttttagtagagatcaggtttcactatattggccaggctggtctcggactcccgacctcgtgatcctccctcctcggcctcccaaagtgctggaattacaggcatgagccaccacccccagccgaatctaatactctttaacaactggctggcatcttttgttgcatcatgtaactgtatataactcataggactcaaacctgatttaagtttgtgatgatcgtgcctgttactcttaaagtccatacattgtctgattttcagcttatagtaaatcatcatttcttgttttatcaacgttaatgttaatattggttaacctattggctctactggctacatttgaaatagagactttttctttgcatttcatttctttctttctttcttttttttttaagagatgaggtctctctgtgttgcccgggtgagtctcaaactcatgggctcaagctctcctcccacctcggtctcctgaagtgctgggattacaggcatgagccaccatttacaatatagctgtaacacacattatttataagaattctaagttttacacttgaactatttaagaaaatacataaggtttcctaaaatgtttataagtttcgtttttctgcttttcttcaatatatctctgagctatatcaacactgtaaatttcccatataagaaaaaatgattgctgtattggtgaaggcacatgagtagaggagagatgggagcagccagccattaccacctcagtttttcatttcatttggtgttaagaaatgactaacatacatttgaaaaagtaacaaggacagtttcaaaggtgacttacatcatgttatttctcatgagagtaatactgtttcttggaagttattgaaatactttgcatatttacaaatatgtggcaagatcaggtattgtggtatattcctgtttgcagtggctttcttgtctgtcaacctaagatttagattgcattggatattgttagtcttgtctaattttatatatactaaatcaacgtttacagcattcctatttgtggagatttaaaaatatttctcagtataatttagtcttctttgcagagctctaacatcgggctaatgagagctgttgaaaagtttgcaggaatatgtcctccattcccattgcccttaagaacctctgtacttgaatgcatgatctctctatgggagcttttattttaagggtaattgtcttagtccattccatttgggctgctataccaaaatatgttagagtgtgtactttttttttttttttttgagacagtttccctcttgttgcccaggctggagttcaatggcatgatcttgattcactgcaacctctgccttctgggttcaagtgattctcctgcctcagcctcctgagtagctgggattacaggcgcccacaactatgcccagctaattttctgtatttttagtagagatggggtttcaccatattggccaggctggtcttgaactcctgacctcaggtgatccaccacgcccagcctagactgggtaatttataaacaacagaaaattatttctcacagttctggaggctgggaagtcagagatcaaggcttcaacagattcggtttctggtgagggctgctctctgcttcagagttagcactggttgctgcgcccccacccccacccccccaacatggcagaaggggcaaaagccttacaagctccctggggcctcttttataagagcattgatcccattcttgaggactctgccctcatgacctaattacctctcaaaggcttcacctcttaatactgccatgatgaggaataggtttcagcatgaattttggagggacgcattcagatgatagaagtaactaactccccaaattgagtatttttttgtcgtcctgattgacttaggtacttaattgctatttgctagcacactaaatttttaagaataagaatattacgtttttaaaggtactgtataataaatattaaacagaaaatgttcatcagatttttggttggggtatattgagtttttgtgttttaaaataagattttcattaaatgagaaacaacactttgctgagcattttcttgtttttaccattctacagcgtttagctacactatgtaatagcactggggctttgtccccagtaagcaaatacctcatcataaaagattgttgaaggttatacctttataatacttgctcagatttgggaaagggtgaaaaaaaagatatataaaaataacaggatatttctccaatagtgaggttagagaagaatttctgttttttaatatgtaaccaagactagttggcctttcctgtttagcattttttttcaggtaatttttaatcttttagttttaattattatggatacataatagttgcaattatttatggggtacatgtaatcttttgctataagcatgcaatgtgtaatgatcaaatgaggatattcaccacctcaagcatttattatttctttgtgttagaaatattccaggtaatttcattatagcaaagccacctcacatttcatacactaattaggatatgaatgagagctccaaattcttgaaaagattcctttgactttgttgttttcaggttggactgcgggaggtaccttctgacttttttctttgagttgtgggtacagtcctgctgtcttccttttccactgcaccagctccagttgtcttcacataagcttgctgtattcagtcagcctctcaccagtcattctggttttggttcataaccaagtcaccatacatagcactgctttccattagtcgtcagaaaaagcctttcaccaacattacttcctttgctaaaaagcattaaaagcttcttcatggcctgaagatcaaaaaccctgagtgagggatggctattttaaattatcactacagttccctattcatttcttttcttctctgaactcctcaaccttattatctttacacagttaatcacttgattatgcatgatattgttcttggtttcaacttgtatgagaaagtatggctttttaaattgaagaatgtattagtctgttttcactctgctttaaagaaatatctgagactggataatttataaaggcaaaaggtttaattgactcacagttccgtatggcttgtgggggcctcaggaaacttaaaatcatggcagaaagggaagcaggcaccttcacaagccagcaggaaagagagatgagagtgcaggaaaaactgccacttttaaaaccatcagatctcatgagaattcactcagtatcacgagaacaacatgaggaaaaccacccctatgacccaatcacctccctccctcgacacatggggattacagtccctccctagacgggtggggattacaatttgagatgagatttggatggaaacacagagccaaaacatatcaaaggatatcaatcatatttttaaaaataatccctaaagagttcaaatagtgaagtgaattaaatcatattcaatgcatattatcaagattttttaaaaattacaattttcatacttgtcacaaacactcaaatatattattggattactattttaaaatactatgtattcagtgaatacataaacatagaattaggaaaggcagctcacatgcttacatgtttattttttctacttatttttatttattttttcattttgtattatactttaagttctggaatacatgtgcagaatgtgcaggtttgttacatagatatgcatgtgccatggtggtttgctgcacccatcagcccctcatctacgttaggtatttctcctaatgctatccctcccctagccccctactccccgacaggccttggtgtgtgatgttcccctgcctgtgtccatgtgttctcgttgttcagctcccagttgtgagtgagaacatgaggtgtttggttttctgttcctgtgttagtttgctgagaatgatagtttccagcttcatccatgtctatttctttttaaaccaaatctctaacagttgtgtcaaatatgttgaggtatacctctgtcattaaaagacaaaaacaaaaccttgtcgctaatgcctaagtgtttgaagtcatattcttataaaatatgaggcagcctgggcaacatagtgagacccccttctacaaaaaagtaaaaaaattagctgagcatggtggctcacacctgtagtcccagctactctggaggcttaggtggaggattgcaacttgggggttgcaccactgcaattcaacctgggtgacagagtgaaaccttgtctcaggaaacaagcaaacaaaaaatatgtatgtatggcatttctctgttcttgttaagttttaatgatttttcatctcagaaagcttaaaatttaccatcttaaagtgaaataaccgttaagagggagagaggaggtaaaaatgcttttattctctttaacatttatttatttactctgtggttggcaaagttgctcatttatttccacaacaaactcaagagatatggaatgtcccaaattaacagataaaggaaactgggtacaagatcatagatcttgcaaacagtggtgctcttcatagacactggctcatttcagagcctctgtactctgtcatgataaagcctccatcatcactaaggaaatttagtaaatgaaacaattttaagagtaaaacaatgagattattagcaataaattacgatgtagtgctgctaacagtttttgtcagatgaaatggctggatctgctgttttggaaattgtgaaacctatcgaaaagttgaaataatgaaactactaaaatcatacaccctctacctagaatcaccattagttaatatttttttatttttgctttgtcttcacacacacacacattctctgtctctctctttctctctctctctgtctctctctcaaccattagatggttaagttttggggccaggagcggttggctcacgcctgtaaccctaacactctgggaggccgaagccggcagattgcctgagctcaggagtttgagaccagcctgggcaacatggtgaaaccccatctctagtaaaaatacaaaaagttagctggacatggtggcgcactcctgtagtcccagctacttgggaggctgagccatgagaatcacttgaacctggaaagtagaggttgcagtgagctgagatcgcgccactgcactccagccggggtggcagagcgagactctgtctccaaaaaaagagaaagaagattaagttttggatatcatggcacttctttcctaaacacttgaacaatgaatttcttaaaaataaggattgtccttattgtacctaagaaatttgacattaactcaataatattatcagttgtccattctgtatttccccatttatcccaaaactgtgtttcatagttggatttctaaaaaatgtccttcttcaatttagtattcagccatggtttatgttttgtatttgctttgttagtctctttaagagatactgagaaaaaatgcttttgttgatatctttttgtgttgtttgctttttaatgtctttaagtttttgaagggtcccagccaattatctttagaatgtcccacccaactttggatttgtctgtttcctcagaattagatttacctgaatttatcatgttaaacatttttcacagtgataccacatctgtgatgttgtgtaattatgctaacaccgtatcaaaaggcacctaatgccaacataaagtttatgatatataaatttgtaattggcagcaacaaagacttaattgcttgaatcattttttcctttttcaaatagacaacgactgaaagacctttcattcagaagctgtttcgtcctgtggctgcagatggacagttgcacacactaggagatctcctcaaagaagtttgtccttctgctattgatcctgaaggtaatacaatcagcaacattaaaacatttctttcattttctgttactgaagtaaaataagcattccacatttataaacaacaggttatttcaggaagatattttcatatcttacagcgaaaagtcttttcaaacagaagcacctaatatttaatatattattttgtaaattattgactaacaaaatgatgactcgactggcgaaataaaatacagtttttaaatcatcctcttagtatatctctggtactctggtttttaatttatggattcagttctgataaatactacttttaatcttgcattttgtttattaactttaaagaagtcagaaatggtaaaaataattttctcatttttgatatttgaaagttgataatactgaaaaatggatgagtattttatttgaattttctactactttctactttttcagttaacctttttcttttaggctttgacaatctacaagttcgttcaaaaacttgacctgtttcatggcgctaattttgtaacttaggttaaggctgttttcctgcaagcaagggacaaattttaaaatttctgaattctgtttttctttattacaacataaagaacaccaagaaaatgcagaaaacaataaaactgcccataatccattaactgatagagaccactgttgagacacacacacacacacacacacacacacacatatacacttgaatacttgagatatacatatgtgtataatacatacacattggcccttcatatccatgggctccccatcatgcccacagcagataaaaaacatttgggaaagaaaatggatgattgtgtctgtactgaagataaacagacttttttttcttgttattattccctaagaatacagtataagtatttatatagatttacattgcattaaatattacaagtaatctagagatgaatgatttaaagcacacatgtgcataggttatatgcaaatattatgccattctatataagcgacttgagcctgggtggattttggtatcctcagggatccttgaaccaatccttcatgaataccaagtgaccacattgtgtgtgtgtgtgtgtaaaatgtcctgctgctcttgaatcccagccctattaatgcttactaaactataggggaaattttcagtggcatattactgtattgacataaaaattgcatagagttggtcgggtgtggtggctcacgcgtaatcctagcactttgggaggccaaggcgggtggatcacgaggtcaggagatcgagaccatcctggctaacatggtgaaaccctgtctctactaaaaaacacacaaaaaaaatcagctgggcgtggtggcggggcgcctgtagttccagctacttgggaggctgaggtaggagaatgacgtgaacccacaaggcggagcttgcagtgagccaagatcatgccactgcactccagccttggtgacagagtgagactccgtctcaaaaaaaaaaaaaaattgcagagttgtatttattatataatagaaattttttttaaaaaactttaaatccatgaaggaaacaggtaatgcattagtatatatgaaggtaatactttaacagataatgcttgtttcttacgaatgtattctgaattggaggaatgcaggattacttgcatgacatataccacacagttcatgaagcattttgcatctaaggaaatagtttgcctaagtagtagaattaggaacagtgggtttggtggtaatgttgtggtattccagcctaaatgactaagcaaagaatatggagcccaaaatatgtgtcattcagcctgagaatattgcaattttccttagtcaagtatgcttgcttatactagcattcctacatgtatgtaatgctttaaaaatgaacagaggttcattaggaaggggaagggcacctacaataatactgtcagaaccaatgccagaaaggattgaaggaagagaccactgactacccaaattattaaaactgaacaggatttaagaggttataaatacattttataaagtcttccttgaactttactagcctttatagtaaggtttctgatgatgtcttacacacatccatgtatctctagtgctagggtaaatgtttgccaaacaatccagttactgaattctttctatcattaccatgaaacatattatttacgatcattaaatcttggagcaattaacattaagttgattataatactatcttagactcctaatccatctttactactgtgtaattttagctttcaataagagttttagttaaataatttttttataatttaatgattttttagtaaatttatagagttgtgcaaccatcaccacaatttggtttttagaacatttccatctccttgtacttacttgtagctaatctctgctccactgccagctataaacaaccactggtctgttttctgtctctataatttgcctattatatttcacataaattgaaccatacagcatatagtcttgtgcaactgtttttttccacttaacattatgtatttgagttgcatccgtattgaagcaagtgtccatagtttgattggtgaataatactccattgggtagatacatcacattttggttctccctgtaccagctgatgggtgtttggactgtttccagcctttcacctttataaacagagctgctaggaacattcaaatatgggtctttctgtggacatttgttttcatttttcttgggtagcttcctaggggtggaatgacaaggtcatatagtaagtttattttttattttaaaagaaactactgagctttcccaaagtggctgtaccattttacagtctcaccagcggtgtataaggattccagtttctccacatcctcagtcacatgtattgccatcctagtggtatctcatgatgattttaattctcatttttctaatggctaatggtattgaacatgttttcatgtgcttattataatttgtagatctctttgatgaagtgtctattcaaatccttgttttttttcatggattgtttccttattactcagtttttagcattatttatatattctggatacaagttctttatcagatacacaatttgcagatattttctcctagtctgtgacttgccttcattttctttctctctttctcactctctctcttttttttttcccagacagggtctcgctctgtcacccaggttggagcgcagtggtgcaatcttggctaactgcaacctccacctccgggttcaagtgattctcgtgactcagcctccctagtagctgggattacaggtgcctgccaccatgcctggctaatatttgtgtttttagtagagacagggtttcactgtgttggccagactggtctcaaactcctgaccacaggggattcatccgcctcagcctcccaaagtgctggcattacaagtgtgagctaccatgcccagccttgtcttcattttcttttgaaggataaaagcatttaattttggtgaattcctgtctatcaagttttttttaatggattgtgttcagttaaataactaaaactttttttcttataggcaatacatttacatattttaaaaatcaaagcatatataaaggaatttagtaaaaagtctctttcctaactacctgttcaccaaactctaacctggttcccctttctagagacaaccagtgttgccattttcctgtatatctttagagatagttaagtaaactttttatttttgaactcaggctacagaaattttgccttagtaactcataacttctgagaaattcccagaaattcaagaataagcttacttttttagttcattttctctgttataagggtgtttgtttttgatctatttaatatctatttttgtttttgaggattttggaatatagatgagttattttcatttgaagtgtaatgaagaggttaatcgtttttattgctgatagagataaaccccataaacctcttacctgtccgtggcagcactggctttcagttactcatttctctgtattgtgtttttttccctttttgagtactttgtagtagtactttaaagaacattaaaaactagatgctgtgttagtctgtttgtgttgctataaagaaacacctgaggttgggtaatttataaagaaaaaaggtttatttaactcacagctctactgcctggagattgggcatctcatgagaccctcaggctgcttctgctcatggtggaagctgaagggaagttggtgtgtgcggtggtcacatggtgagagaggaagccagagagagcagggtggtgccaggctttttataataaccagctcttgtgggaactaaaacagtgagaactcactcctccacacccagggagggcatgaatctattcatgagggatccacccccgccccccccaccccaacccaaatacctcccattaggccccatttccaactttggtgataaaatttcaacacgaggtttggcggggacaagcaaccacactataacaaatgattttatcaattaggagtaaatgaaatttaagccagagtttaatatttgaataactaccttttttgaaaacaaaaggcagggtctcactgtgttgcccaggctggtcttacatttctcactcaagtgatactcccactttagcttcacaaagtactgagattataggcatgagctactgcacccagcctcaaatgactaccttattgcacttttcctagatttttttcgacaatctactttttaaaatatgttgttttaaacttccttttttataacatccttgactatagaatgagaacactgcaatgaaacccaaaactttggaagtaatgtgttctgtaatgatctgtcccctaacagcagcacaattgtcacagacacaaaatgatccatatttgctagtcccaagtttatataagtggggggtctcccttgatacatttgtgttttatctgtaaaaactaaagttaacagttgctttttaatccaggaaagagggcttacttgaaattttatattgtttattttgttaatggattcatttgttcaattcatttttatttcatggttgccaatttctagtttgtgggtgtggttaaggagtgcctagagtgggaagaaattagttgggtgttaatactgtattttacttctttaaagaattgtataactgtagaactttcaatctacttttttttttttttgagactgattctcactctgttgctcaggctggagtgcagtgatgccatctcagctcactgcaacccctgcctcccaggttcaagcaatcttgtgcttcggtcacgcaagtagctgggattacaggcatgtgccaccatgcctggctaatttttgtatatttggtagagacggggtttcaccatgttggccaggctggtcttgaactcctggcctcaagtgattcacccaccttggcctcccaaagttcactctcttaatttttgcatgattgtgccaaacgtctcttaaccacttaattgcagaaataggtttagaacacaggtctccatctcctggtggtcttttggtttttccactttactatgctgccatttgtttttgttttctttctttttaactttttggtttagtttaaaataacattctgaaatacttgctttttccttactctttattttactttcacaaatcttagtcttcaatttgtgtttagtatctaatctgcctacatgctcttctctcttaataatatttctgatatgatcttaggaacctgagtgtctactgtttttattttgtttgttttgttattttagtgttcctatatataatcctgaccactcttgttgaattttttaaatggtgattatgaacatcagacacgtaaatgaaaagcattcaagtgctttgaactgacactctcagaatacacctttattctgctcttatacccaggttacaagacaagattaacgtgaccctacacaagaaaggcacacaaatttgtgaagctgttcttttaaaagagattctttgttctgttaaatttctaggctgctctacgtgtacatccttttctaggggatacacagtgtgacttcccttgtggtttttttttttttttttttttttagaggggagcagtgaggcagcgcagccacacaacctaatccacaaaccttccttttaggtgatttcaggtgctgtaggtgagtacatctgtgtgacagacttctccccatgcaaactgtcaaatgcttctcttgactgcagaacacacacttcattgaaatgacatagataatgcctattcttttcaggtatttttgatggtatctttcataccaggaggaagccacatctctaacacatctcagtatcttttctttagaaaaaaacttttatctttgcttcttctttttattacgtattaaaaaaaattgtcatttaaaaatctatgtagagtatccaaaacatcgagtcactgtttcagtaaaaaactgtttactgcctggttcagttcacctgtagtattgtcagatgtgtcaaacatgaagcattttgacacacctgcactcaacttaagttgaaagcgaaagactttaagattgggtgtgtatggataagaacttgctgtcatcacatgatgaaaagagaaagtacttcataaaagttatgtggcaccattgtcttctactccctacaagtgattcagtgatgaaagaattttgtctgatttcatcatatgaaagtcaaatgtactagtatttatgaatacgtgctttaggtcattgttcttgtggagtaactaatgatgagctgctgcttgtggagtaactaatgatgagctcttttgtgtgttcctttctttttttgtaaatggctaagggaattagtcaagttggaggtaacaggaaatgaccaaaggtgagctcaggtaaattgtttttgtcgtttcagctgtagttaaaatgactcagagatctaagcttctgtgccagacctgagtgaaatatttttttctttgtacattaaaaataacacatcaagaacatttatttttaccttggagaatacaaaacacctataagctttacccaattatacttcatttcccagtcttctaatgtaatgtataacaacgtggtaagctaggcgggtggatcacctgaggtcaggagttagagaccagcctgaccaacatggtgaaaccccgtctctactaaaagtacaaaattagctaggcgtggtggtgcatgcctgtaatcccagctactcgggaggctgaggcaggagaattggttgaacccaggagccagaggttgcagtgacctggaatgcgccattgcagtctagcctgggcaccaagagtgaaactccatctcaaaaaaaaaagaaaaagaaaaagaaaagaaaaaatggtatattcacatttttttctcctttgctgtatatgattagattatgttaataaagtgaattagttgacaagataaatttttttcagacataaagcagttagaaaaagaaacatataaatctcatgctgaccgtataaagcagatacttttaagtatttggacaaaattgaagctggttagtatctcgtgatttgagataatatttgagcaataatcacatttgtcagtgtgatggcactgcccccggaagaataggcactcagtttgcaaactcatgccacaggaataaaaaaaactccaatccccaaacctcatcagattgcgggttttacaatttcagtaattctttagatattcatttagaatttgaattagaaggaactagtatctctgtaccttcacgctatttgatttgggcaataataatgctgattattttcattctccactactggaaatgatgacattactggactgacagaagatgcttctggtttctccttctgaattattgttatcttaatctcaagaagttaaatgaattaacctgactgttcccaaaatgagaaacacacacttgcacaactatttcatctttagcactagaaaacaaaattctcttaccaaaataatagtatatgcagacagttaaaaacaagttatcttttcattgaaacaggtactatggggcttcattctgaccatatgtaaacagtacaattattgtctatattttaaataaagcaagtaagttgagctattctgtagttcatacttgacaaatattaatggaccctattacacccaactagaattactgggtcattttatgaaagcagataaaataatattgttttcaaagtttatttatgtatttattaatgaacaaggtttaatttttaacttttaccacatttttatcttattgtcaggaagcttttaatcagttttaaaatggccttacaatcacttaatttaatacactttgctttttataattacaactgatcatatgggattttttatattatttaaattttagtttatgtcctccttactaagaaatacagagattataagcaaaagtcaatgaaagaattaatatggacatgtttttaaattgtttaaaatgttaagagtcaaagctctgaaaatataataaagatataaaatgtatacatggaaagagatatgtggtatatctggtatttggtatatactatgatattgcatgttcattaagacctgtactgctaagtgagtatgcatccggaagaagttaatgtaagtatttttaaatgggtttgtatttttctgataaacagcactctccttctgtttgtgatcataggataaaagccctgtaagcttgtatatgttcatttttactgctacatcatgtagtgtgctcttaagattgagatctcattccccaggaagcatttctgtccaagattaattgcccttttaaaatcagcgtttgatgtatttctttggctatatcctggcttggtttaaccctctttgacctgacctcgctgactattacctccgtggctgagacaaaatccttcagcatgatgtatgcacttcacatttcagcctgtggtttttcatgtcgatggattcaattagttggtgttttactaatgaacatatcagaggttaaagaatttgtcagacagaacaaaattgttcaggctagtggtaatcagaaagctcgtcgctctattttttaaaacttctaggcagtattaagtatttttcagaaattttaccttcagtattacacattccaagatagcaaatcaagtcattttctgctgaattataaaatataaatatgaagctacaaagctgaacacaatggttatatcatttgatcttagacttctactccatatttaaagtatgagcttttaaaaaattaattaaactgaaattttcttgttaaaaacatgtatgaatttcccttaaagatacatcatccatttctttaagcctcctttaaatattaatagtaagaaggaaactcaagcatctcactagaatctcaagtcacctgtttttaaagacatttatagatcatattccttgttgaaattggcttagttgaataagacctaaaacccagattgggatgagaaaggtaattagtagccattagtaatagaaatctttagaactcaaatttatcacacagtgcaagttctcaaatgatatacttaaaatgtataacataaagattttgaaaggttttttttttttacctgaatgttttcatcttttttaaaaaaaataaccttacctaaagtctattaaatgatatatctgtagtacactagggctcatttgacttataggtgatgtgctccacttgaatatatgtgttgagagcactattaaataaacgtgaaggtttctaatacttaagaatttttcttaatgtcatttaatttgcataatcatcgagtctgggtttttgttgtcttttaaaaaatacatttattaaaattatatgccatactgcataaaaatggaactgaataattcaggaggtattaccatgaggccaaattcttacagccctttgtatgccaatcacataattgaatccatggtttttatatatcttttgatatatctagtactaaaaaaatgaacttattcttataacgtgtgtaggaagagaattacaatcgctctttactttttgttactaaatcatgacctttttaaaatgatcttctgtcctcacatactttatcagttacatttttgacaccattattttttattagagagtgagcaggagagaggggtggagaagagtcactcgtgttattgagtaccctgtgtccaagtcctgtgctagggtcgctgctgagtactttgcttggatatcccatttaatccttcatgtaactggagattagaattctttgttcacactgtaagatgaggaaacagaagtttgagtgaattgcttgagaattcaaaactaataaattatgatggtttacactctgaaagaaatattttgctgtttagacgtaaaagacccagatactggaactgggagacgtgttagtgatcctctactctggaccagtttgcaaactgacccacagagttaaatgagaagctatcatgggttataaatcagcaagcagaacttaggagatggtctcaatcccacattagcaaaagctgccatatctttacctgtgttgtatattgggtttctacataaaattttgtttgtagaaaaattctacactggtatgatcataagattcattctagggaacatttttaaaaaaagactttaccccagaaattgattcagaaagtctggagaggagctcagctcatatatatgtatatattcttttaatttcccacatgattctaatggtcagctagattttcaaaccatacatctatataggcatcttcattttatatataaagaaacagcttcaaagtgacgtgagacctgctcagagccctttgttgccagaactggaattcaagttgcctaacccccaatttgtctttcattagtaccttgctaactagtggtgcataattggccctctctcctttatgtctcatttatattattgtatattgataacagtcattgtatctatgtctatatgtaagcatcattttttaatatatacataagaagttaccattattttaactttgtgatttccattaatgacttgtgtggttaatgtgatttttattttttcttcttattttttttctatatgtaattcttaccattctaatcatataaccaaaatctacttgaatatgtttttcttaaaacgtaactttttttttatgttcacttttaagtagatgctggtttctaaaagtgctttgtggacattatacaaaataatgagatgtactcttcaaaattgtaaaggttaagaaatgtagaaaaggctaaaaaacggttgcagattaaaagagagtagagagacataaaaattaaatgcaatatgtgcatccttgacatgacctgaatgtatcccccagaattcacatgttagaagcttaatccccaatgcagcagtgttgggaggtgaggctttttggggggtgtttaagtcatgagggctctgccctcatgaatgggttaatgctggtatgaaaaggatttgcaagagtgggttcactgtctctcacacttccacgttcttccatatgagaacacagcaagaagctcataccaggtgccagcactttgatcttggattttccagcctccagaactgtgagaaataaatgtttgtcctttataaattatccaattatagcatcacagacagactaagacagtcctggactgaatcctagattgaagaaaaatacattattgggatagttgataaatttgaatatggactacaatgaatattttattattttatatatcatggtatatcagtattttttattgtgataactatactgtagttatgtaaaagaatatcttatattagaaatggtacactgtaagtttgaaatcataacaaaaattactctctaaaaagtgccctatataaagaagttcatatagaactagttcacttgatttttctcatatgtttgcctaacttaaagcttcaagctagctttttttaaaaacctgagtgggagaggcatacagtaacatttttctcctgagtcattttctttgtagtgacatttctcattctaagtattaaggtctagattcccattttgaaacaaaaagacatgtttaccaaaaatattgtttactttaacagtatcaggtgtttcctttgtactgtaagaaaaagacatctactgattttttttttttttttactgttttattattaattttttgtttttacacagggtctcacttgttacccatgctgtagtgcagtggtgccatcacggctcactgtagccttgacctcctgggctcaggcaatcctcccacctcagcctcccaagtagctggaactacaggcatgcaccaccacgcccagctaaagctaatctttgtttggttgagtttttttattttttgtagagatggggtctgttgcccaggctggtctcaaattcctgggctcaagcgatcctcccaccttgacctcccaaagtgctgggattacagacatgagccaccacacctggcctgttttcttttattggttttgatattgctaaaatgtccttcatactttgttgttatttatggtaccatgaattaaggatagcatatacatttggcttatctggaaacattttttactttgttgttttaataaccaaaacagtctttacgggtagagttattctccatggtagggctagctatcagaaagcattccaaaaacattaattttgacagtataattctaccagcaacaatattatgccagctatgagaatatttattatctaattactgtatatgtcaggtaccatgctaggcactggggacagagtaacaaataagagagaaacttcggtttgaagtttctgctgccctattctaagaatccctctgtttaaaattgtgttattgaggcaagtcagaaaataaacaaaatacataaatgccggtgagatatttggacatatgtaggcagtgacaaaataatatatttaaaaccttaaactgttctgttgagggatatgacagtcttagattctttccttagttacttaaatttagttagtgatgcttttatgttaaaaattaaaagtggccccagcttctaaaccagagaatcagtgctacttattcagggtttgggtaaggggatttattaggcttgttacacagtgtttgaatagtgcttttgtcctccagcttctgttgtacaactcataaactccagcaatccttttgtaacatggttggtcttttgcctttcagatacactgtgcatcatcagtggattgtttaccatattgtatttgctcccatgtttaaatattgctttagatacagtactttggatattgagttgtgacttgtttcttctgctgtttcatagtatacaaaggtgactggcttaaggaaaaactttagagataaggaacttttactcttacaccactattctttcattttttgactcagtgctaagtaggaggaagattctgagaatattaaaatatttcaaagaaatataagaatatgaagagaattataccggaaatgttttcaaatattctaagaaagatttaatacagtaaagctttagcaaactggaacttataagcaatgaatcattccagatagctgagggtttctccatttcaataccaatgtttaaaaaatcttcccaaagtactggtactatgctttctatagtattctgtatatagcttaatatttcattatgaaaacaaatcattatattaacactatggtcacaactgtgtcaaattatgtataggtgcaacaaagaaaaaataaagcatttttttaggttagtagtattataaagtgataccttttttcaaaattgttttaagctatggcacagtgatttgggagtttggaatgttttatttggttatctttggaattgttagtatgttaaagtttttatttttcacattcttttatcaactgtagtattttgtgtcctctgttgactgtcacctgggactgtgctgcctctaacaggaagtctaaatatttctttaaaagggtctcttgtttcaggtgccagccaagtcattatcaccatacatcatcagctcattttgcccagaccttagagcacttacagattcaaaagtcattttgaacagagcagaaaggaaaacgtagggtatttctcctttatagagttgcttgattccctgtttccttgttgtcttctgtcaccaggaagctgagaggtttagacattgtattttgaagagaaggtaaaggagacaaacccagaattgtgctaaaggaataacacaaagtttcttgatggttctattttttttttctttttcattagaggagtttggctttgctttctttgtttttctatgacaaaaatctttatatttactttaaaagttgtcagtacaacacaccaaaatcatgaaaaacacaaaatcttaagtttaatttggaatacaattgaatttaaaagaaaggtgtaaatttcagcccccttttaattagcaagtggatgttaacaaaaatcagtcaggctttatgactctaaaacaggaatccctgagtcagatttgtaatcccttctcattaaaattttaactgttattcaaatagtatctctaagacattttgatacatacttgaatgctttactgaaaacaactaaagctcacctgtgtcttactaaacatctcaaatactgatctgattcttgatttctagtcacatttctattttacattttcaaaatatgtatggaccgacttcatgtacttgtcatttttaataaccatatattacagtttttaatgtataactaaaataaattttggtcattggtacaatgggctgtttttgccactacagtttcattaacgtcaatcttaagtaagcacagtaattaagaaagaagtaatactttcacatacagcaacagaatttttatcagaatatattgtaaccctcaggtttctgttttgggtgatacatactgcaacatttgaactttctccatgtccacatttcctgttcaggggacaaaacatgtttaaaatccatttaatgcactaaggattctcaaaaggcaccagattattttttcttcaactgttttgacttttattgttgttgggtttctttcttggaatagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaatgttgtgtccgtctttatttaaaacaagttacctgttgataaaatcattaaaatttccttagtcacaaactgtcataaaagtttcttggagaaataggatggagggatatagaagagaatataaaagaaaattggagaagacccccaatatgcctatttgactaatagtaaatagtgacctcctaggaaaatacaaatacatttttaaatattggcattgttaactaggaacgagtaaattcagattaaagtaagtcattgtcctttataatgttgattttcattcggatgacctaaattatgaccatggaattcaactctaattgccattttaataaaggcagaaaaaaatagcaatatttgagttatgtaaggataaaaaaatccactgacttatatttttgcacaagaggctggtctgaatatgattgttcacattaagagtgtttattcttcgtttcagtttggggagttgaactgataagcaccaggattttcttacagatttagggacccgaagtaacttgtttatagtttaagttgacttatcagtctttataggatgatgaggtataaaccgtattccaatctgagtgtgaggtgaattcgtttagtgtactagtcttgttacatttaacactggaaacaagctaggagttgatcattatctgagaaaacaatatataagctttgacattgtgtgacagtagtttttaatggttatctttctacagtattttttaataggctatttgaggtaaccttttcttcagtttttagaaatttggtttatgtgggtcatgccagagaatgacagtctcacttttatttatcatactattgatatttaggtctgaggtaagttgggtttcctgttacatgtgccagcatggttgaaatacaaatgtaaaaccttggggtatgataggaaaatcaagtgtgaccatatttaggaatatttgaacctattcattgtcgatcaatggatggagtccatcaaaatacctacttgcctgagttctgtcatcctcttgtttcctaaatatatttatctcctggtctgaaaatattaaaaattacagtgatggtagagaggaaagaagagaggcatgcctcttttcagatcatttgagattaagcgaaaacttggacattataaaaatttatttactatgtagctttatttgacaaaagcatctttcacattatcaatcatgaattataaatttgattcttcatgcttacgagcagatatagtactactgtaaaatctagtaggaacaatatagtaaccatggagtgaaagactcaatttttaggtcctttaggtagctctttaagtacttaggtttttaagtgcaaaatcatttttattaactatgttactgtattagaatgatatatagtgagataaagacaaatttgaagattgagggatgtcagtacgctttgacgtataagttgactcctatgaaagtgattagtttggctttccctctgtagctttctcacctccacatctcaaggataaataaagtacaaccaggcgttttccattttttcccccagttctcagtggagtatatagcacacagttggtgtttagcaagtgtggaaaaaaggattacttaataactttataatgagtgttatatttttctggtaagaataccagctataaaaatagaaccttgtcatttagaaatcagtatacaaagtgcacttggttcggcctggcattagtgatgaagacttgcttactcaaatcgactactttcggtaggaaccactgtggaccagatccttgcgtcagtccacattcattttagttgcagtgtagaccgcagcacatatcttgtgtttcaacatcactctaatttaagcagcccctaaagctggagctattctcaccaagcatctggaggtatttgttaattctgaccttttcataaatgagtgatttgtgtcttgcttttgcttagaactttacttctgaaaataagagctatttaattcaacatttcccaaacttccttgaccatagaatttttttttctttcctagtatcacagcttcctattgaactctagcatgggaaatactacattaaatcattagctcataatgacctagagtttatagcataaatcttacttttccctttctgacaactctttagctatttgaaagaagctctcaagcgtctgactcatctccaaacaaaatagctctagtctgttcattccttcctccaaatatctcccattttgtcagtgtcattcttgaaattcatctgccaagtatatactgtgtactgagtaatacatgccaagtcatgtgctgtcctcaggggatggagtagtttaggttttcataatgccaatattggatgcatagtctggctgctccgtagtgccataatctgacagatcacatccagggtgagatttagtgaaagggctgggaattaaccataagttctgtttatgaaacatccatccaaatataaaaactcaggcaaattgtcaatggattggagaaaacctcaattcataggtatgagtaagtaggaattcaaggggaatatttgctctcagggagttgccataaaactagccaagagagccatggagctgaaatatggtattctgttatcagtcaccaagatccccagatagaatgcggctgaggtcaagcagagagggactggcctcacaaatgggtggttttctgtggtactggcacatacagcaggtatttctgatctctagctgtacttgtttgggacttgatgactttgtctttttgtgttgcctagtgcatattttccaagtaaggtacgctgtagaaagctcacatctgtaaggtgggttttgatactcttgttactcaaaactgttagtttttagctttcttttacaaagacagtcactcattgacctagaaactgtctgaccccaacgattttgtaaaagccaagagaaatttgttatctcctgactaccagtcttttttctgcatatgccatctcaaccatgtcttcctgaagagtttggtcatgctcactacctgtatttccatggctccttttgtcattgttttgaaattcattataatgtaatatgaaatgtcaacttaccctgatgtttcttgtactgtatcgatgctgatattcagtgaagtatgacagagcaagttattgatgacatctgaaggtatcaccaggtcttggagccaactttaaaaagtgagggagcaattaagtaaaaactaagtaatttttgtttcttatttattttttttttgagactgagtgtcacactgtcgcccaggctggagtgcagttgcgcaatcttgactcactgcaatctctacctccctggttcaagcgattctcctgcctcagcctccctagtagctgggattacaggcaccccctacatccagctaattattttattttatttttagtagaggcaagttttcaccatgttggccaggctggtctcgaactcctgaccttgtaatctgcctgcctcagcctcccaaagtgctgggattacaggcatgagccacggcacccggccaaaactaagtaatttgtggactggatagtgcatgcgatattggagcaaaaaaatagaaatgcctgatgggttgcgattgtcagtaatccaactcagatatacggtggacatctttaattctgggcagaacatttagaacatctcaataaaaccagctctaactgctaattctatgataggcatattgtcctagattttatagaattccacgattcatctgtttattcaaacatttgttgagcaaatagagtagtggaagttctaggaagaacaagacatggtctgttgatcttaagggaccttctcttcttactagagaagacaaaaataactgtacaacataatacttggaaattgcaatgagaaaggcgcaaataaagcactatgaggaaatagagccgagagacctgtttactttgagttacctttgataccttgcttggcctctcagcagcatttgacatttgatcacaccttgtttcactcttgaaacactttcttcactgggcaccacacccttctggttttcctcctaactcagcacctttctcagtttccttcgattcttctctactttgactcctaatgttgaaatatctcagggctcagcctttggttccgtttctgcagctacactcagtatatgagcacatcccatggcttttaacaccatccctgtgttaactccagtatttacctctctcctgagctccaaacttaatacccaaccacctacttgtcatccatctcagatagtaatagttcaccttttttgagtgggggtagggggtcaaagtagaactcttgcttctcccccaaacctatacctctccctttctattccatctgaataaatgcgacctagtcattcggtcccaaaatgtaggagtcctaatttaatttcccttcttttctcacctataccatagccatcagtgagtcctgatgaacctgccttaaaatatactctgaacctatctactgaccaccttcactgctaccatgtaagtctaagcaaccaaccatcatctctcacctggactactacagtagcctcttatctggcctccctgcttcttttctgctccccttcagtcttctaagtataatgtgtttcttcaaacaaatgacatcgtggctgttccttgatcaaaacatttcagcatctttccattccacccaaaatgtatctaagctccttaccaagttctgcttcatccggtctctgcatctgacatctgtcacgctgccttggctacttcagtgtatctacacttgcccatcttatgccttgaatatgtcaagaacattctccctccagggactctgcacctgatgtcatctctacctggaattttgtttgcctgacttgcctcctccatctgtgtatctgcttatatgtcaccctttcttataggcctttcctgaccacctgatctaaaattataccccaagcccacttccagacccacctcactcttatcactttatatttcttcatcacattatatctcctcttcatagtatatctcactctgaaattatgtatttgtttgtggctttatagttaacagttatggaatgtttacagtgtcccacacactgttctaggtgcttttcgaatattaactcatttaattgcagagctatatgagatcatcactagtattgtccccacagggaaactgagatacaggacaaggaactttctcagcatcatgatagagttggattgaagcccagcagaatgggtccagagaccacactcttacccacttcctgaattgccttgccttatttttgatctcacaacagacaataagtttgagggcaaggacaacttctctttatccccacacttctggcatatcacagggggttattaagtatttattgaatgaatacgttttgataacattcgagtaggttaggaaaagcttcattgaagaagtggcttttgagttagaacttgaggaaagggtaaaattggagaaagcgggaagaaaagtgtgtgatgacaagctaggtggaaccacaggaacaaaaactcagagggatggttgtacaattgggctgcacctaagtcacttgtaggagacagggcaagataaaacaggaaaggtatattctgacaagattatgaaaagccttgagtatcaggccagggagatgagattttatttgaggtgcaataagagccactgaatatttttagtagttagatcatgtgctcacagctaccttttaagatgctgactctggtggcagtgtgcagggaggtttagagttaagtctgttctaaacctgggagaacaatgacaaagctactgttacttgctgagccagtggttttccagccttttttcagcaggaaagtgttcttcagtaaaaccttgctcaaatatccagtaggtcaaagaggagcttctctggttgaagcggggtggctggcccagaagctgacctgccagcaccctcttgcctgttatgccagccttttgggaacctgttcaggatctctgtgcccctcagacaacagattgaacagctcttgcctggccctgttgattataataaagtctgatgaccaaaagcaataatgtcaagagtggaaagggacatggaagagaaaatagaggaagaatcaactgaacaatatgggagacctggaaggaagaagtcagtggtgataaaaaatcttatgaaatgggagattagttacccacaaaagaatttagttgggaaaaacagatgatgtgtttagttttgaaccaggattaagtactcagacttgaggtgttaagacagacaggggttctcagtgttgcctgcccttcccgattacttgtggagctgttatcaaaactacacattctgtactccaccccctctcttgcagctggttgaatcagtttgggcaggcactaggtctcaagatttgtgtaacacttcactagtgattcttatatgcactactaaaatgttgttggcatagaatcatcagtgagcattgtaaatgtgcagctgcggctcctgagatcagggctggaaatcatcacccacctggaagggagggttggagccaagagtttggcatggaattgaatcagtcacacttgccaatggctttcacatctttccccctctccccatcctcgctgcagattcattcaagccactaacatctcttccctgttacagtggcctcagaactacagtccctatgcccctttaattcctttctccttctggcagccagaaagagcatttacaaattcaacttaggtccactttttctttcttttttttttttttagatggagtctcgctcttgccaggctggcgtgcagttgcacgatcttggctcactgcaagctccgcctcccaggttcaagcgattctcctgcctcagcttcacgagtagctgggactgtaggcaagcaccaccacgcccagctaatttttgtatttttagtagaaatgggatttcaccatgttgatcaggatggtcacgatctcttgaccttgtgatccgcccgcctcagccttccaaagtgctgggattacaggcgtgagccaccgcacccggccaaggtccactttttctctgctgtttgaaatctttagatggattccttttgccattagtatgaaatccaaaatccttaccatgataaaaagctttgcaagctctggatcctccccactagatgtttttttctccaattctcttcctcttcttcatgatccagcacaccacgcctctttcagagtgtcaaacacaatactgtccctcgttccaaactcttgcctctactgtttcctcccttgaatgtctctccacttccttttgcttactaatttctaatcattttttccctcaattcccctggactttccaactggccaactccttcctggtagggttgccacaacatagcagataaaaatacaagacacccaggtgaagttgaatttcagataaactagaagtaactttagtgtaagtatatcctgtgcaatatttggtacatattcgtactaaaaagaatttgttgtttttctgaaattcagcttcaactgagtattctgtattttctctggaaaccctacttcctgaactagatttggttagaactagatttgagctagatttgagctagaatgacctagctcccctagctcattcccatttgtattaattgccccatatctgtgttttgtggtatgctgtaagttctgtgaggacagggacttggtctgctgtgttttcaccaatgcttaacacagtgcaatggcatgtcacaagcctttattaaatgaatgaacacaatgagaggcttggagttccagtgaaaaggacagggctgaagattctgtctgggaagttttctgcctggaggtgacctttgaagtgggaggggtggcacataataaaagtatagagtagaaagagaagaggagcccttggactgacctgaggggactacctatgcttgggggacagaaagaggaagaagggcagatctttgagacaatcatgctaaagaaagaattcacaaactacaagaggatccagggaaatagtagaccaggtctttggatttggcagtttgggaccttcgagagaactgttctgagtctgatagctgtcaggttgctgatgactcttaagaaatttagtaatgggacaaaaaaaagataagactgtagcccagctgttaacatggtggagagaagggagacctgcctcattgtattggtgaaagggaagggatcagtggacagagagggtgattgtcctggggaaagggtcatggacagtctgggaagaagtagagaagatagattaagaaaagaggccgaggcaggtggatcacttgaggtcaagagttcgagaccagcctggccaacatggcaaaaccctgtctctactaaaaatacaaaagttagctgggtgtggtggcaggcgcctgtaatcctagcaacttgggaggctgaggcaggagaatcacttgaacctgggagacagaggttgtagtaagccaagatcacgccactccactccagcctgggcgataagagtgaaactccatctcaaaaaacaaaaagaaagaaaaaaaagaggaagaatgtttcacaagtaagaaggaggatgtaaacgattattacagtcattcttgataagttggtgtccaaaaaatcacaccgttcttattactaaagattatatacaaggttcactaagaatataacctgaatttgaacatagtaaaggtttcttagcccggagattctcgaacttttttttgagagagagtcttgctctgtcgccaggctggagtgcagtggcgtgatctcagctcactgcagtcatccatgatctcagctctcagctcactgcaatctccgcctcccaggttcaagcaattctcctgcctcagcctcctgagtagctgggattaacaggcatgtgtcaccacacccagctaattttttttgtatttttagtagagacagggcttcaccatgttggccaggctggtctcgatctcctgacctcgtgatccacccgcctccgcctccgaaagtgctgggattacaggtgtgagccaccgcgcccagcctgagattctcaagccttaacagacattggaattagcacttgcaagattttgattaattaggtgggtcagggcctaaaatcatttcctacaaacacccaagctgcgggtcttagatttttttcattcttacatccattaaactttttttttcccctcctttttaaattggcaactgaatataaatgttttacatttggcttaaccttgtagtgaaatccgtaagaaaaattgaacatcttttctcctgaagttagatgaaatgtgatcaaaatacatctcacaaatgcattctagttttaaataacaaaacacttatgtgagccaggtgcagtggtgcatgccagcagtcccagatactctgggggccgaggtgggaggatcccttaagcccaggagttcgaggtgagcctgggcaacatagcaagaccctgtctctaaaaagttaaaattaaaaatgcttaatgtttatctcaagcattcattccctcaatactaagcaagaaggagttttctttggcatttgaaactgtattgtttttggaatgtgagaaaatagaaaattgcttaaatgcataatatgatattgatgaaatacttatctgtagttaattactaatcatttatttgagagatctatttttgttgataattacttatttgagagatctatgttgattcaaaaggaattttaaaaagaaatattttcttaaaatattttgtgggtgttagtatgattcattactaatggtttagagatgattttaaaatatttacattaaacaaagtaatgc

SEQ ID NO: 731 - DNA, 3233 bp, Homo sapiens
cgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaatgttg

SEQ ID NO: 732 - protein, 275 aa, Homo sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 733 - DNA, 31718 bp, Mus musculus
  misc_feature (1)...(31718): n = A,T,C or G
gccctggggcagcactcagccctggggataagggaggagagggcagggggagagggggcattggatggtttccacaaaggcgagagtccttggtcaggtctgtggctggagcacaggatggccttctggtgggaggttagacacggctccttaggagaaagcccatcccatcgttcaagcaaggagggtcttgatgatcagagacagtctatggttttagggctttattgtagaaaggcagggagaaacgagagatagtagaaagagagagagagacccgccatggccacgtggagagagggggaaaggtagagagaaaaggagggctagagaataagaaaggtgagggctaaagagagcgaggagggggccaagcagcccctcttatagtaggctgggctaccttactgttgccaggtaactgtggggaggagtatacctggctacagtcaggtagctgtgggggtggagtctagctagaatgccagaagcttgggacattgtcttcgtgactgagtcacagaattgtggacaggcacctgattctgggaatgtggcttgcctttctgtcccttgtagatttctctattgggtcactggagcaagccccattcgaccaaaataggctgactataacagtcccacaatgcttgttggaaagaatacactcttagttactgtcatgagctcagattccgatttctcgggacaatactgggaaatctcagaaaaaaatgctttccctttgacctcagtttgtccaccatctggaaaggtccttgaaaatcagccagaggaaaaaaatatttacgtaagtgctgtggtgtcctaagaataataccaaagagggaagactttgaatggaatgataatctacatcatattcttttaattattagttcgattttgaatgggctttgtgtcttttgtgtatcattttgtgggggtgtaagagataagataatctattattcttgcattaataattcacatgattaatatttggccagatctagtttccatgactaatcataatatttgtaacgaagggtatttccactaagctgtgtagtacagagacagccaacatattgatgggtatagtctttttgtattttggggttggtttggacctcatgggctccagtgatccccctgcttccaagcccccactagctggagctatgggcaacattaccacaattggctttgtaccatattacattgattagcatgtactaagacccttttccagtgtcagcaacaacattagctgtttgttgctttaaaatcgtctgaatacagatctgaccaggaaaatgtagtgttggttgccagagcaaactttaaggacttctctatgttccctatgaatgtgaaaacaacaaaggtcattgtgtcaagtggtttgccattaatttatcaagaatgcacatttcagatatgaatgaagagtttgccatatgctggtccctggtggtgatcagcacaggttatttgagagctttgtttttgagatgaggcctctgtgtgttacttaggtgcctaacctttgaactgttcatttcaagggatgttcttactgggtcactgactacagacaactgctggtgctcccagcctgaggtgaaggctcctttaaggcatgaagcctcaggaagtaaattggatcactctgtataaaaaatagtaataataataatgaaaagcatgggtagccagttcagtaggtaagagcttttgttgtataaacaaagcatctgagttgaaaccccaggcttgtacataaaaagccatggtgtggtcaccttgttctgtctgagagtggagacaggagaattattggggcttactggctgtcagcctagctccaggttcaatgagataacttgcctcaaaaatatcagatagggagtgataggccaggacatggatgtgattttcttgcatcagtgcatgcactatgtgcacatggcccctgcctcaccccaagcacataccccttatacactttgaaatagaataaattgtatttggtgcaagtttttaaaactgccaaactctttacacaactaagagttcatatgaatattgacataactaagtacaactcctttggccaatgatgtcttttctaattacaacactcaccacaaaggcattagctaacgctccttttaaattggagaaataaattgctgttacaaagtcaatgggagtgcttttcaatgatgctgttcaaactgaggggcgggggaagtccagaacattactcctaaaaccaaaactaaaactccagtaagacaaactaacatgggagatttttaccagtcttgcctctttccttagaaatgtttgttcagctggggaaaacagacaggtgcatactcagacagcagagccaacccatgcaggtaaggagcttagtgtgataatttttaaccctggacagtccctatttatctgtgatgaaccctgagcaaagggccagaaagtctgtgagttctggctgaggccattgaaaaacatgctgagaatttacatagttacggtggtcaccaggacaggctgaagatttcttagctaaaattcttggctcaagaagggttgtggtttatttttttttcttggtattgaaacattttcagtatgtattgtgttatcttggcaataccttgaggtctgaatatgaaattaatttttgtttcacatccatcccatgcacatagctgatggtaatagtatgtggtgctttaaataattttgtaaagcaagaaatgttttggagttaggatgtgttgtctccaaggaggagtgcttagcctttgatgctagatgaataccatccagtgtcttttggtgagcatgggtatgcatggctattgagtaccctagtgttgaactgctggtgaggaccaatgttaatgcttccaagaaagaattacaaaaatatgcaagtatcattccacattctgaagggaagggcaagctggggtctccataattatgtgacattagcatgtatttgaatcactatcaccatgagctaaattatgtcccttgatattgatattttgaagtccaaatccttggtacctcaagaagggattgcatttggagtttgtctttgtgaaaatgattaagttaaaaaaaaaaaagataggatagtggtgtctcatccagcatacttagtgacttagatcctatagtgctcctgagtcagcatggctcctgatagtacccatcgccagcacatcctccttgatgatctgaatcctcctctttcccctttctccttcctctggttttcagaagtcccaccctattctctattctgcctgggaattgggtgattagcatttagtgacaaggcagagaattaatggtaagaattgtttacacaaacatgagacaggacattcttggtataagcattatgatgccatgtccagattgaaataagatatgagggcagagaaatcagcatttgaataacacaagggtaaaatttacacagtgtataaaaacattatgccttataggaactaacttctgagcaaaccagcagcatcttggtgagcattatggtgagttctcttctccatcaaaaggtaacacaattcatggacattctgatttctccttttcttgtctttgtttcaaccttatacaatcaacttgtagcagcttgaatggcctaatgactttgtttattgtgtgttttttaatagttgtatcaggcattagacccttgtgacataataaaggctcaaatggttgaagtttgagactaagaacatttacagcaccctagaagggctctgacctcatctgtataccctagctgtgagaacagttcttgggagctttctagaatgtaactctgtgtatccctatgtacagcaaaaatgtgtttatttgttctctcaatttggtcagtgtcacaactagagtggtctggctaggtctcctggtttgttgtgttcttattttttctgaacttaaataacttcttttgggaaggttcataaatttgaaaataataaataaaatttaaattaaaaaattcccattagtgcttactttcattaatcaatgtttttcattttgaattataatttgcagttttctggttcttttggtaaaatcagtgggtatccttaagacatggaaatggctgtgtgcttattctctaagccccagtccatttagggaaaggttttttagtaactagaaaagggtgtactgtctgttagaacagctctgggtgaaatgtcttaggaaaagaaaagcaaaatctttctacagattcaattccacaaggcttttttgtgctccatactctcccatatgaccattcttccctaagactggatgacatgttgagtatttcagcctgttacatggtttagaagtgttgctggattgtgtgatttgtgttctcatcatcatgtgtttatggtttatcagatttcagtagcagttataatagcaatctatgttttataatactattaggttaaaaactgaatgtagaggggcagtgagacagctcataaagtttgatcttggaccatggtagaaccttaagaacctgaagcaggagcgtcatatgttaaagccaacttaggcttcaaggtgacaccctatctcaaaccaagaaggtattggtcaggaaagctgttacccaagtggccaaagccaagaagttatagacaaatgtttctgattcctggtctcctgacagtaactggatgagttttattcttggtttccacttgtattccttttatggcatttgttcagacaaaggcctattataccctaaggctatagtgttagaagcaagtagatactgtttccagactgttggacaaagataccctaaagggacatttgtacttcatttgactaaaaactatttaaacagtgttccccagtgaatttccatttatctaggaacatcatgctgatggatgtaaaatcccagagccttccagagaaaaattgtgttccagagagagatttctggtttctctgaccaccatgcaggacagaatggagtcaaacagcaatgggacaatgataggtaggatcacatctcgactgcttagctctatcaactcaagtcttttgttttctgtaatctcatatcatgaattccacttatggacctcagagcacactgtataattagtacctctcccctatgtggcctcattgactaaacctcctttgtcttgtgttactatgaatttacctctttaaatttgcttttaaagaacaactggccaagccaggcttgttagggctgccagaacacaggctctaaccctaacagtttattgatatgattattgttttcttttgtgtgtttgtgatagagttccactttatagtccaggctgtctggtacttcatatgtagaccaggctacttttgaatacacagagatatgcttgtctctatcctttgattctagcatggcaaatgtgtatcactgcatgtggtaggattttctctgtccaattacgttaaaatattagtgcagcaggagacctgtgattggacagagaaagagagagactaaaagtagggcgaggagaagccaagatggaaacagacagacaggaagaagatcctgatcccgtgtgattttaatagccataggtaactatgaatatcataagggatagaatagttggggtaacttggttgatgtaggtgggcagcttgtatcattatcaattggctctgaaatcattgtgtgggtatcttgtgaattgaaaatttatatataaataaatatgacttgttaattataagattctagattgttgtttctagaagggttgctggatgtggtggctgaccttgcggtgggcagtcattgcatggggctggcatcacagtgaagagaacttgggagctctggccccaaccagagagctggtaggcagagagtagctggatggagcacgggaacttggctgttgtttttttaatatttcccacaacaaccagcacccaactgtgactgatttatttgttcaccatactttatgtctctgataatgactcttgctggggattcatagttcacagactgttgaactgttttcacagatcaaccacctcttgaagtttattaaactttcctgtattgtttcttacataccacttctttcaggtactctctttctacccaccaaaggtggagcacttcccagccggagctaccttcctgccactgtgtgatccacattctgattctgggacaggaggagatcagaagaggttggaggctgaaaaatgtaaggagtcatagacaaataagacatatttattcactgtggggaaaaaccaccaggctgataacttccagcagggacgcaggcccaggatgatctacacagtacacacacaggaacatgtgggcctagacagtccagtacacaaaccacaggaatgtagggatagagatctacaggcaatctggggaaggcagtctcagggtccagcctcccacctacaagaacaaaaagaaacctaggttaggacatgccactttttttaacagaattctaaaactttcacctctaaagtgagagcaacttcattggatccagtcaacccaaagaaagatttcacagcgaaccaatcaactctcagattattatgtctgattaaaggggcttaagtgagagctatggaggcatgaaaaggagttttctcaatagaggccacacaggttccaggaagaggcagaccagagctgtgactacggctaggaggaacttttcatgaatcacatctcacggaaatgacagtcacctgacgtatttttggaggttttagaatttaccacagagataaaaaggtaagcagagaacgcaattaagaaattggtgtcggggctggggagatggctcagtggttaagagcactgactgttctttcagaggtcatgagttcaattcctagcaaccacatggtggcttcttctcctatgccctcttctggtgtgtctttagacagctacagtgtacttattaaaataaatacataaatctaaaaaaaaaaaagaaattggtgtcatgcaattcatttgcaatatgatgatgacgaagatgaagatgatgatgcctcaagaaaaatgggaagtaatgtgagtaggcagtcttatagaaaggtttttaaaggttcagtgagcacatgagcttatgattgacatcattactcatcagggaaaactcaaaaccgtaaatgagtaaccttatcacaccgattggctaaaataagaaaagaaaaaacatgcacgggaagaaactgaaacttatagcctgttggtggggcatataatacacagaagacctcaaaagcattaggtaggtagttagttcttcagagtatgaaatgtagagttgtcataagacccagaaattccttgggctataccctaggtaacgccaagagagcatatatctatacacaaatttatacatagacattcatagtaaaattaataccagataaaagatagaaacaatctaacgctgactgattgaatacaaacttaatttagataatatctttaaccagacaaagaaacaaatgtctgacaaatattgtcttgagatactaaggaaagaacaaaatagttaagcagattcaggaaaggaatgaagtcctacattcccgggtctgattaagactcttgccagcccagttaacaggttctgtgacggttgctgacatgcacacaatactcattctctgcatggatatttcaatgaagaagagtaaaacagcaatcatgcttacagcctaagcatacagagtcattctccttttccagatgtgagcatgcaaattcctaggactcttagaagaaaacctatttatagtccaagagatgccttggcagccttctaacccatgctttatcgtgcctgactataattcctatgcaaggtacccataaagtcatatttatttaggaaacacaaggaagggaacttaggcatagggggttgctgttgtagctctctgggatagaagccccaagcagcaaaaatatggaaaattttgactccataaaattctccaagtgagagaagaatgagagtccatgccatcaagcaggaagtgcactgagaatgatcacaataacttacttaagggagacgaagtccatggagaagcgtattgctgtgggacctgtgctctgtagagtgggtgctgttttcaagggcaggtccatgtagtaatagactacatccagaaaaccaaattggggggtgagtgagtagataaaaggctagaacattctagccaagaataaaaaaataagttggttcattgttgaatgagatggagctggggtgaggaaggagaagcagaacagaaaggagatactgcgtaaatgaggaaaatacctaattaaaaaaaaaaaaagatacaaggacaaagaggaagatagcagtgggccagctgcttcagtgacgtgggatcagggggaaagtgaccccaagaacaaaagttaagacaggaggtggtcagactggctgttgatcaaaggagagaaaatacggtaacctaaagggacaggaggttggatctcctcctgctggtggaggacagagggtgaggaagcagatgttgcaggtaaggaagccaaaccttgcctcaagcaagatgatcaagaaagccaggagctaaaggtcctgcagctgctgtcacttcctgctgggtcaggggttagaggagagtggtgtgaggagattcttgtggaaaatggagctgagaggatgagcaccttggagaagccaaaaagcaacacagcaagcttcagggaagaagagattggagaaaagccatgagccacaaggagaacacgtgggaaagaaagctttctagattgagtataccacagggtttaaaattgaatggactctcaaggttagcaaaatgggtgactcatcctatagacagggtgagcctctcctgtgtctgagaagtcttcctaatgttctttcctgtttcccaccaaggcttcctatgttgaagttctacttatgcgtttggcctcgtatagtttcattctttgtcattttaaaagcttgtccttaaataactgaacaaagaaatactgaatctctattaactacaaaggagaatgaggttttctcagcaactttgtaagatgtagcatctgagagccaccaaagccacacatgaggctactgctgagtcactgcagccatgctcttcttgagagccctgcatgcttaggtgtgtctcattctctcttttcctacttttcttccctttctgtattactttttaaaaatatatttgtgtttgcttctcaataaatccaactccatctcatacgatctctttcagaaatttctttctctggcaaagtcaagaatggtggtttcacttgagttgagttttttttttttttttttttttttttttttaaaacatattccaatgcccacagctcacatcgtgtggcaagcctgtcgcctgtgccccggtcactgccaccttgaacacttaaggctgagcctcaaaaacatctgtttagcaaaagaccacacacatgattgcatactctgtttaaacaaagtgctcatgactggttaaaaaagccaaaaaatgggttagtgtttgccaagaaaggaggctgggtgtgtggaaatggatttaaacacggggcacccttcacatttaccacttgccaccccgcaggcccagagttttattaaaatccctgacattctcccttggtgcacagcgaaaactcctgctactttcactttctctaaggacccagttttttcccaacccccactcatcctcttcctgctgtggtcgccagagccagaagcagcctgtctccccgcccctgagcaggagcacaaaaccagaagtccctgccttgtacaggcagctctgaaagcctactgggagcatcaaggctgcaaacgctggattgagaagccgcaactgtggtaggtgcgggcatctggctcggggtggcgctgtgggacccgcagaggtcatgtttacaaggcataggctgagtccaggagggaaaacaagactgcttagttagggaaagagacagctgggaggtaatgtctgatgagctttttaaatggtgactcctttaggatctccagctggccaatggcagagatgcagatcttagggctggtttctaagctgtgttggctcctcctgagccaggcctggggactgcaggatattggcggcctctccactggtatctttttatgctttctctcagtccttaccacctaggcaatttgaaagcctctgtcttctccctgtggatcttgcaaagtaatccctctcttacttccggaccctttaaacatctggggtctctggtacaaatttgagcactgctcattctcatttataaaagaattcactccatgctgacagtgatcatatctttgataactttatctgagaaatcaaatacccctttatttgagtatgcttactattagagtgccagacatcccccttaccttcagagagctccagaatatggagtagaaaggacagcaatcagtaagagaaaggtgacacttaagagaaaggtgacacttaagagcagacctggggtggggaagctgcactagggaaggagagcagaggccctgaggctgtcctgttccaatgaagttgggaaaggggagtagtttgaactcagtgacagggatggggtagggaatgttctaggtgaaataaactgcacttcaaggactcagaagcaactttaaagtgacataagggcaggaatgcaggagaagggggcaagctgggttagatgagaggagtagccagagagtaagtctttgaaataaagcagccccacctttcctccagagccctggaagtcataaggggaggagccagaggatccgagtacactctcaggttgctgtgtccctctgtctgaggaatgggaagaagtgtggtttgagtgttctgacgctccctaggctatgtgatctgcatgttaactcagtaggaagcactctgaacatatgtgagggttcaaaggtgaaccctggaacagtgagagcacagccatgggatgcacagggactcagaactgggttaaagtgtcaggagcaatcacttagtctgggccaagctgtccatccatctggaagatgagtcataatcagtagaaaagcagccagggtgcctgcagctgatgcaaggtcctctgagcagctactgcaggggaatgctccccaatacacaacacagtaataatgctagcttgtctttgggtctcatttagcatctcagtgtcttttctgtagcatctcgaaagtggggaggatactgtctaattcttcatgggtaacacaggagtcttcacaggcagcgtccaggatacagagttgctgagtcaggcaagaggacccaatgttcctggttgttttcttcttcgtttcctcttcttccttcttcaaactctattgtcttcagaagagaggcgttggtctgtatgggagaaggctgaataccacctctctctgctgtgttttgtgtttgtgctcctgatgatcttgcgttctccctgtgcagatgagaagaagctagtttggtttgctgcaatgaccacacttagctaataaccttaaaattggaaggactgtaatctagaatgaatttttgaaatctaatttaaggtacctatgacctttgaaatgacaaccagaaacagagtcccagatttccctgcctgagaacaatgaaccttcagctctacgttgatttttatatctcctttccctccagactctgcatcatgaatactctgtctgaaggaaatggcacctttgccatccatcttttgaagatgctatgtcaaagcaacccttccaaaaatgtatgttattctcctgcaagcatctcctctgctctagctatggttctcttgggtgcaaagggacagacggcagtccagatatctcaggtatgttctctgtcatagtcacacccgagtcacatgcataagaactgctgagaagggacagaaggaatgtgcacacactgtttcatggggcaggggctaaagaggaaggacagagtctcctccaataagacttctttaagggcaatgagatttcctgagtcataacttggggtgactctcagtacattgtctagaatctaattaacagtggtgcatgaataattttatactatacttggtgttacaggcctttaattacagctactaaggagactgagatatgaagataccaagtctgagactaccctgggcaaattagttctagaaaaattaagacgttaaaaaaaaaagatggagggaaggtcttagggttataacttaggtacagtctcaagtactgcaatttgagaaaataaaaagatgtttaaattatttgaaagagagtttgctgggatctattttattttttagagcaacagtctttgtaattaattgtttgcaaggaaagataattccttctctttattttgtctaatatgccttgcttcagctaaaatactgaagggggcaaatgtgtggagctagtccatgtcctaactggacattggggttcattactttttgacaagcatcctgagagcattccaaattaggaaatggggttcctgacctcacagcgttcctgaacaggcagnnnnnnnnnnnnnnnnnnnntctttctcatgaagatcctttcgggtgtaagtgctcggtctcgtcatctccaaacatagtccacgaggccatgcatgtgtagagaggcttctccctaattggtcctcatggtcttttctaggttcaggttcactaatcaactcatatacagatcttatgtatgtatataacatgtatgctcatgtatagcgtgtgtgtgtgtgtgtgtgtgtgtgtgtgtgtgtgtgtacatgcccttgtatatacctcttgttgggggtgggaggagtcagttctggttgtcttactctctctcatcaggctcctcccagtgctgggatgacccccatgcaccactgggcccatcttctatgcttattgagactccaactcagatgctcatgtactttactttctgagtcatctcatcaccttgacaattcctttggaaacaaattgttttattactgaactcagaatgtttcatcttttccttcccaggcacttggtttgaataaagaggaaggcatccatcagggtttccagttgcttctcaggaagctgaacaagccagacagaaagtactctcttagagtggccaacaggctctttgcagacaaaacttgtgaagtcctccaagtaagttgtattagtagaataatagcagttgaatgcaaggcagttgttgttgtagagcctatgagaaggaccctagagaatacgagaaaattacaggtctagttctactcagtgtgaggctacatatctataatacctttatttagatggccaagagggtcacatgttctaggccagcttcggctacaaaatgagactcacctaaatgttctcccaaaatatcacaattctgtaatgatattttgaaatatttttaaattgactacttgtaatttttatttactcatatctcagttgcaaagtttcagtacttaaagatgttgtgggttttttttttattaagatttatttattttatttatataaatacactgtggatgtattcagacacaccagaagagggcatcagaacccattatagatggttgtgagctaccatgtggttgctgggaattgaactcaggacctctggaagagcagtcagtgctcttaaccgctgagtgtgatatctacactcagtttagtttagtttttggtttttaatgccatagtattcagtaggttggaaagcttgctgaaatgtcattttgtaatgttaccttactgaatattttctctccaaagacctttaaggagtcctctcttcacttctatgactcagagatggagcagctctcctttgctgaagaagcagaggtgtccaggcaacacataaacacatgggtctccaaacaaactgaaggtcagaatttcaagttacttcacacaccacattcttgtcctttccatccaccctctctctttttccttctctgcctttctcttcgttcccttctccccaccacagactgatctcacagccatttcagagtcaaagccattctgactatctagaccacctggtataatttagagctcagggaattcatggaggttctactcagacacttagatttgaaacacagagttttttggtatatctacctagcacaggtgaggactgacgcaaatgatttccagtctaacagcttactttagaagacatgggtggtttgcagcattcgcaggtcatgtgactctgccatctctgagaaggagattcatggatagaccttccccttaatcctgctctagggctgcttctttcacagtctgtgttgtcttagctgtcaccacctttacctctgaaggagactactgtttctgcttccacagttcctgctttagattggttacttacattcatcagaattagacttgatttccattgaagaccctgccagctgctcagttacattaacctgaacgagctttccatttggggttgaactttatttgtttttattccagagatgacaggttccagcattagtctttgagatcattgtctgatatttgaaccattcagatccctctctatcactaggtacattcttacttctgctaacacagagtaaagaataagaatcttttcttagactcatcaattatttgcacatttcttgttagagttttgcctcttgtatgatcttgatattgtaaattagcaaggattgccttgatcagggaaagactacccattaatagagaagaagggaatttgtccctttatccacattttctcttaggaatgaacagcactcctaagtgtggaatagtcatgcctcctacactagtttctttctgattttgagtttctgacgtgttgtggtatgtcagacctgggattgaccatggagcgctagatgagactgggtatttaaccttagtatattagtaagggttcactggaggaacagaatggcggggatttaggggggattcaatagatttgcatacacaatacaggttgaatggatagtgaccacctgcatatggagagactgagtatccggtagctgctggatctaggagaatggagaccttagcaggccaagtctggcatggaaggcctagaggattcttcagagccacaagtctgtgttctcatgatggccaaatcaattgtcagctaaaaatggcaggcacagtgcactcaccagcaaggactgaaggcaggcagacaaaagcaggctgcttctgtctcagacctttatatctggcagcacagcattgtgctgcccaccggagggagtgacctgtctatattctgggaaatgtccccacagaccagagacatgtcctctgtttgaatccagaaccaattaagatggtaaccaacagtagccaccccaggggtaaccatggttccctcccacattttctgcttggtttgttcatcgtcctgaaatctctttttttgctttgcccaaacctgctttccttgagggacctacaagacttccaccatcctcacctgatgatgttcctccagtgtgcatgacctcaagtcaaacgtgggcattagtgctttcgtttgaatcatttttaataggcctatccaaattccacaaatatgaaaacgtgatgcttagatgtcttatcagttaatgtctcatacacatatgaaaggaacctgaatgaagtctctgctttctcaataggtaaaattccagagttgttgtcaggtggctccgtcgattcagaaaccaggctggttctcatcaatgccttatattttaaaggaaagtggcatcaaccatttaacaaagagtacacaatggacatgccctttaaaataaacaaggtaagaaacagcacccagaattcaaaggacaattcccttatatttcaaaggaaagtggccgccacagtttctcaaagaatgtacaatggaaatatcttttaaagtagatgacgtaaggaacagcatctaaacatacatgtcagtgtagtgaagagactgtatggaaagctttgatcgtgattgtgtagctctgggctcagtggtaaagactgcatatcctatgtggggttctggccttgactttcagaccagaaagaatgaaatcaggaatgcacaaaaaccatttgagacttatatttcttaatggaagctttaaactccatagaagaatgatagatataaggaatatatatctatatgttgctgtgtggttttaccgtctatcggtggctcatgctacttttgatcatttcttataaaaacctctgtttctacctcattctagaaactacattttcctttgagttcaagaaatcaaaaacgtaggtgttaatgtagtataaaacctgtatggagcatgaggcagggtagaaaggaatatataaacatttatataataaataatttcttaattaaaataaacattttaaattactggtccacttatcattattaaatagtatgtatttatagctttctaatatttaaaacagtgactgagatctcagtctgaattagaatataacttgaattaaggtagatattcgaatagtttactcaatacctataagatataatttaatgcattcaggaacattatgaatattaaacttcccattctatttttattaacagtactctaaaaatgtttgtaaaagaatgagtttttttttaacttgggaatttaatctttattctgaatggtctgtagcaaattcttatgtttattgtaccactataatcaaaatcttcacacattattgaaatactttaaaagtttgaacaatactgattgactactagaactgaacctgctggcataaaggacaagaagatagatacatgagggtctttccagatggccccctagcttttaatgggttgagaagaattttctgctctgtgatgggttatcagactgagtcacatagaaacatgtccatgtggttccccatcttggagtaatttaacttgggatttcccttccctctctctgatgggatatcaagatgcagctctgccctaagcctgtgaatgtctgtgttctggatctttctgctttgtgatggtttaagaggttttcatgaacatttgagcctgtgtgctcctgttgtcttgttgtcaggcttttgtttgtttgtttgtttaatattgaatattttccttatttacatttcaaatgttatctcctttcctggtttcccctccggagaccccctatcctatccccccttcccttgcttctgtgagggtgttcccccacccacctgcctactcctgcctccctgccctggcatttccctacactgaggcactgagccttcacaggaccaagggcctctcctcccattgatgccggagaagaccatcctttgctacatatgtggctggagccatgggtccctctatgtgtactctttggttggtggcttagtcccaaggagctctggagggtctggttgattgatattgttgttcttcctatggggttgcaaaccccttcagctccttcagtcctttctctaattctttcactggagaccctgtgctcagtccaagagttggctgtgagcattcgcctctgtatttgtcaggctctggcagaacctcttaggagacagctacagctgttttctgagagaatgcatctgtccataggcctgtcacagcactatgaaaatgttccagtctactttatgatattttttctgtttttcatatttgactatactgttttcctagatatgactgttgactacattaaatgataaaaatcctgcatcagatatgttagttatcttttcattagtgtaacaaactctctgagataatcaacttaaaagtaggacatgtttattttggctcatggttataaaagtttcatttggcgtccactggcccaattattccaggttatgatggtacatcacagagtgacaggaatgcgtggtgaaggctagtttaccacacagtacccgggaagcaaaagaaagaaacacaaaggggctagagtgccttcaggagaactccctttcaaatatttagcttttttcctattaatccttacctcctaaaagtttgaatagttcttggtcgtggctatctggggaaaaaggctttgaaacatgagcatttgtagaatatttaaacccagttctaaggctttagaatattaatatgtgaatgctatgtttttttttctagataacacaattgacttttagcagttagctcctgtcctgattattttttgttcttggtgtgtgtgtgtgtgtgtgtgtgtgtgtgtgtttgtatgtgtgtgtgtatgtacttggcacaagctaaaaaaaggaagaactctaaattgaggaattgattccataagattcatctataggcaaatctgctgggcatgttctcaataatggctgctggaggagggcccagaatgctgtgggtggtgccaaaaccacgcaggttgtcctgagttaagtaagaaagcatgctgagcaaacactggggagatgcccataagtaacattccttcatggcttcagcctggttccagctctgaattaccccagcaatggatgtgacctgagagttgtttatgaaataaattctttcctcctcaagttgctattctggcatggtgttttaccacatagaacacaccctaacagaaacggtcccatatctacttaccttcaatattttcaatgaaatcaggaagaagagggcagacattgtctaaacagtcactggaacatgaatattgtttacattgtgagtgctgaaaattttattgtgagccctgaaattaactgcagctcatttggagaccctgaccactctcagtaatacgttttatgccatgtatttctgtgttcaggatgagaaaaggccagtgcagatgatgtgtcgtgaagacacatataacctcgcctatgtgaaggaggtgcaggcgcaagtgctggtgatgccatatgaaggaatggagctgagcttggtggttctgctcccagatgagggtgtggacctcagcaaggtgagccagaagagtccacaaaattcatcactctaaatgtcttccagaagaatccagtgtccctgttgtcctttgtcattagaacagaagtaaatgattttattttgtctagtaccagttgagtgtgttgtactcacagacccagcattgagttgtgtgtgttggcactgggctttgggcttaaatctgtgcccaagactcccattgtagcctttgtgcccttgccatataacataaattcatcactagaatagataatggctacctgatagaatgaaatctgggcatctcaaatgataaacatagcacagtgcttggaaaatagtcctcctccataaatataatccatgtcatgatctttgttagcattttattcaatatctgagaaaatgcacaaagaactgttaaactttgacctaataaataggaagaggaggggtgcagctggagagagcagagtcaagcaggtcattataacagttcttggtcttccttgcggcaggatttcccatggtgtgtgagccatcctctgaatggtgggcagtagattgtgcattacctaaggggtctttgtaagcagacctgcaccatagttctcagcatccagcaccctaactgtggcatagtttctctaggatattactgtgtttcatcactgacaaaatgcctgacatgataacctagggcaggaaggatttatataggctcacagtttcagagcattcatttcagttacctgttccatcactggttgatatggtggcagctgcacattgaagggaatacagatctttcagttaataggaagtttagaaaggagaaaagacacataggatcaaagatgagcttctaagaaacatctccagcaactataaccttcattcagctaaaaaataatttagctgcctcccaaaatgttgccacatgtttcaaaacaatggtctgctatgaacatttgggtggaatttcacattcaagtcacaacagctcaccaaacacattaattctaccctggattgacttcccttctggtgtggctcataataagagttaatttctttcagagctttgatttttattttagcagcagtgattcactagctttgaaacaaaatctagttcaagaaaacaaaagcaaatacaacctaaactattatcacctggacatggacacctgtcagaataaaagatgtcttagatgtaatttctgggagggcaaccaggtctttctatccctgggctgcttgtcaaccatgaccatcagggaagacacatacaagctagcaggacagtggactgtcacactgcctttttatgaataagcagtgtgccttgaatggtgttagaaggtactgtgaataggagtgctctgtggttctgaggaagacctcaaaggtgaatctgaaattctcaaattcttctttgttaggtggaaaacaatctcacttttgagaagttaacagcctggatggaagcagattttatgaagagcactgatgttgaggttttccttccaaaatttaaactccaagaggattatgacatggagtctctgtttcagcgcttgggagtggtggatgtcttccaagaggacaaggctgacttatcaggaatgtctccagagagaaacctgtgtgtgtccaagtttgttcaccagagtgtagtggagatcaatgaggaaggcacagaggctgcagcagcctctgccatcatagaattttgctgtgcctcttctgtcccaacattctgtgctgaccaccccttccttttcttcatcaggcacaacaaagcaaacagcatcctgttctgtggcaggttctcatctccataaagacacatatactacacagggagagttctctcttcagtatccctaccactcctacagctctgtcaagatgggcaagtagggggaagtcatgttctaagatgaagacactttcttcttgtcagcctgatcttataatgcctgcattcaactctccctgtcttgaatgcatctatgccctttaccaggttatgtctaatgatgccaaataccttctgctatgctattgattgatagcctagccagtaatttatagccagttagaactgacttgactgtgcaagaatgctataatggagctagagagaaggcacaaacactaggaaaggttgctgtttttgcagaggacacagggacatttcccaccactcacatggctgcttacaacctctggaaattccagtttctgtccatgacttgattcctttctttggcttctactggctccagcatcctgcacatacatgtatcgtcattcagttacacacaaacaagtaaaattttaaaaataaataaaaatttaaagagagagtctaaaattttagtaatggttagataatagctgctattgtgcctttttcaggttttaatgtcattattcttgtgtataaagtcaataatttataggaaaacatcagtgccatgctgtgatcttatcttcatcccctttcaaacacattgtttaaccatcaagcagtgactctccattcttcctccctttggacatataaccaccaatcttctctctgtctctgtagctttatctattttggacattttatatagactgcctctttgctatcttgataatgtcctttgatgcatacagattgctttttttccagtgatgttctccttatttaatactgttctgatcatgaggtatgcatgctgcagctaagaatctcactactaaagtcaagtatagaaataactgttcttatgttttcctccaaggccttcatggattataccttatatatctaggtcactgttccagtttgaattaaattccatatgtggtgtggtgttggagcctgatgtgattcctttatttgtgaacatccagttgtcgctgtacttgtaattgctttgaatcatgaggtaatgaccaatgaataggaaaaataatgttacaactagtggggtaggatagaagttcctcagtacatatattgaacattaacacaagtgtgaaataaaaatatcagaaatgagcagtaaacaaagaaggagagattaaacgttctgtaatcagggtcctcagaaatgactcaggggctgaagatgcttgctaccctgcctgacaacttgagttctatttctggaacagacatggtggaagaagaaaactgactctagcaagttgtcctctgacctcaccatgagcatgatgcacaaataaatatccctgttaatcagatataattatgcagtaagttaataatcagaaaaaatacacatataaaaaccaattccttatcaacaagttaatcttgctaggaagagccaggaaaaagagtaataggggaccatgtgatcctaaaagggataaagctaagccaggatatactcttatacatcaacatgtgtcctggtttccagaaggttcaatttgaggacatatcccaatgatgtcattactgaagtccacaaaaagacagtgactatgatctctgtagccatatttatagcagcaaataatggatccaggtgtcaatctcatacagtaaacaaagaagtcatgttgtacacttaatactgaatggaagttagaaagttgtaccagatagtttttatattaatgtgatacaaggtagagtcactggagaggaaagagcctcaattaagaaatgtctccatatgctctggagcattaatgtgagaaggctaggcccattgtatgtgagacaatccctatgcaggtggtcctctgattataaggaagcaggctgaacaaaccaggaggagcaagccagtaagcagcattcctctgtggcctctgcatcagctcctgcctccagtttcttgccccgttggcattcttctgacttccttcattgatgaacagtgatgtaaacgtataagccaaataaaccttttctaccccaacatgccttcttcatggtgttttatcacagcaacaaaaaccctaactagacaaaagtcaaatataatgtgcatccagtctggtagatgggtgatgccaagttttgaaaggagacagcaaggtaaagcatagtgtctattagtctgttttctacctctttagtgaaatattgaactttggcaataccctgcttattatataattctgggccacctgcctaattgtggtactgttcacactatgctgggccttctcgtgatctgaacagtaagtgtccggtggctggataatagatgagaaataaagaggatgagagataaataagagaaaaagaatagctgtaatcatatgtatatgctgatgactgaaaaaaattattaaacacagtaatatgcatgcacatacatatgtatatacatatgtgtgtgtgtgtgtgtgtgtgtgtgtgtgtgtgtgtgtgtgtatttttttccccagggaaaaaaactaaggggaagaattcttacaaccttgacttctacaaggctcttgcaccagccctagaccagccttgtcatgtatgctcctgagtgagtacacagaactaaaatgtccttccatcacagtctctgagaaactcttgggttgatttgcctaaccacaaccaatataaaaaacacaattagaacatgaccctcagagttgcatatgggtaaatataagagaggccttctgaattgaagttcctccctcctactgttaatataacagacaccctattttgtatcaaattgataagaactttaagcaggacacacatctgggaaataattctaccaagtctggtttggtggggtgagtacttccatgagcatgaatgactctgacagctgctctctagaaaagctcagtcaagcctggctactcattaaggtggcatcattggggcagcttgagcaacttgcggacagggccactgaagtcctcccccttagccacttctcactgtcatacaaccttaatgatgatattcttgagccttggaactcccttatgagtacttttacctcccttttgctttcctctgctccccccacacaaccaagagggaatttttcaaactgaaggaaacagctacactaagagaagaaatggcatagctgtctgaatctctctctctctctctctctctctctctctctctctctctctctcacacacacacacacacacacttctgagagcagggttgccaatcagcttttctaagacctcctgttgtgctaaaactcaatggctctacttccccttccaccatgaatgaggaagagaaataggatggcttccacacacatcatgcaaggtcctccttacctcaactttgggaaacaaagtcctcaccatacaccatgaatatgccgtggcttgttagtgttgaatgagactttcccaaacagtacatatctccaggacagatggatctgcatgcatcatcccttttgacctaacttaacatagtgttccagttgtatcaggtatgggaaaaacctgtagtgtgaagccttgctatgctgcagactggtctcagtcagtccctcacccagcgggagaattaagggtcctggtactcaggtgggcaaggagttggtgggtgacaaatagacacgaacacaagaagagtgttggatctgaatgtaatttctcaaggcaagcatcagacttatagaatagaagaaaacaaggaagttaggtttacatcagccatggtacactgaagttatccaatgtatgatgacacaaaacagagaaatgcatacataaaggactgacaggaaccaggcagtgataacaactgagataaaaaatgtccctatatcaagtccgaaattctaggagccaggtgaggatttcacaccctagtcacaattctagtctaatgtataacccatcacctgggggtttctgctcttgctgatcttttcatgaataatacaatactctggttcctccttaagccacaaccctctttcttcctagaccattgtaaatacttgcatatgggagtgattcactgttattctaagtttattttgttgaactagccctgagatatttagctcttatccagtaaaatacggcaatgcctgatttcttttactgtctttctttcaacactggaggcattttgtttgaataaatcaaatcattccttgggggcacctataataaaacaatatcgaaggaaagcactctaaacccttcaccaactattacaagaacatatctaaacccttcaccaactatcacaaggacatatctggagtatatctgtttatgggatggcagagactctccaggagacaagtttccctaaaactttttgcctcaggattgaggccaatgttttggacttgtcatgcagacctcactggagtgggtgtggcattgctatgggagtgtctttgtacatacagaggcaacttcaggaaaagtttggtgtgttgaggcagtccagggcaaaagtgtgcctggaagtgcgtagggctaaacacagcagggatttggagccagtgaacctcttccttcctgacatcagatggcttcagggagttttcacttgcactgcttggaaagtatatcacccttttccctcatctgtccatcacttccttcgatgagtctcttaaagacattagaaaagtctgcttgtcaactgtttccttttccatgtattactcgttttcctgttagtaatacagaatctcatagactgggtaagatatgaacaatagaagtttctctttgagatcctagagagtcggaagtcttatgaagatcattttaatgaaaaagagaaagctgagaaaagaaaagcataaaatgtatggtttacctagtaaagggataccagcaagtgaaatggagcaaaattctatgttcaaggagattaattagttaaaggagtagtaactatgggggcaaggtcctacccaggtaagcttaggtcgaaacatgggtgggtacaggcctttaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctttcattctctctctctctctctctctctctctctctctctctctctctctctctctctccctccctcctttgcctgcttgccgtgtgggactgagtaactgctagatcattggacttccattcacatctgctactgaccactgttgggagttggactgcagactgtaaggcatcaataaattcctttactatatagagactatccataagttctgtgactttagagaaccctgactaatccaggagcccactgaataacttggtgactcttccctatgtggtcacattgactaaacctgctttgtcttgagttactatgaatttgcccctttaaatttggtttgtaaggacagctggccaagccaggcttgttagagctgctagagcacccaggctgtgactctaacagttgattgatatgattgctgttctttgtttgtttgtttgtgatggagtctcactttgtagtcaaggctgtctgatatttgatattagacttagacttgctttgaaatcacaaacatatgttgcctaagtctgtgtacagggccctatccaagggtatctcttgggtattggcctggccagaggggccaaagaagtgcagctctctgagaaggaggggtagccagagcaagtcaagtttctggtcctcttctaaggccactgaagtgagcagctggagctaaggtcagggacaccatgcaggaaatgacttcaataaaagcttctggagagaattctcaattagaaagtcactctcaaacagtctttggtgaagtaactcatgtaatttattccttgtgtatatggtcttatatacattttgggatgggttggggtacaaaagcagttgatttctgttggcttgctctgaaatgttagggatcccatatctgcatgttgagcatcattgacagttgctcctacatgactaattcttacagtcctctctatagtgtatcatggtcacaggttccatggcagaagcatggtcaggagtagatttaaaagcctaccattctcaggggaattaccatggtttctgaatctgctcaaccttaccaagttttctgtctagtggtatggtccactgccccacaatatgcttggctctgtctctagattctagcattgcaattgtgtaccaccacatgactgatttatttgttcaccatactgatagtctctgataatgacttttgttggggattcagagttcacagactgttgaacaaagtcttcacagctcaccccctaattgaagtttattaaactctcctgaattgtttctcacaaatgtttctttcagatacaatctttccagccaccaaagtaggaacactttccagcctgggctaccttcctgccactgtgaattatatattctgattctgggtcaggaaagtatcagaggagtgtgggggttgaaaaatgtgaggagccctggtaaaataagacatatttatttactttggatgaagactaccaggatggcagcctccagaaggcacccaggcacacaataacacacacctagaacacaggaaaacactggcctagacattggaatatacaaaccacaagattgtagggatagaggcctgccgacaggcagtggaaggcagactgaggcactagccacccacctccaagtacaaaaagaaaatttggataggacatgccactttctgaacagagttccaaaaattccgcgtctaaagtgagagcatcttcagtcttcggagctagtcaaccccaagaaacagtccacagtgatccaatcaactctcagatgattaagtctaattaaaggggttttaagtgagatctatgatggcaagaatagaagtttaacagaggccacacaggttgtaggaagatgcagaccagggctgtgactatggctaggaggaacattccattattcatgtctcacagagatagcagagtcacttgttttatgcaaaaggtgtaagcatcttcactgttggggggacttaaaatttatcatagaggtgaggagatagccagaaagcacagttaagtattctgtttcataagattcattttaattatgaggaggaggaggaggagaaggaggaggagcaagagggaaaggatgataatgatgttgataacaataacagtgatgatgacaatgactcctcaaataaaaataggcaggagtttgagcaggccatcttattgcaagatttttaaagaaccactgagcacatgagcttatgattgacatgactactcaccaggaaaaactcaaaaccttaatgaataatcacatcacactgattggctaaaataagttaagagaaaccatgcacagagagagactgaaactcacatggtgctgctaggtacatatgagtgcatagaagccttcaaactcattaggtagttcttcaaactgtaaaatgtagagttgtcatatgacccagaaattctttgggctatatgctaggtaactccaagagagcatatgtctatacactaaataatacataaatgttcatagtaaaattagtactaggtaaaagatagaaacaatctaatgctgaccaatttgccctgacctgcaggacttaagcaacagggttctcaagagaagagaactgcaactacaaatctgggatcaggagacacgaaggaaggcaccaagacaaaaatcctgttcaagcctcgtttactcttgggaaatggagggattttaaagatgaaaacctcaaatgatatttgatcagatacacaggctaaaccaggccaaactggtggtgctaagcaacacatttaggccaaaggaatgccctcactgtaaaaagatctggaaagaaatgccctcattgtaaatttccaaagtcaataaggaatggagcaagatagtggaagaagcaaaagagtgttagatgatggcccagggacaagattccagcagcatccaggccccaacaccaattgaataaaaacttatttttagataatatcattattaatattcttactcaggcaaagaaactaatgcctgaaaaatattatcttgagataacagaaaaagactaaggttgttaatgagatttgggaaaagaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgtgcaaattcctaagaatcttacaaggaaaacctgtttatagtccaagtagtatgtcttgggagccttcttacccatactttatcattcctgattataatacctatgtaaggtactcctatttaggaaaaacaaggaaagagagcttacatatagggagctgctgctctagccctctggtatagaagccaaaagcagcaaaaacatagaaaattttgactccaaaaaattctccaggtgtgagaagagggagaacacattccatcatgccatcaagcaggaagtgcactgaagatcatctcaataacttccttaggggacatgaagttcatggagaagagtattgcagtgggatctgtgctctgtagagtgagcactgtagagtgagttttaaagggcagatccatgttgaaacagactacacggagaaaattaaatcggtgggcaggaggtgaaaaaaaaaaaaaagaacagagctttccagacaagagaaaataacatagcctggttttggaagatgaagaggaggatggcagcgaagtctctggagaaagctggggcgaggaaggagaagcagagcagactagaaaaactgtgtcagaagatattaagacaaaggggaagataacaatgggccagctgtttcagtgatgtgggaccaaactgaaaagtggccccaagaatgtgagttaagatagaagatggtcaaactggttgttggtcaaagcaaggaaataggagaaacaaagaaataggaggttgaaatcccctaccgctcgtggaggacagataaggacagaggttgcagaggaagccaaacctttccccaagcaagatgagcaagagagccacaggctaaaggtcatatagctgtgctcactccctgctgggtgaggggttagcagactcttgtggaaaatggagctgagcagagaagatgagcactctggagaaatccaaaatgcaccccagtgggcttcagggaggaagagttgggagaaaagctcccatccataggttatacggagagcacgtggagtggaaagctttatctagactgagtgcaccacagaggttgaaactgtgtgagctctcaggctcaaccaaaccaaaatttgatattgtctaggagaagtaaatgaatgatcctgtagacaggatgagcctttcctgggtctgtgaagtcctcctaatgttcctatttcctagcaagacttctttctgcctggaagttctgcttatgagtttgccctcatatagcctcattctttgtagttttaaaagcttgtccttaaataactaaacaaagaaatactggctctctattagctataaaggagattgagagtttctcagcaactttgtaagatgtaacatctgagagccaccaaagccatacatgaagct

SEQ ID NO: 734 - DNA, 1799 bp, Mus musculus
gctggattgagaagccgcaactgtgactctgcatcatgaatactctgtctgaaggaaatggcacctttgccatccatcttttgaagatgctatgtcaaagcaacccttccaaaaatgtatgttattctcctgcaagcatctcctctgctctagctatggttctcttgggtgcaaagggacagacggcagtccagatatctcaggcacttggtttgaataaagaggaaggcatccatcagggtttccagttgcttctcaggaagctgaacaagccagacagaaagtactctcttagagtggccaacaggctctttgcagacaaaacttgtgaagtcctccaaacctttaaggagtcctctcttcacttctatgactcagagatggagcagctctcctttgctgaagaagcagaggtgtccaggcaacacataaacacatgggtctccaaacaaactgaaggtaaaattccagagttgttgtcaggtggctccgtcgattcagaaaccaggctggttctcatcaatgccttatattttaaaggaaagtggcatcaaccatttaacaaagagtacacaatggacatgccctttaaaataaacaaggatgagaaaaggccagtgcagatgatgtgtcgtgaagacacatataacctcgcctatgtgaaggaggtgcaggcgcaagtgctggtgatgccatatgaaggaatggagctgagcttggtggttctgctcccagatgagggtgtggacctcagcaaggtggaaaacaatctcacttttgagaagttaacagcctggatggaagcagattttatgaagagcactgatgttgaggttttccttccaaaatttaaactccaagaggattatgacatggagtctctgtttcagcgcttgggagtggtggatgtcttccaagaggacaaggctgacttatcaggaatgtctccagagagaaacctgtgtgtgtccaagtttgttcaccagagtgtagtggagatcaatgaggaaggcacagaggctgcagcagcctctgccatcatagaattttgctgtgcctcttctgtcccaacattctgtgctgaccaccccttccttttcttcatcaggcacaacaaagcaaacagcatcctgttctgtggcaggttctcatctccataaagacacatatactacacagggagagttctctcttcagtatccctaccactcctacagctctgtcaagatgggcaagtagggggaagtcatgttctaagatgaagacactttcttcttgtcagcctgatcttataatgcctgcattcaactctccctgtcttgaatgcatctatgccctttaccaggttatgtctaatgatgccaaataccttctgctatgctattgattgatagcctagccagtaatttatagccagttagaactgacttgactgtgcaagaatgctataatggagctagagagaaggcacaaacactaggaaaggttgctgtttttgcagaggacacagggacatttcccaccactcacatggctgcttacaacctctggaaattccagtttctgtccatgacttgattcctttctttggcttctactggctccagcatcctgcacatacatgtatcgtcattcagttacacacaaacaagtaaaattttaaaaataaataaaaatttaaagagagagtctaaaattttagtaatggttagataatagctgctattgtgcctttttcaggttttaatgtcattattcttgtgtataaagtcaataatttataggaaaacatcagtgcc

SEQ ID NO: 735 - protein, 377 aa, Mus musculus
LCIMNTLSEGNGTFAIHLLKMLCQSNPSKNVCYSPASISSALAMVLLGAKGQTAVQISQALGLNKEEGIHQGFQLLLRKLNKPDRKYSLRVANRLFADKTCEVLQTFKESSLHFYDSEMEQLSFAEEAEVSRQHINTWVSKQTEGKIPELLSGGSVDSETRLVLINALYFKGKWHQPFNKEYTMDMPFKINKDEKRPVQMMCREDTYNLAYVKEVQAQVLVMPYEGMELSLVVLLPDEGVDLSKVENNLTFEKLTAWMEADFMKSTDVEVFLPKFKLQEDYDMESLFQRLGVVDVFQEDKADLSGMSPERNLCVSKFVHQSVVEINEEGTEAAAASAIIEFCCASSVPTFCADHPFLFFIRHNKANSILFCGRFSSP

SEQ ID NO: 736 - DNA, 31828 bp, Homo sapiens
tggagccaaaaggtggctgagatgatgatgacggacacacctggggaaaaccataaaaccagcaaggaactgacactgtcagaggcaccttgagaattcctgcctgtaggagacatcacactctggggactgttgtggggtggggggaggggggagggatagcattaggagatatacttaatgttaaatgacgagttactgggtgcagcacaccaacatggcacatgtatacatatgtaactaacctgcatgttgtgcacatgtaccctaaaacttataatagaaaaaaaaaagtgcctcctcccggtgagacgggctgcccagaggctctgtgtgagaggagtgtctgctgtgctggcctcctcagccacagcctgggtttgccattccgctcattactgcctttagtaattgtatcatgtcattcccatcactcacaggaaaagaaacaatgaaaaaaataattgtattgtgaatgtttgctcgattgattgggtatgtgtgagtctctggcaataaaccatatttaagcattgcaaattggctaccgggtcattgggaaacctggctttgatctgagcacacaggccagaagaacctgattacaataacatttaaaatgaacataataccagataaccagcacgtctcccatctcaagattcttaactagagggaccacatcggcaaaatctcttttgccatgtaagacagtcactggttttggggattaggaggtaagacatctttggcaaggggcattattctgctggctacaccccagtgttcactgactggggactgacgactaggtggccatagagggcttggttgatgtgcttctgatccagaccttccctggtggatgaattcaggtgcagatggcactttttttttttttttttttttttttttggagacagtctcactctttcacccaggctggagtgcagtggtgcaatctcggctcactgcaacctgcacctcctggattcaagtgattctcctgccttagcgtcctgagtagctgggattacaggtgtgtgccaccacgcctggctaattttttgtatttttagtagagacaggatttcaccatgttggccaggctggtctcgaactcctgacctcaagtgatccacccgcctcagcctcccaaagtgctgggattacagacgtgagccactgcgccctgcccagatggcacttttgccagcagtttattaaggaggagggtgatgagagcaactcatgaaatatgtttttcttgcccctgagcatctcctctgccatggccatggtgctcatagggacaggtggaaatgtacctatcacatggggagaatgatggcatgtttttctcctgtgcttccacagaggggccttttcataccttcacatcagccggtaaaagctggggtggcctgtaggtggcaggaaggacctcatgatagcacatggcagaaatggatagaaaggtgaactgtgcaggatggggaatctcctgtagtgtttgtgggagaaatcaagtgatgaagttattttctctagacaaaagcatccataaatcacagcaaaattgcatctttgataaggtaaagctacaattctattccacaaaaagacaatttcaattttttgttttaaacttttgctaaatgtgtttaaaatagaattgcagctgtaaatgaaccttccataaaatgggttatttttagtggatgataatgaatacgtgaaaaaagaaaaaaacacaaatgagaatgtatatcttctggagcttagagggcaaatatattctgactgccccaaaatggatgatgggaaccatatgtacaaatgaggtagtgggcactgctttagggaagcagtccttaacctttctgagtctcaggtttctttgatgatctggggaagtgtctcggcgtgttaccacctgtgcaatgttgtgcaagtcacattagtggtgtctggctgacctctcgaactgcatccacagacctcagctgaagatccccctgcagctgtttcttccagcttctggtggaagggccggtgatagaggaacaaccttaattttcactgtggcttgacatttaaatcacagtgttacctggagaacttctgtaaaattactggtgaaacattttcagttttatgtctgctctttcttgtgttccctggggccaggttagatttaaacctgaagactcattttttttttttttctgttctgttttcctcctgttatcaaggcttcctagcatgaataaatctgccagacccatggttctcacctagggggcaactgtgccccggcctggaggacatttggcaatgtctggagacatttttggttatcatcattgaggggtaggtgtgcctggcatggagggggtggaggccagggatgctgctgaatgtcctgcactgcacaggacagcacccagtgcaaagaatgatctggcttcacacatcagcaatacgtcagttgagaaaccctgcgctagacaattaaagcatttcgttataggaccctacctaattttctgtgtagagattcatttggaggtccctctttaggggaagtaagagggcaatgttcgaagttggcattgctgtttaatattaccaggcactttgtttaaacaaagataacgacgttcaccaagacttccagtcacttcccattgaagtgaatatatcttagaatcgctgacagactttggagaaaaaaacacgttttagtaagtagtactcagaatcaatgaaaaggaaaataaaagaggaactacagaagagtagagaatacacacaattctgctgccatcacatgtacttagaattgcacttgtgtaattataatttttatttattattttttttttgagacagaatctcagtctgttgcccaggctggagtgcagtggtgcgatcttggctcactgcaacctccatttcctgggttcaagccattctcctgcctcagcctcctgagtagctgggattacaggcgcatgccaccacgcctggctaatttttgtatttttagtagacatggggtttcaccatattggccaggctggtcttgaactcctgacctcaagtgatccacctgccttggcctcccaaagtgttaggattacaggtgtgagccactgggcctggtctaattttaatctttaatattgcttctaaattacatctcccttgtttattttttgataaccctcttctgatgtcaatttcaatatgtccattctcctgcgcccaaatctgcgtctcctccttaaaccccgtcttccagcatgcagcacaaggctcagccatcagggcctcctcccccatctcacctctgggtgctggactggtttcctctcaaggcctcttacattcgccccctttctgagtcatccctgctactgcctggcttcacaatccccctttagcttctacactaccatcttaactgccttttaagcactctctccaagcacagcctgaaacctccctctgtctcataaacccccattactgacagaatagtttttgtaaataaaaaatctgttcattaaactgaggctttaaatgtgagtagcttttatttacttaaacgtgtactcacagtccagaaaaacccttccataatgcaatacatgaggctcaaacaaattctaccaggttgaaggggtgggtcgcccctccacacctgtgggtgtttctcgttaggtggaacgagagacttggaaaagaaaaagacacggagacaaagtatagagaaagaaataagggcacccaggggaccagcattcagcatatggaggatcccgccggcttctgagttccctttgtatttattgatcattcctgggtgtttctgagagaggaggatgtgtcagggtcacaagacaatagtggggagagggtcagcagacaaacacgtgaacaaaggtctttgcatcatagacaaggtaaagaatcaagtgctgtgctttagatacgcatccacataaacatctcaatgctttacaaagcagtattgctgcccgcatgtcccacctccagccctaaggtagtttttccctatctcagtagacggaacgtacaatcgggttttataccgagacattccattgcccagggacgggcaggagacagatgctttcctcttgtctcaactgcaagaggcattccttcctcttttactaatcctcctcagcacagaccctttacgggtgtcgggctgggggacggtcaggtctttcccttcccatgaagccatatttcagactatcccatggggagaaaccttggataatacctggctttcctaggcagaggtccctgcggccttccgcagtgtttgtgtccctggatacttgagatgagggagtggtgatgactcttaaggagcatgctgccttcaagcatctgtttaacaaagcacatcctgcacagcccttaatccatttaaccctgagtctgacacagcacatgtttcagagagcacggggttgggggtaaggtcatagatcaacaacatctcaaggcagaagaatttttcttagtacagcacagaatggagtctcctatgtctacttctttctacacagacacagtaacaatctgatctctcttgcttttcaccacaccaggtagcatgcaggatgatgttatctgagatcagtgagctgctgactggctggattccaagggttcttctgtaagattcaaatacatcccagtcatcactgctgccggggactctcctgtggaggttgcctgctctcggcttatatcccactggggcagattctgggccctttgggtggataagcaccagcgatcccaggaatcatttttgaacattggcctgatctttgactattataattggagaatactggggacacagggggccacctgccacctttctcgttgcctagccccttctcctctctacatcctcttctgtagaaccaagattatttgagaacaagaagatgggcagaggatgggaggctagtgccaagcccattatagctgaaaccaggtgatcatggaagggagtcagctctgggcttcaaaggtttgcatacaggccttttcgatttgacctcaacatacgtttcaaggctcatctcctgctgctgtgttcttcttatccccctcccgacatacgtactcgagcacacacacacacacacacacaacctcgacacacgtactcgagcgcacacacacacacaacctcgacacacgtactcgagcacacacacacacaaccttgacacacgtactcgagcacacacacacacctcgacacacgtactcgagcacacacacacaacctcgacacgtacttgagcacacacacacctcgacacacgtactcgagcacacacacacaacctcgacacacgtactcgagcacacacacacaacctcgacacgtactcgagcacacacacacacaacctcgacacacgtactcgagcacacacctcgacacacgtactcgagcacacacacaacctcgacacacgtactcgagcacacacacacaacctcgacacacgtactcgagcacacacacacaacctcgacacacgtactcgagcacacacacaacctcgacacacgtactcaagcgcacacacacaacctcgacacacgtactcgagcacacacacacacaacctcaacacacgtactcgagcacacacaacatcgacacacgtactcgagcacacacacaacctcgacacacgtactcgagcacacacacacaacctggacacacatactcgagcacacacacacacacacacaacctcgacacacatactcgagcgcacacacacacacaacctggacacacatacttgagcgcgcgcacacacacacacaactttgacacacatactcgagcacacacacacacacaacctggacacacatactcgagcacacacacacaacctcgacacacgtactcgagcacacacacaaccttgacacacgtactcgagcacacacaaccttgacacacgtactcgagcacacacacacacaacctcgacacacgtactcgagcacacacacacacacacacacacaacctcgacacacatactcgagcgcgcacacacacacacacacaacctccagacccttccaagtccatcttcagggaccttccttggtccctgttctctcaagccacctggatgatgcagatctgaaatgccgtttccctgtttgcccacttgcagatctctatttcttgatcatctaatcccagtatgaagcctttcaatcattcaacaaatacgcttcagcaaatacagttgtctcttggtatctgattgattccaggatcctagcgaacattgagctctgcggatcctcaagtccctaatataacatggcgtagtgtttgcatataacctatgcaaatgtaacctgtgtaacatcctcccatacgcttgaaatcatctctagattatgtataatacctaatacaatgtaaatgctgtacaaatagccgttatactgtattgttttaaattttgtattattttttgattttttaaaaaatttttccatctgcagttggttgaatctgtggatgtggaacctgaggtaccggtggccaaatgtacagtgtgctaatataaaaattagtaaaggagggttaggctgtcctgaggctcgcagtccggtgtgggagacagaagatttagtggaaagtccctgtggagcttaagtgttgggctgggccattctaggggtgttcagggcaccttggaagtacctcagtgtgctcgccgtctctccctcagactgctgccctcttgggccagatattgtgtcttcaacttggtaccaagttcccagcaagtgccaagccaagcccatggcaggaagcgaattattttttgttaactgaatgcatgagtcttagaatggaacctgactgtgtcacaagcatgataggaacatgttgggggcagggaaatgttttcaaagttgtggaaacctttgcagaatgaatagggccacgctccatattttgctctttgcaggactttaaggaagtgtgtcaaatgcccacaggtagagctggaaaatgtggcctttgctaaagatgcagaagagtctagagacgcacaacggctgggtcattggtggtgagggactttatttgcagtgaacttggagctaggaaggaagttactgctgggtgggtcctcagtgacggaggtctgcttacacgtttgccaggttttcaggccagcaacatgattctgtcatttctcttgggcttgtctgatcatgaagtagtgatttttgaaaaatccttggacctggtgtgaggatcaaagactcccttcctccggacagtgttggaaaatcctggaaaaatgcttcctctggggccctgtgtattttctatctgggaaaaccatgatgagcaatcagataaagaaatatttttgtgatatgttgtgactttcttaaagtaataaagtagaagagattttaaatgaaaaatataggtaattgcaaaatctcttgattcttagctatttctgaacagatttcatgccccacccccccatacaatttttagtgggggaaagaggagaaaggaaaggaaaagctaaaataaccttgttttcatagttctgtgtttttatcctttcctaaacccattttccatcgctggtcacatgatttggattgaaaggacgtttcctctaggcctcggagcacagaggcagctaacatgtttgcactatgccatcatggtccacgtttactcagacactttcttgcaatggcactgacaacgatgcccccatttgttgccttaaaattcatgggtatggccaggcacagtggttcacgcctgtaatcccagcactttgggaggctgaggcgggaggatcacctgatgtcaggagttcgtgaccagcctggccaacatggtgaaaccccatctctactaaaaatacaaaaattagctgggtatggtgatgcatgcctatagtcccagctacttgggaggctgaggcaggagaatcgctggaattgggaggtggaggttgcagtgagccaagatcacgccattgttctccagcctaggcgatagagcaagactccacctcaaaaaaataaataagtggataaataaataacagctttttgtttaatcaattgtctctatcattataaagttttctatatcattgatttattctctaatctttattatttcttcttttctactgattatgtgttcaatgtatttatactttttctagtttttgaaggtagaaactgaggtcattgatttgaagcctttctcctctcctaatataggcatttcatgctgcaaaatttccccaaagctgacttaataacatcctacaaattttgatgtttttattttcattttttattaatttcaaaatacattctaatttcccttttgattttataatatttttataagtattattcagttataaaaagaaataaagtactaacaaatgctacctggaaccatcaagaatgacccttgaaaacattatgctaagtgaaagaaggcagtcaggaaagaccacatattgtatgattcaatttgcatgaaatcttcacagtcggtcaatccgcagggccagaaaagaaatctggaggtcggagcctctcccagaagccaggggttgtgggaaggaggaaatggagaataattgctaatgggtatcacagttccttttagggtgatgaaaaccttctggagttagatagtggtgagagttggacagctttgtcaatataccaagaactattgaattgtatgctttaaaaggatgcatattatggtccgtgaattgtcttttaataaaggttttatttttaaaaacaagctaggcacctagggtgtcaaattgaaggaggctctgattctcagggccgcgcaaatgcagggttggcacctatgcgtgtggccctcctgaaattttgtgccttaggcacctgccttgcttctccctaattcaggccctcaggagaaagctctaattctggtcaatttgaaacaggagggcacggcttctgggcgacgctccgtgctccagagagagccatttgtctgttcccttcctctggacgtcaccgtgccaacatgaaatgcttccaattgagtccagcctgagatggaagggggtggggggatatctgatgacatcacgaactgctgcatcaactcccccgagtccctgcctctggaccccctgatagaggacacaaggagtgtcctgagcccgtgtgactcagtgtctcttcccatcactttgcgggaaaatggggctgcttacaccacaccgcagcccaaacacctgtggctagagaagggcttgggtactaggagtgaggacgcctggttctgggcccaggactagtactagttagtggtgggacctggaacaaatgctttggttctaagtgaatcccccatattcatgacaagaggcgtggaacacagacccatgggaccttcccactggaacacggagcttggctgtcacccgaccttcgcttccttaagtacaaaagcccagggttccaggctccgtctcctttcccgcagacgccttgtttcttcgcgcggaggccctggacgccgcaggctcccaacctacttctctgggctgtcaggttctgaacccggtcctgaagaggccctggcgccgggggtgggtgaggccgagcgcgcgccttgggaacctggccggcctcaggctggcgggagcattggcggacatcgccccgggcggggcggactggggggaccctgacctgaccctgctcccagctctgacctcggccaccacgcgcggcgcccccgctggtcccgccaggctccgcctaaacgcagaaagcgtgggaggcgcccgaccctgcggtataaaagcggtgcctgcagaggccctagcgggagtccgcggcgagcgcagcagcagggccgggtcctgcgcctcgggggtcggcgtccaggctcggagcgcggcacggagacggcggcagcgctggactaggtggcaggtgagggcgtccccgcgcacggctggggtaggggacgggagtggcgagcttcaggtccaccggctgccaccgagtgatgggaccggaggacaggagaggtcgctcagccaagagccccggggaggcggtgccttctcggtggggtcagcaacggtctctggggggtgcctgggagcggcagccggtctccgccttggcggcccacagccaccgcggacgcctccctcccggatgtctcctcgctgcccttccctggccgaagccctcccctgcagcctcctccccacctgccggccctgtgttctcactgctcttctctgctctgggatccgcaggatgacgtctgtcctgcttcttcactgtcctttacagtcaccagtctcggccgggcgcagtggctcacgcctgtaatcccagcactttgggaggccaaggcggtcggatccttggagatcaggagttcgagaccagtctggcaaacgtggtgaaaaccggtctctactaaaaatacagaaattagccgggcatggtggcccacgcctgtaataatgtcagctatgtgctgaggcaggaaaatcacttcaactcgggaggcagaggttgcagtgagctgggattgcgccactgcactccagcctggcagacagagtgagacttcgtctcaaaacaaaaaaaagaaaaacacaaaaaaaccaccaccaacaacaacaaaaaaataaagccaccagtctcggagtttcaaatctgagcactcttatccatcttaattctttcaataattcagctaaacgaatggggtcctgagaatctgcagagccaggctcagcgctcgcctgcagagcctgcggtctgtggggaccaccagcaagatgaggaatcaccttcgggaggaagggtcgtgctggggagggtcgcgccggcggggtcaagagaacctcctccagggtgggaatcagagcctccgggccgcggtgtttgagggtgagtggaattaatgccgtgatggacatggggccttctaagggggaccaacagtgtttgtgaagagttgactttgggaggggttcaggatggccagaggtggaggctgtgacctcagtgagtctggatcaagggagggggcaggtgggtaagacaccgttttaacaaggtggctttgagcggccacctttgaggggcctaagggcccctgggagatttaggaggaaggacaagaggattaagacaccgctttctgaggtgccgtgtggctgtggcgtgggggtggctgggggagtgggttgtgttcattgtccaaggctctccagcgctttgcgtggcgttttggggagcacagatgaggtgtcccgacagtggggagtggctctagggagaccagaggctcgggagggggcctgggcattagaccaggcacagaatccgaagtgggaagaaatgtgggcgtagagggcaggccttggggatgggtgtgggggaggagggggagatggaaaggagtcagggaggtctcccaggctcacctggaggagtcagggtctcatttccaagtgcactgggaactgcagcctgggggtgggggttcatttggtttcaggcctgtggccaagagacccaccccctcacattcacactttggtctccagtggcttcacaggcaccacctccttgttctcgcctgttttactcctcaccttgggctgtttcttgcctttccattctggcgttctgcagggatcagatccttcctctcacgcacaatctacactcatggcttttgctgggagtaatgagtaaagctcccaaatagatgtttctgagttaggaagcacattaaaaacaaaacaaaacgaagcaaaaccacacaattgtccaagtcccactctgtgttcaagggtcacatgatgtgcagaagctggtgatgggcaggagctctgaatggagttactgggatgtcaggccgcgtgggcctggggcaggctggctgactgggagcagcctggctccaccccggctgtccaggacgcactcacttgcctctatggatgacagctccttgcctcacagctgtctgtctctgggtcagattcagcatctcagtgtcttttgtgtatcagctgaatgtcagggaggccacaggctggtgcccagttgaaaatctcacaaggactctttgtaaatgcatgcaagaataagaacagcattttcctcctcctccctgaccccattctcctcctcagatgggacgatctggtccttacggaaagaattggagttcactgcttccagctctgtgtgtgtgtgtgtgtgtgtgtgtgtgtgtgtgtgtgtgtgtgagagagagcgagctctgcaggcgagccagttctgttgctattgctggtttgagctgctgccatcaccacacttagctaattaccttaacatttgcacttaatttttggccggagactaacagaaaataaatttttctccaatttaaaatacttacgaactttaagaagaaaacaaaaagtacgattccaaaattgccctgtagtaagtaggtcagtaacattcagggagtgtggaaactgcatttctctttattcttcccttccaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggtaagcttgcccgtccgccaggagcagggactggcctgggctgcgtgttctgtcaccagcttcacactcacactccagagccactgagaaaggagggcaggactggggcccgagtgtgcactggccgtttcagggaggcggggtccactggggaagaagtggggcagggcagggaggcaggaactctgctccaccgagatttatttgggggaaactttcctcggttaatcccttggaaaagaccatccaagctgtcttgtcctagcgcagaatctttctttagaaaatgacactgaaattatttgaaacataagttgcaaagaactacctcttttttggagcaagagactttgtaactaaactttcattggtaaggaaggttaatacctgtttcaagttgtttctgtaccaacagctcagggagggcatcaacagaaatttgcaagaaggattccagggcaagtgcttcattacagctgcacactgtgcaggtactgctcagctcagtctcaccaacattcagagaacctgtggaaatgattcaagatcagtgcttgtccccagacctttgtggaaaggagaggagacatacacgtgagatgaaaccgaaaagcgccatccctgagtgcaggccgctggacacgccttcatcatgggagttgtcctttgttcaatatgactgtctttttctttgatgacgcttttcaatagtgaattactcattttaataatttcccagctcattgtgtgaagaagggagggtttatgtgtaaaggctaccagccttaataataagcacagagaggctctctaaaagatatatatatttggaaatagggcattgcaatgaaaatacgcatgccatggcaagctatgtgcacattcagggaggtgaaataacactaagatttttaaaggaaaaagtaaagaggattacataattcctttgaaataattatttttggcaaaaagatcaataacgaaggtgatgtcagtgtgaggttggatggggagttcctgggtagatgtccttgcacaagtattttgttgtgtaaggctgtgatggcctttgtgcaagagcgtaggtttttagagtcctttgtgatagttgtgttatcaggcattcaagcgtgagaaccctctcttcatggccttccctgtctgtttgtcaaaggtttttggttttgtttttttaatattagtgactccattttgattctgaagttccttatgctgaaatctgtatgatctttttctatgttttaggctcactgataaacccttatagaaagcttttttgagagcaccaaaattgtctgggtaccttcttaggtgtgagactgagctctctccatggctccagtgttcaactggatgcttgtgagacaccaaacatactgagtacacgttgctacctgtaacatgcagggaagcgttaatggcagcagaaatattttaaagaattatttatttttccttcattatataactggtaaaagtccactataaaaatttttaaaaaataaaagtagaagggaggaaaaaatccctatgaatccatcaaacagagacaaccacccttgataatgtaaagcatcttcctccagtcctatttctttttttttttttcgagacagagtcttgctctgtcgcccaggctggagtgcagtggtgcgatctcagcttactgcaagctccaccccccgagttcacaccattcttccacctcagcctcccgagtagctgggactacaggtgcccgcccccacgcccagctaatttttatttttagtagagacagggtttcactgtgttagtcaggatggtctcgatcacctgacctcgtgatccacccgccttggcctcccaaagtgctgggattacaggcgtgagccactgcgcccggccctatttcctgattttcacttgacattttgtactttggtgattatatggtatctttacttttataaatgatttttcagctaatgtgaggattcggtgagacagtccatgtaaagcaagtgctcaacatgtgttggctatgaatagtaatagtggtgtcacagcctcaggtgaaattggtcttagcttttggttctgttctatttgacagggtttctcatcaacagtctatgagctgtctaaagtaaatttagtagcttcctcttttttctatgttatagaacagtgtgtattgcatgagaaatagaaattgcttgaatattagaaaaaaaaatccctcaaaagatcatctaagcctttttagaagtaattctctctctccctcttattttttttttgttcattcattgtgactgatagattctgttttttgtttgttttgtttgttttgttttgttttttgagatagagtctctgctctgtcacccaggctggagtgcagtggtgctatctcagctcactacgacctccaactcccgagttcaagttcacgtgattctcctgcctcagcctcccgagtagctgggattacaggcacatgtcaccatgcctggctagtattcatatttttgactggcatttggtaacttataatctgtactttactgaaaataattatatagagtttttgttttaacattccctttgtttatattgctgtaacctctttttcacatataactttactttggggtgctttttcttacatgtggtgggtggctgtctgttttgtatgtatgtgtgttttcttttaaagaaccagctcttggattcattgatcattttgtgtttgtcccaaaattccttgggagtttttctgtatcttttctaacataatgattttaaagttttagcattttattactttcttggtaatattgaaaacaatgctatgttttaacttatctttggccaaactctttggtctaatatatatcacccatattttgattattttctaaatcatatgtcatatacttatttagaagaatttgtttgtttgtttgttttttgagaaggagtcttgctctgttgcccaggctggagtgcagtggtatgaccttggctcactgcaacttccgcctcctgggttcaagtgattctcctgcctcagcctcccaagtagctgggattaccagcaagcatcaccacacccggctaattttcgtatttttagtagagacaggatttcgccatcttggccaggctggtcttgaactcctgacctcaagtgatctgcccgcctcggccccccaaagtgctgggattacaggcatgagccactgtgcccagcctagaagaatattttaaatatttgtttagaagaggattttttgtgttttttttttttttttgacatggtcttgctctgtctcctaggctggagtgcagcagcttgatcatagctcactgcagcctcaaagtcctgggctccagcaatcctcccatctcagccttccaagtagctgggaccacaggcacacaccatcatgcccagctaagtggagatgggatcttgcaatgttgcccaggctagcctcaaactcttgggctcaaacaatcctcctgccttggcctccaaaagtgctgggattataggcatgagccactgtgcctggcctagaaaagtattttaatttttactttgaagagttaattatttagaaaagtgttttcagtaatattttgtaggtgattttcattttgttggcattttatttataatgctgattttttgttactacattgaagttagagaatatgatctatataattctgtatttcagaatgtattgggatgttgagacttttcttatggcccaatatgtgtgatatattttgaaatatttaatatacacacatgtagtccctatagggtacaattttaataactgtgttattgtcttattaatcacattgctcatgtaatatccttgtttccttttgaggattctgatgattgtatttccgtctatttttccatgcattttttctgcttttaactttttaactgcatctttttttttcactataaattttagaggtaattttcccaccacttagggtacatttatattttccttttgatgcaagattttatcacaacctcttttctgagcttttctcacccttgtcattttttgtgtgttactgatctttaaacaagcgagatccattcaggcagaatggctacatcttttactcgcctgttttctgtcccctctctctcctctccccagccatcaaagagctatcttgataacttttaaaattatctttcacaacaggcactgtctttaaacacagaggaagacattcatcgggctttccagtcgcttctcactgaagtgaacaaggctggcacacagtacctgctgagaacggccaacaggctctttggagagaaaacttgtcagttcctctcagtaagttgaatcaatagaacaataaaagttgcattcaacatacctggtgatatagagtctgggagaaagaccctagagaaattgagaaatttatgttaaccaatttaaaaaaattgcactatttttttttctaagatggggtctcactacgttgcccaggctggtcttaaactcctggtctcaagtgatcctcctgcctgttgggattacagatgtgagccaccacgcccagcctaaacttctttttttttttaaagactgcaattctataattataccttgcattagtattgcaaaagtagtctctacttttcttgaaaggtaaaattgaaaggtaaaattctcaagttcatttctggttattcagggttcaatacatacctattcacaaactctgatattttaacatatcttcatatgatcacttttaaagagttatgtatattctttttattaaaaaaagataacatatttagaatttttggaagtttgctgacatttgtatttagcaatgcagcctcactgaacatttttctctccaaagacgtttaaggaatcctgtcttcaattctaccatgctgagctgaaggagctttcctttatcagagctgcagaagagtccaggaaacacatcaacacctgggtctcaaaaaagaccgaaggtcagaatgacaagttattgcaccttcctcccaacccgtcctcctcctgcggctcttcctattcctccttcccgcctcttatatcctctctcctcctcctctccctcctatccctcctccctctcctcacccacctccacctctccactccgccccctctaatttcacgggtgtttcagatggtcagagtagtgttgactggcagggcctcctggcatactgaaccttgatggactcataaaggttctgatcagacattcaggttttcagcaacagagatttacttttgtctattctcccaggaccagagtagctgatacaaatgtcaaaagagggccagccacggtggctctcgcctgtaatcccagcaatttagaaggccgaagtggacatatcacttgaggtcaggagttcgagaccagcctgaccaacatggtgggacccccccccgcccaacatctctactaaaaatacaaaaattagccaggtgtggtggcccatgcctgtaatcccagctgcttgggaggctgagacatgagaatcacttgaacctgggaggcagaagttgtagtgagctgagatcatgccactgaactccagcctgtctcaaaaacaaaaaacaaacaaaaaaacaaatgtcaaaagaatctcaggccaggtttccagtttaataacttgcattaaaatatactctccctggcctgtaacattcacatgtcaggtgactccattgtctctgcgagaaggagattggtggacagatcttgcctgaggtatacacttgggctgcctcttcctaggttctgggggacctccatcaccattacctttacctgctaaggtcactcctgacttttcatgtcttccacttaagctcctttagtttgacttgataagcctacatttgattggttaactgccgaccctctctcagggctgatcagttccacagactgaaaataccctccatttggggttgaaccttattcatctacatttcagaaagtgacgtgttccagtctaggcctccaagaccaatgatggtctgatgaaccattcagactcctctgcgccaattatgcttagtaccaccaggaacatttccatttctgtgaataaatgagacggtaaagaatgggagacgttcttcgcttaaagtctcagcagttgtttcccgcattcctgcttggagtatttaccacggatgctctcttcaggcagtgggttagcagggatgccctcagttcattgaaacagtaccacttgatctccagggaaagaaggggtgatctttgtttgcccacatcctcttttccagggatgcctagtgctttgttgaggggattcagcaggaatatctcctccaaaagcttctggaaactccccatgtgcccaatgtcagctcttcccgctttgagccgtccattctggttgcttctgacatgtccatgtatagtcacagaatgttagaactgggtgtgatcatgaagggttggatcaaacactccaattaaccatgtgagacaaacaccccttcagcctatcacatttcctgctggtcttgttctccaacctggtgtaatttttctactttgtaccaacctgctttcctcgagtgacttaggtatctttcaccatcctcaacttggtggatgttctcaaggtgtcagtaatcatgaataccactcatatgtgctgtttttatttctctacataacaacccaaactcagcaaagttgaaaacagaagtttgcttctcaactaatgatccaggatcatccaatgcatcaggttcttataaaaagcaactgaatgtagtctctacttttcttgaaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggtgggggaagctttttaaaatcctgctagtttgatgaagaagttgaatggaaagatttaactttgtaaaagtgtaagtgacataagcgtaagccaaaaggaatttgaaacttaaagtatttctgaatgaatttcttaactcagtagaaaaaaacggaaggagtaaaagatatttgctgcatatatatattatatatacgtatatataatatatatatatatatgtacgtatatatatatattatatatatatacgtatatataatatatatatatatatgtagtgttttatcactgctcttaactgcctttgataatttctcataaaccattgctgccacctagttttggaaactaaagatcttcctataagcccaatttacttggctagaaagcaaaaaaaaaaaaaaaaaagtgttaaggtagtgtgatatgtgggagtgagaggcagtatagggcagggtagagggagagaaggtgaaaacatgtgtctttaattagttatttttaaaattaaagtaagttttgatttgaattgttaactaattatcattaattcagtatttacagctttttaatattaaaacttcatgacaaagaccttagttttgacattgaagtaaaacttaattaaggcaggcattagaataatttgccaaatcttccagcccctaaaaagatactattttaatgtaattaaaaaacaaaagcaggtaaccctcctgcattttttgtaaggtgtactttaacttaaaaaaattagttctctagttgcaaagggtgggaggaggagaattctaaccctggttttagaactattttaatttttataataaatgatctgtatcaattttttaaagtattacgttaataaatgtaatactttgctgagcttctatgtgcttatgcctcttctgtattttaaaaaagttatttcattagagtatcagaattgaaaagattgggttaaaatacattactacatatgtaggtcgttactctttctgagagagtgtatccatttatactccctgtcatgctgttgtggaactataagtttcatcccactttatgattttttttctcatatgttgggttggataaataggaaaaacaatacacatttttttctaattaaatcaaaacaaatttgtatttaatttcatttgattatattgctttcttagatctatttgctgagcacaatttaaatgagaaacatctttctcctctggaaaatgtagggtatcacattttattttgcagaagaaaacctttcccagggtggtactgtgtctgcttgcaatgaagataggaaggaactggttgactttttttttttttttttttttttttttttttagtgttaactggggcatgaatgtggcggtttccatcacaggtgctgaaaacactcttggaggcaactgcagctcttttgaaagttttaattgcgtctttcaataatccttcccccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtaagacccgggctgcgggaagaacccagggacacctttgcgggcagaactcgagtgccacttccacctctcatattcaccttctgagttggcgatgcggcagacgcacactgtgcaggcacttggcgttgggatcgaacttttgttcaaggctgacttttcccaatattgtctgcgtgatctgccaaactacacatctcagtcctctgttttttcatcgctagaaggagtgggcggcggttaaaatgccttttaaaataaatcaggtaggaggaagcttataaaaatcctgctagtttgatgaatggcagacttttaactctaaaagcataaatgactgctcggggttattgcctcctagagttatgatgaggataaaatgtgggtaattcaggtaacaagcttaccacattgcctggcaactagtaaatgctctacaaatgtgatccattattacaatcatcattcttagcattatgcttttaaagtctaggaacctgaaatagagaatgaggaagtcttaactttgacctaacaaggctgggagggggcatccagggaggtgtgaagtccagttctcagagggtgggaccagaggcagcctctgagggcacatccaggcactcggcttcctttcagcatggatctccagggtgagagagtcaaccatggcaaatggcaggcagtgggaccccatgacttaagaggtctgtgtgcgcagcagccattggctctccctctgcccaccttcctgaaactatgctccggaaactatgcagaatctctctggggcagataatcctctggtaacctctctgctccggaaactatgcagaatctcacctgggacagataatcctgttggagtggctcacactgagagccctttcgtttccaatccttttctttactagcaatggtttgttgtctttaaaaagactatgtttgaaaaaaaaacacagtcgcctgggcattgacacttgtcacaatacaagatgtctctggagttgttggataaggagaggacagccacagccttcctgcctctgagtgcttggtgtctctcccccttgtcaaggaagtggcacatgggacataggacaagtaagagtgctcacaagcttctggcagatgaaggggccactgatcctatgtgaacaaacaacacctacgtgcaaggggaggaagggaactgtgagtgcctgtgcgcttgtacatgtgcactgaagtcggaatcttaaagtctaattctggtctttcaggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattccttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctctgctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggttttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacatgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccaccacacccggctaattttgtatttttcagtagagacggggtttcgccacattggccgtgttggtcttgaactcctggcctcaagcaatccgcctacctcagcctcccaaagtgctaggattacaggcataagccactgagcccagccctagttcagtatcttttatgtaaattataaacatctgcaacattatgtatcatatgcagatacttattgcatttcttttattagtggtgaaagtgttctatgcatttattggctcttgaatttcctcatctatgaattgtcattcacacacctacttttctgcttcgtttttacatatgtctttgcctattaaagatattatccctctgttttatattttctctcattcttgtattgccttttaaattttgttatgatgtttcattaataaacagtgttttgttttcctctataatcaaatctagattttccctttgtgatttccgacaccacttccattcttagaagtacttttccattcataaagtagtaaaataaaatagttttttttctaaacttttatttttgtaatgatttaactaattcacatggaatttgattttgtattattgacattcaggagaaagcataattttatttattagccaatttctggatattgtaaatctatttttccatctttattcttctggtgaattttagaataattttttaatacccaaagtaatttttttaactttcaattttttgggaggaaggattagcatgacattaagcatataaattacttgagtaaattgatgtatttacaatgtttagtcatctcattaaggaaaatgagaagagtctccatttattcaagcccttttctatactacttttattaaaactttttttttgagtttttttccatataaatcctacatatcttttttttcttgttatggctatttctaaattttagtaacaattttaaacaagagcatttcccctgacctgattatggatggcatataagtaaaccattgaagcttatacatttatcttgtgcatgaccaatttggtatagccttttggtaatttaagaattttcagtaaatcatcttggagtttctgctatatgattatgcaataggcaaacgatctttactatgtacgtaacagtatatgcaaataagaaagaggacatccttctaactgacacacccctagtgtctgttttttgtttattgttttgtctttgtcttttttgcattacccaggcaggagacaactttctgtggtttagatatttgttcccccacatttcatgttgaaacatgatccccaatgttggaggtggggtctaatgggaagtatttggatcatgggggcatgaatggcttggtgccatcctcgaggtaatgagtgagttctggctttatttgttcccctgagaactggttgttaaaaagagcctgacacctgccctctgtctcttgcttttgatctattgccttgtgatctctgcacatggcagttcaccttcaccttttgccatcagtggaagcagcctgagtcctcaccagaagcagatgctggtgccatgccttttgtacagcctgcagaactgtgagtcaaataaacctcttctctttgtgaattacccagcctcatgtatgtggtttttttttttatagcaacacaaatgaaccaagacacagagggcacaatcatgacagaaattcttgttccgctctctgttttaatttagaggttgataatatccagtattggtgagcatacgagaaaacaggcatccttaccttgtgtgtgggaatgtggattaagggtttttggaaggaagtgggcagccttttcattttaaatggacattctttttgggccagcatctcacttttagatgtctgatctacataagtatttgcatacatgcttagatatgctaaggttttccctgtagtattttcaaaggcatttttgcagggtaatttaaaaaatcgtggtaaagaaaaacaaaatttaccatcttaagcatttctaagtgtacagttagcattgttgaatagcaaaaaaggaaagaaaaaggaaggaaggaaagaaggtagagagggagggagggaaaaaacaaagaaaatgaagtgtaattaattcaattttaatttttccttcaataggagaagaatttaatttatagtatgaactactatgcagaattttaaaatatcacaataggttcaaatgcacttcttgtaaaacactatgaaaacaaattaagtgaaaaatgtaactggcaatgcaatgtgtataatatgatctcatttatgtgaacgaaaccctgtgtatgtaaatttatgtatacaaatctatggggagaggtttaaaaggtgacacttttcattgctaacagaggttgtctctgagataggtttggggaaggagatgtgggaaaaaaccttccattttttgccttctatatttctgtaatatttaaaattttaacaaggaaaatctaattctgtagcctgcacataatctaaagaaagaagaactccattatacaaccatatatctaatattaagtgacatggtattgaaattgaaataaaatccatataaatggtttttgaaaatatctgtttatccttggtttttataaaagtttttaatgagaatggcatttgaacattgacttccccttttcatgaataaagtctatttctgccttttcttatgtttaagagctgtttttatttcctgttctgtgaattggcttcatatacttcacccatatttttcttcaggagtgtaggcctagtatgcatggatgagtagaagcattttttatactcaaggaattaagccgagcacagtggcacgtacctgtagtcccagctgcttgggaggctggggcggaagaactgcttgagcccaggaggctgtagtgtgctatgattgtgcttgttaatagccaatgcccttcagcctgggcaatgcagtgaggcccccatctcttaaaaaaaatggtaagaaagagattagccttttgtctatgaaatgaatcataaatatatccctagattgttatttgtattttatcttgtttacagtattttcaccatgtgaaattagagattttatgtagtcaaatttatgaatcttttagcttccaggttttgtgactgtttattccttcctcagccaactccaatctggtttgtgctccaccattacacgaaataaatggtcaccaacaccctccttgttcctaagttcaatagaaacctgactttttggcaatattctacccttttggagacttcttccttaagaaacactttttgctttgggtcctgatcttccttctagcttcctggcctctcttgcttagtctcattgtcctgccctttccctggcccatgctttaaatattgctatcccttgcggggctggcctgagtcttctttcatccactttctcccaaattggtctggccctcatcaatgacctgactgccagcccagagctcagatctctctcctgagctccagacccaaatctctacttgctcatcctatccttccatttggacacacaagtatctctacctcaatgtatccaaagccaagattattacccaccttcccaacacaccttcttggattcaccagagcagggatcaagttcacttcatcagctctgcatactggacacctcactcagtgtcttctgctccttatgaattatcagttgcattaaactgaaaggcaagacaatccgtgctgttacccaagctggacaatgagacaccttcttcccccgtcactctgtcatgcaaatttaaatagcaccttttgatactgcctacaggttgcctatagcaatcactcagttgattccaacacatgtattctcacttgtcttccttcctcttcttgcctcctccaacccattctccacattccttgcagagaagtctttcctaaaagtaaatctaggtaatcctagctgctacaacataaacctgcagtctcaatagtgtaacacaatggaaatctatttcttgctcacataaaataaaaaataaaaaatgaggtgtccagtatgcagagctgatgtatatatatatatatatctcacagtttctttacccattcattgactgatgggcatttgggttggttccaggatttttgcaattgtgaattgtgctactataaacatgcatgtacaagtatcttttttgaataatgagttcttttcctctgagtagagggaatcccattacccagtagtgggattgctggatcaaatggtagttctaccttaagttatttaaggaatctccacactgttttccatagcggatgtactagtttacattcccatcagcagtgtagaagtgttcgctgatcactgcagtgttccctgatcaccgcatccatgccaacatctaatgtctttttgattttttgattatggccattcttgcaggaataaggtggtatcacattgtggttttgatttgcattttcctgatcattagtgatcttgaacattttttctttctttttttttttttttttttgagatggagttttgctctgtcacccagattggagtgcagtggcgcgatctccgctcattgcaacatccgcctcccaggttcaagcgattctcctgcctcagcctcctgagtagctgggattacaagcacatgcaaccacacacggctaatttttgtatttttaatagagacggggtttcaccatgttggtcaggctggtctcggactcctgacctcatgatctgcctgccttgccctcccaaagtgctgggattacaggcatgagccactgcgattggccttgagaaatgtctattcatgccagcccaatttttgatgggactgtttctttttttcttgctaatttgtttgagtttcttctagattctggatattagtcccttgtcagatgtatggattgtgaagattttctcccactctgtgtgttgtctgtttactctgttgactgttccttttgctgtgcaaaagctctttagtttaattaggtcccagctatttatgtttgtttttattgcatttgcttctgggttcttggtcatgaaatccttgcctaagccaatgtgttgaaggatttttccaatatcatcttctagaatttttatagtttcaggtcttaggtttaagtccttaatccatcttgagttgatttttgtataaggtgagagatgaggatccaatttcattctcctacatgtggctagccaattatcccagcaccatttgttgaaaagggtgtcctttcccccactttatgtttttgtttgctttgtcgaatatcagttggctgtaagtatttgagtttatttctgggttctctattctgtccattggtctatgtgcctatttttataccagtaccatgctgttttgttgactacagccttatagtatagtttgaaatcaggtaatgtgatgcctccagatttgttctttttgcttagtcttgctttggctatgtgggctcttttttggttccatatgaattttagaattgttttttctaactctgtgaagaatgatggtggtattttgatggggattgcattgaatttgtagattgcttttggcagtatggtcattttcacaatattgattctacccatctatgagcatgggatgtgtttctatttgtttgtgtcatctatgatttctttcagcagttttttttagttttccttgtagagaggtctttcaactcctttgttaggtatagtcctaaggtttttgtttgtttgtttgtgtttttttgcaactattgtaaaaggggttgaattttttatttgattctctgcttggtcgctgttggtgtatagaagagctactgacttgtatacattaatcacatatccggaaatattgctgaattattttaccagttctaggagctttctggaggagtccttcgggttttcaaggtaaatgatcatattgtcaacaaacagtgacagtttcacttcctctttttgatttgatttgattctctgcttggtcgctgttggtgtatagaagagctactgatttgtgtacattaatctcatatctagaaacactgctaaattattttatcagttcta

SEQ ID NO: 737 - DNA, 1117 bp, Homo sapiens
tagcgggagtccgcggcgagcgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtaagacccgggctgcgggaagaacccagggacacctttgcgggcagaactcgagtgccacttccacctctcatattcaccttctgagttggcgatgcggcagacgcacactgtgcaggcacttggcgttgggatcgaacttttgttcaaggctgacttttcccaatattgtctgcgtgatctgccaaactacacatctcagtcctctgttttttcatcgctagaaggagtgggcggcggttaaaatgccttttaaaataaatcaggtagg

SEQ ID NO: 738 - protein, 309 aa, Homo sapiens
RESAASAAAGPGPAPRGSASRLGARHGDGGSAGLGGRPCIMETLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVRPGLREEPRDTFAGRTRVPLPPLIFTF

SEQ ID NO: 739 - DNA, 49826 bp, Mus musculus
  misc_feature (1)...(49826): n = A,T,C or G
tgtcgtgctcagtgttactccatgagccagctccttactgcaggatggggctatttgatggctccaccattcctttaacttgtagataagaagcgcttggtaaaagtttgaaccaggcacagggtggattaaatcttcgttgctcacggaatgttgccaccagagcaggtccagggaaagactatagcttagtttccaacctcatttcccttggcacttaatatggtgtttttttttctttaatttatttactattggcatggtaacctgagctgttgaaccaaaatggccatctggccttccttcaagaaataggccctagcaggtactgagtgtgcaatgtgaaatgtcagattctgtcagtgcccctgttcccaagggatggggcagaatccctcagaaggcctctcaggagataccagctttccctcagaggaggtttatctgtgagagactcggccctagccccaggatttagttatgtaagtgtttagagggggaggggcaggagttcgagattgattgattaaggaagagtttcactgcgaaagattgctttagggcaggatcatatgggtgacttttcttttctacgccttggacagagttctgcattttctggtttggttggttttagttcagacagtttttaatacgaagcatctattctttgagaatcttatgtatttcaagaattttgatttaatttacttctgttcctcctgctatcctcccaaatctatttattccccaacctccccacactggtttgggctttttttgtggaggggtgtgtgtgtgtgtgtgtgtgtgtgtgtgtgtgtgtgtgtgtatgtgtgtgtgtctagacagggtatctctgtgtgtcccagacagtcctagaacttgctatgtagaccagactggccttgaactcagaaactgactgtgcctctgcctctaaatgctgggagtaaaggcacgacccttcggcaatgtaagagagggtctcttgtagttcagggtggcctccaaactccccctgactggcctggagctcttgtacagaatccctccctagtgctcggactataagtgtgtgccaccacactgggcccccttctacattttcttctcccctcccccattacacattatatttattttattactttacatttacatatttattcaattactgtgtatatatgcatatgtgtttgtgccctggcacttgtgtggagatcagaggacaactttctgcagtgggtcctcttcttccaccttcaagatccaggaatccagtggggttgccgtgtttgtgtcacaagtgtgacctcacccatttagctgtctcgccaacaccaattcagtccttttgaaaggactttttttctcaaagtgctagggattgaaactcagagacggttacattctaggccagtgtactaccattaaacagcaagcccagccctttgagaaaaatgtcagtgactttgttcctccttactgcaaaaataacacacacacactttaaatatatgcaaatatagtcacaaagtctttgtatatatataaatgtaagcaaatgtattttatgtattgcaaattcacacatgtaaacttttagaattttttttatttcacctgtatgggtgtgttacctgcatgtgtgtgttacgtgcatgtgtgtgtgcatcactgttgtccttggaggctagaagtgggtgtgggattccaaagaactggagttttgagccgacatgtatatactgggaatcaaacctcagtctattgcaagagcagccagtgctcttaactgctaagctgtctctgtagcccttatatatacaaacttaaaaaataaatgttatgatctagataatctatgcataatgtatatacaaagtaaaacaacctaaactgtatcatttaaacaaaagtgaaagtgtgcctcccccctcagcccaggtctgtgagggcgtatctcaccctgattttcttctctttgttcccatggagaattataaacaggtttccaccctggaggccatcctcccatatccccttgggagctgacatgaactctaacttccgtaacttgcctgtggtctggacaggctctgcagtacgtgccttactcagtacaatgtacacggtgatccctatagcccagacagctggccgtttgccagatggtaaatggaaatgaagtcacatgcctgggaggtggcgggactgtagtccctccctagagatccccctttcgagtcctgctgttaataactgcaatttgtatctctctatatcttgtgactcatttttaattgtatcttttttttttttcagtgtctgtgatccagcccagagcttcatttatttgcttattgtctttaatagctgaatttcatttccctggaggacagtgttttcttgttcatatggctttgcctgtgcagagaatgtacttactagcaatagaatggcttgggcagaatcttgttttgttttttggtttttcgagacagggtttctctgtatatccctggctgtcctggaactcactttgtagaccaggctggcctcgaactcagaaatccacctgcctctgcctctccgagtgctgggattaaaggcatatgctaccatgcctggcaccttgggcagaatcttaactttaaaaattgtgtggggatggctgattgcaccagcaaactgctccgctgcacgagtgggcacacctgctggctacaccttctcatcctcaattgtatccatgctgttaacgcactgagggtggttctagcagcttggggggaaagatacagtcactccagaatgagctgggtgagccagagtgtgctgactcactgggcagagatgtgtccctgcctaaagcctgggagactccaccctggcagcctcaggcctcagaccatgaccatagaaagtaagcctgggtttcctgcttctggaaagcagtcagaaaaccaagcttaagggattggtctgtggctggatggctggagtgttttcctagtaagccggaggcctgggttcagtctcttgtatcttaaaataataaagagaccagaaaagctttggtctcctacaagatgaaagcctgctggccacttgaaaaagagtcctgctggcataggaaggggagctggggagctggggtctggccacaggaggagtttaaggagatggcaaccctgctgtggggactcatatttatcaaagagagtgctgaaaggctttgctgcagtgtgcacagctatttattgtcaagggtacccctcccttcttattctctctctttttttttttctgaaaactttgtgaaaatataagccgcatgctgttcaacttagccatttaaatgtacaatccagtggctttcagtatattcaaaaaaatcacacgtccatctccgtacctaactctgttgaaagctgttcctctcaggcatcagctgcatctctggtctagccagcccctagcctcaggaccaatttactttctgtcactaggagcttacctttctagactgaaaaagtattacaactatttattatttaatgtatgtgctgtgctatgcttgtagaagtcagaggacaacttgcaggagttggtagaaggaagatcctaagatcacactcagttatcaaggttgatgacaaacggccttacccactgactcatcttgttagcccgtagacacagacccattccaaggagtgacatatgaaggttgcatagtaactgtagtcaacttcttttgccagccagggcaaagcttcatctgtctgagtctcacacttccaaacttcccttgtctccaataagggaattctcccacctagctctctagcctcacaaattgccatgagaagccagtaaagtactttctgggcagtgggggaaggagagggtccccaagagaccatagcattacgtcactcttgtgactagtaaatgctgttgctttgatttttattatttccatctttacctcttcttgactggggatctaaaccccaaaagttagggagagcaattgtaggtactctttgcaaacagtaatttctttttttgtttgattgacttgtcttgaggaaggacctctaatgtagcattggctggccatgagctttcttttccatgtaaaccaagctggcttgaacatacagctttctgaatgctggaattaaaggcatctgccactatgcctgcttattttatttgttaaaattgtttatctatacactgtgtatgagagagaacacacgttctatggcgtgtgtatgaggtcaaggaataacttgggctcagttctttcccttctaccacatgggtcctgggaatcacactcctgttagcaggcttgggcacacacagacacaaagaaggctggggccatagctcagtgtttccctggcatatgggaggtcctaggttcatccccagtactgggagaaaaagaatgtcaccttcctgctctagggtggactgtttcatggaggtgctttaaggttgtggtttctttggtgtgatggtttgtattgtcttgggtgtgctgtatatgttggggagtgattgtattggggggggcttgggtgtactctgtgtggggagcttggttgtgctctgtgtgagggcttggtgtgctctgtgtggggagcttgggtgtgctctgtgtgagggcttgggtatgctctgtgggggtgtgtgtgtgcttgggtgtgctctgtgggggggggctgggtgtgctctgtgtgagggcttgggtgtgctctgtgggagggcttgggtgtgctgtgtgggagggcttgggtgtgctgtgtgggagggcttgggtatgctctgtatgtgggggtgattgtatgtgctgtgtacagtggggtttaagtgtactctgtcatcacacatatgtgaaagtcagaggataacgtgtgggaatctgttcccccttctccaatatggtcccagggtttgagctcactgtcaattaacttcacccactgagctgtgtgcctctgccctctattctcccctcctttaaaaaatatttatttacatgcatgggtgttttgtctgttctgtatctgtgcaccatgtggtcaaaggagaacattggatccctttagaactcaagttatagatgtttgtgagctaccatatgtatgctgatgcttgaacccagagccgcagggagagcagtcagtgctttaaccacggagccagtcttccttttttgagacaaggtcttgccacttgctggctgactttgaactcaggagccctacccccaccccgctgaggggctagagctacttttgcatgccactcttcctgactccttcctcttttttatggcagaccttcagcagctgtaaaattaactcgcctactcagcaggtgagatttaaaattgtttgaactagagaatattgcactggtggagacttgagaatcatctcattgctgggagtgtgttagcatgtgtgaagccctgggttcattcctagcagcatcaacagagactcattttacgttagttttgtttgttgactttggtttacacttgcatggctgacaacatagttcaacagagactcattttacgttagttttgtttgttgactttggtttacacttgcatggctgacaacatagttcaatggtagaatgcttgcctggcatgcatgaggtcataggttcaattcccagcaaaacatatgagcgcatgtgcatacacacatacactcactctcacacaaagacacacacacacacacactcccatatacacactctcacacaagtacatggacagacagtgagagagagagtctgagacggaaactacacatggcaatcctggattatgttctcattgtaaaaattatgtagaaagttgtcctggcctgatagtaaatctatcacaccagtgacagtgagcgcaggcagtcgcccctgatgattgtcatctcaactaccttctggtgggagtagagatctattctgggcacaggggccatgaaagacattggacaccggtacccaacatcttcattcttactatccatgaaagtgcagaggttccacagagccagctgtgatggaatcagaagcaagggacccagatgttagcactagaatttgggtttctttttgttgttttggttttgttgttttgtccgctgtgagacagcccttgttgctggcaatggagtcatcattgaagacagacagccagagaaccatgtctccacaagtgtagacatgctcagaaggacagacagcccccatctccccagacagacagatgagccattcccagagctggactgtaagagaggacagtgatgtgccttttaaagtacagggagttcagtaacaggtttggatgtcagcaaaactgcagagagtcactcataagagggggggaaatgaatgcaagcttaacgtctaaccacggagaactgctgaggagccatttctgtagcaagaaactcacagtgcattatctacactgttgcaaacgtgcaaattttacacttccttcacataatctcccattaaaacttgagtgacatattcactgctcctcaaatataacttacaaaaacagtcttggggggccgggtgcaatttctattttttttcatttgtctcactgctgagagctgagcccagggccaagcactctactacactgacctgtttcccaggctcccagactttaaatctggcccagtaattacattgaaatcaaatatatatatatatatatatatatatatatatatatcctactgagattgcataagtatgcagagttgtcgagacagaaatgttcgagtcagcactgtttgtactgggacattactggaagacatccaagtctgatctcctggaggcaaatgcatggggtacacctatacagctctgtatcccacggtcctgggaagggtgaggtcggccagcagtctgtacacttgagctgggagggccatctaagactgagtgtttagtgcagaaagtaggattcctaacaaagcgaggcacatcttaacaaaggcagaaaggaaacttgctgagtgtccctgcaagtgtcagcccaggaggggctatcggagaacttccgctttctgattcagaattccatagtgctgtggttttcatgcagagcagatgatccttttgaggtgggggcagttaaaacactaaataaaatatgaagactcaggggtctacttacatttcccaaaggatgtaatttatatttgccacgttagtccagtcttatttttaaaaaatgcatagaacaaaactggaaggtacagaccgtgcctactggtgtgggctagactgttcttttctgtatttgccaagtagttttccttaatcctaaagtagctttcagactggaaggggaaaaaattctgagctttgcagagattggacagcctcctttaagggagctctggctgtgtgtgtgtgtgtgtgtgtgtgtgagaagtctcagctcctttccctggcttattctatttttaacagggtccccgtgaggggtccatgctaggagggtgggcagtgtgcagccctgctgaggcctgggaagctggacgtcttccaaggatggccaggatactgagggacaccggtggtgactaaggcagtctaaaattgctgtcccctgactgccccttccctatctcagagctccttctgacctgtctcacccagatgatgcccagtcttctacacattatcctccccattagggaggacccactggcctggaggggagtttgggtcttggtgattctggggaggccaccaagcaaagatttgagtttcttaggaagagaacaccatggactaagggtgttgcttcagaaagggcagggaagagtccactttggtttccccaaagcaatacaatggactgaagaaagttaaaatgggaggatgctaggtctgtctgttttctgtagctgtaacaagacaacagagacgggatagtttatagctgctggctgggtatcttggcacacacttttaatcccaccacttgggaggcagaggcaggcagatctttgtgagtctgaggccaggatggtatacatagagagttccaggatagccagggctacactatgaaaccctgccttaaaaaggaagaagtggaggaggagacaattaattaattaatttaaaaatttcttgttaaatagaagtgtatttagttttataagattgaatctcggggagtccaagagcactatcctggcatcttccatgtgtctggtaagcgtcttgtcgggctgagtcgtcatatggcagagagcatcatgtgacaagatgcagtggctgtattaaccccgatctcttcctcttgtcatgaagccactggtgctccgtggggctgggatcaggctctggctccctggcatcctctactccagtcaactcccaaggttcccatctctaaataccatccacgggagaggtcagggattgagtttccaccatgggaggtttggcacacaccacaatgccatttaacagcctttcttcctttcccttctcttcctcctcctctttatcctcctcatttttctttctttttttgagacagatctgtgtagtgtagcactgtccaccctgctactttctaggatgacctcaaactcatggtagtccacctgcctcagcttcccaagcgctggcactacagatgtgtaccaatatgcctagctgtcttagccttctaaatgaagcagtccttgccgtagctcttaggtttgggttggccagatcacaaaatgcagcttgcatttgtgtgagagtgagcctgtgttctgcttctgtgggggattcatgcatggaggaggagctgggtgaagttaaggaataagggttctgttgttggttttcccctagtatagagctctttagcgaggtgccttttacagagtctgtttgcatagtattgtatcaagaaatcagtgccctggcagattcttactacagatgtgtaaacttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaccaggctggccttgaactcagaaatctgcctgcctctgcctcccaagtgctggaattaaaggcgtgcgccaccactgcccagcttaaaagtgtttgtgtgtgtgtgtgtgtgtgtgtgtgtgtgtgtgtgtacgtgcacacacatgtacatgcacatgggtttaggtacctgaagaagctagaaggcagcagatcctctggagctggagtaataggcagttgtgagctgtgtgatgtggatgctgagaaccaaactcaggacctctgcaagagcagtgtatgttcttacccactgagccatttctccagccctcaaaaaaaatcttattttcgctttcaacatttcggcagcaagggaagaattgtgtaattaacatgtcagcgacttctgtccataggctaagcctgtgagaacacactgggcccctccgggactgttcttcatagggcagaggatgggaatcctttcttttggatgctgtggtcctccccaggggacataactgaggaagaggcagctggctgcccttggcccgggcctcacgctcgctccccttgccttctgcaggaagcctggaagcatgcgatcgagaaagccaagcacatgcctgacccctgggctgaattccatctcgaggacatcgccacagaacatgctactcggcacaggtcagcagtttgtcccaggggctttgaggagtccttgcgggagattggggtagggggggacttggggtcctgcttctggtcaaagaaaaggaactaatatagcaccccaatttcagattcttacagcctgtgggattgttagaagtagagagatccaaccagttaagtctgtgtagacgttcaaaattggaagtaatctgaagtgtgaaaaacttttgattctaaatgttttagatggggagagggaggcagggaaggtgcatctaggttccgtttgaagttggttgagaggtgggcagcttctcagggcaagtcaggggtccacgttccttctgaactgtgacaccatcatcccaacacttgtccttgcaaacaccagtagagacagacagtatcaagcaggttttgacccctggtccaggtagcaacctcacttttccttggctagcactctgccctctccatcattcctgctctatccttcaaggagatggctgcagagcctcctgtgtgcctccttcctactcaggaagcccacctctcagtgtggggaaggataggtcagcataggagagaccctagcatgtgagggataagtagattctccctttctactgcaacagcactggggtagcaagctgcccagactctggggaatctccaaggaaagagggtccctacccaagcttggctctgtgtcttgaaccccagtggggacctgagaccaggctgaactgcttacttcctaagtaaatggctgagtttatagtacccagatgccagtgagaggatgccaacatggctggctttctagaacattctgatctcttgattccaggcatggctgtccggaacattctgaaaacggaagcttccttctttggctatagctttttaagattaaaagtcttggtacaagctggccctttgcttaggacgggttttcctgtctctgagaactgtttccaggatgggtgagagatagattctgctttaaacttacctgggtttgaatcctgacgctcagacaggggacctcacctgtgagccagtctctacaagccaggcacaaaaattgtcaccatctcagggtctctgcagagatttaatgaaacaatctatattttaaatttacttatttattttatgtatatgaatacaccattactctcttcagatataccaggagaaggcatcattggatcttattacagcattatagatggttgtcagccaccatgtggttactgggaattgaactcaggacctctggaaaagcagtcagtgctcttaaccactgagccatctctccagccccgaaacaatctatttaagaatccagcatataataaacactccataaactttaggcacaataggcatttagtcattcattcatccatccattcatctattcacctactgtgttactggggatggaacctagggcttccttatatactagacaagtgttctctacgtggactgctttcccagccgtcatctcatgtttattttgagacaggttcctcctgagttgcctaggctgactttgaactatagagcccagacagacctcaaacatggctattcttttgcctcacctttgaaagtaactggggctaaggtctgtttcagcagtcctggctgactttaagatgttagtggttgtgagcagtgagcaagacactctcaaggttgcacactcacccacttcgccagcctctgggtgcatctcagagtggaggtgagggtgcagtgcatctacggcctccacctgtgtatatatagtcctgtgtagacgatagtgcttgtctccctctggctgcaagcagattgacagcccaacagagccctctcctcagcctggggtaacctgccaggcttctgttcctctctgcacaggttccagctctcaaaacctgttctctcaggtctgggtgttctgggccaggaagctgctggttagagataagggctaggtcctgctgaggtgactcactgagataaggaaccctgccaggcgagcctgtttaagagcctgtttaaggcccacccggcttccccaagcctgaggtgctctgggaacaaagattcctgggagtgggaaggtgggactattctggaagcacctctccttcctacctctcttcctcctttgttccatttctctcccatccccctctcttacgccacctgtctccctctctcttttcctctccactctccacctcactcctcctgtctcaaacaccttcaatctcttaatcagccccttcctctcccagtctctctcctgtctccacctctatcacatcccaggttccccccacccccactcttttcacagtctcttaggttgcctcaggcaagtccttcctcatcctgtcccctgtcccctccctacactgcagcagtccttacctcctgagagagagagctacctgtgtgggctatgcctggctcaggtgcctagtgtagttgagacactgctgcctaccgtcctctctgagacctgcagtttgtgactgttaggactcaggcagtccctgtatccagagctgctcttcagtcctgcttgagctcatttctggatatatggactggctcttggacagcttacaacctaacagttatatggtccagttataaggacacatctctagccatccatccagcatatgtttattaagcatctatacacaaggtcctgtggtgaacaagacagatatgggtcagttttgtggagttacaccctgatgaaagagcagataagccagacaggaacccagcagggagggctagtcttggtgaaagggcaacaccatgcagaaggagtaaatgtgtctgaggaaaggcaagtccccttgaaggagggaggggagtgtccacagctcgacccaagggtcagcaagcccaggtgcagagcaggctggatcctaaggcctatagaaagcccaggagagtttgagctagagaggggcaggaccaggatgctctaggtgagctctgatctctgtaggtacaacgctgtcaccggggaatggctgaaagacgaggttctgatcaagatggcgtctcaggtaagcagaggcctgagctgtgagggggcagggccccgtagggactttcccaggctgttttatgccatcctttcactcctgcttgatttaattttgctttttacatttctttacttttcttttttcttttttttttttttcttttggtttttttcaagacatggtttctctatagctctggctgtcctggaactcactctgtagaccaggctggcctcgaactcagaaatccgcctgcctctgcctcccgagtgctgggattaaaggcgcacgccaccatcgcctggcctatttttatttacttatttattgtgtgtttgtatgtgtgtgtgtgagagagagagagagagaccgagagatagaaagacagagacagggatagtgacagggacagggctgcctttgaaggccaggctggctagcatcacactcatgatgtagagtaggctggcctcaaactcacaatcctcctgcctccacctcctgcttgcatgctatgaactcacttcaatttttttttttaatctttggagtttttctgtgttattgtttaaatattatgtttttaattgtatttttacttattttgtgtgtgcatgtgtgtgtgtgtttatatttgtaccacagaatgttcctggaggtcagaggacaacttgtttctctcttttctctgtgtggatgcaaggcatcaaattcacattgttacattaggcaggaggcatttatacttgctgagccatccaccggccctatattgtgttcttcttcttcatcatcatcatcacatttatttgtgtgtgaatacatgcatgctgcaatgtacagtggaggtcagaggacaacttgtgaccttagttctcttttctttttctttctctgtgtgtgtgtgttttttgagacagggtggtttttctgtgtagccctggctgtcttggaactccatctatagaccaggctggtcttgaactgagacatctacctgcttctgcctcccacaggttgggatcaaaggtgtgcgctgccacgtctgacttttttttcttggttctcttttcatcatttggctctgatcaggctcagctgcaagcaagtttaccactgagccatctcaccagcccacatttcatgtctttacatactagtccattaacatgtatgtcacatatacaaactgaccacttaatttacatagttcaagcttgggatgcaggttatcctcagtactgcagggggagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaaggaaagtatgtaattcagtggcttttagttactcagcagtcaccactgaattccagaacctttccccctgttttaaatttagtacaccggacactcacacataacccacagaagaccaagccagcccaaatccctgcatggactggggattgcccaggaggctccaggcctagctgaggatgtgttagacatttctacccttcctgtccactccattccttcaccattccactccaggaacccctggcccactttctgtattgtagatcactcagttttaggcatttcatgcacaaagatgtcacgaaggcttgtcagtgagtcattgccgttggactgacttacatggcattacccggttttgggattttggttggttagtttgtttttgtttttgttttgcttttgtttttgagttttagctactaaacacattcagtggccctgcaaagaaaaagaaaacaggactggaaaaaagagctcgtcctctgagtgaggggacctcttacaatgtaaagcacacattcaggctagagctgtgccttacatcactgtgtaagtcctcggcatgtgggaggctctgggtcccatccatccccacagcgagaagcaggcaaagcctgtatcttgatgagtgttggcaagagcacgttggctcagagcgcagtcagtgtccccacaggctccttcagtcacggctcatctaagattcaacactatcccaaaccctctcaccctgactggtctccctatcctgagacttcccccatctggcactgcatcttctgagtatggcttcttctactcaacattttcagtttctttactttgctgtgtaatccttccttgaaagaataaacctagttggtttactgatggatttaggttgcctgtctctctcctctcttccctgtttttcttcctttttttttttgagagagagagaatgaatggatgtgtgtgtgagtatgtgtgcacgtgcatgtacaagccaatgagtacggtgccctcagaagccagaacatgaccctaaagtgatgttacaagtggttgtgagctgctgacatagatgctgggggctgagcttctgcaaggcagaaggtgttttaaactacccagccattttttgttttgttggtggtggtggtttttggtttgtttgtatgggtttttgtttctttctttgttttaagatttatttattatatataagtacactgtagctgtcttcagacacaccagaagagggcatcagatctcattgcagatggttgtgagtcgccatgtggttgctggaatttgaactcaggacctccagaagagcagtcagtgctcttaactgctgagccatttctctccaggctccgtgtttttgtttttgtgttctgagacagggtctctaatctagtcccggctatcctggaactagttgtgtagaccaggctcctcctttcactgcctaccgagtgctgggattaaaggtgtgcatcactacacctggcttacatagtcattttaaaggttcattttggcttgtggtttccgaactttcagttcgtggcctattgaccctgttgctttgggcctgtgtgagcacagtgcgttctggctggagcacgtggcagaggaggcctgctcacctgatggtggccaggaaacagaggaaaagccaaggccatgaaaacacccttttagtaccctgcccctccccaggatctgggctccacgctgtccgttcttccattgggttgagatgagttattgggtgccctcaatcccagcagcctccaggccgaaaggcgtctctggctttggtaccgaggcccacgagggacagcctagggttattgggattgaagtaaagtacaggacacccactgggcagtctgtgacgaggggatcgtgggatcgtggggtgtgggcactgatgactctgtcctgtcttttcagcccttcggccgtggagcaatgagggagtgcttcaggacgtaagtgacttggcctgggggcttccgccaagactccttaaagctaggactttggggaattcccaatcaaaagctggggacacgtgacctaagtctccttgtagcccatgttcttctccatctagtgtctgttggacacacacacacacacacacacacacaccccacccagctgcagggctctggaaggacagggtatatcactcacctgcttgggtatttggaggcacagggagtcaggtgggaggccacagacactggtccttcccctctgactctgggtggaggagtggagggtgttgcctttccttatctccttatctttctttcctatactctcttccttcctccacccagctgtgtcacacagggtctggttgttctgagatcccacagttgtgtcctcagtgaacccctggggtctagacaggctcccccttgtctttctctccaggaagaaactctccaacttcttgcacgcccagcaatggaagggggcctccaactacgtggccaagcgctacatcgagccggtggacaggagcgtgtactttgaggatgtgcagctccagatggaggcgaagctctggggggaggattacaatcggcacaagccccccaagcaggtgcgtgagccccacctgcctccctcccaccaatggctggccagccaccagggtgaaacacagggctctgtcttcatctctacagtgcaagggattaaaagctgagctttgcctatgctaggcaagggctggaccatggagccacatctcaaacccctaacagtttgagacagtgtctggcattgaacttacggtcctcttccctcaggctctggattacaagcatacaccactgtcttagttagggtcttactgctatgcacagacacctgaccaaggcaagtcttataaaggacaacatttaattggggctggcttacaggttcagaggttcagtccactatcatcaagggagcatggcagcatccaggcaggcatggtgcgtgaggagctgagtgttcaccatcttcatctgaaggctgctagcagaagactgacttcccagcagctgggatgagtgtcttaaacttcacacccacactggcacacctactccaacaaggccacacctcctaatagtgccactccctgtaccattacaaccaccatgcctagtcctttgcctttccgaccagttgtcagaatcaccattttgggagcgggtaggcatggtaagccatgtacttcatatgctgcggatcatttattcctaaaaacaaagctgtgtggttggagcatctttatctctgtgaatagatagatctgttccttatgatatttataagttgattttttttaatctctttgtggtgtggctggtacacacatgccacagcatgtgtatggaggtcagaggacaaccctctgtggtttgtgttcttcttttgccatgtgggctcagggactgaacttgagtcattagcttggtggcaagccccttttcctgctgagccattcatgtccctttcatgagttttgtttgaaactagatccagcacggctggtaccgaccatgctgagattattaggaatcttggtcccggtatctggtttggcatcactctttcatgtggcctattggtcccaacagctacaggctcatttctcaccaaccttgttgggatgacaatatcttatttccaagaagttccagtgaaagcatcagagctaagcatcattggctctgattatcaggcacatatgtgtgaaccaatcagagtattcagggggtgtgggtattcagatgaggcagcctgagaactgtggtcacccaggctatacagactgggactggggccatgatggcttctaagcagtagcagtaggtatggcaacgtgtgtaggcttcctgaggaaccaggctcagtgaggttagccaacctgaccacccaggcagggatggagtttgtgctccaatctaggccttcctatcctctgccagattgctaccttctcttgccccctatcctaaccaaaactacttcttgtctctggacataagaaaacatggctttctgcctctgtccttcatccatagtttgagtagctattggacacagaccctgggtgcctcaggaaagcaactctttcatatataaagtgaataagtattaataaatataataataatgataataagaccacagtctactgggtatagtggcacatgcctttaataccagcactggggaggtagaggcaggaggatttctatgagttcaaggccaatatggtctacagagcaagttctagaacaagccagtgctacattgtgagacactatctcaaacaaacagacaatgataacaaaagaagccacagtccccactctcaggctatgacctcaggcgtttgctctgctctggcctcctttctcttccttccttgcttatttcctgccccaggacctttgtcctggttgtgccttcaagcctgcattagttccctaatctttatatgataagcttcttctcacaggccagggcccaacttacgcctcacctgttacccccagagtaaggccttcagcccatcctaagtaagatctccctactaaccactcagctttgtcatgttattctgttttggtctatttttcctttctttgaagcattgtgatctaaaagggacctattcacttagttaatattttagtatacccctgccgccatgcccctaggatttcgtgtcttgtttgtttctgcccccagtgcctgggtatcgagtgagtaataacaaagctgaattaaatgagtgtggttatctgaccgggtgtcgtttgcccactcaactgtgttctgccacttaccaagccaaccctctagctagccttgcttcaccatccttgtagggagggagccatactggacataggacccttcctggagctctttgcccttcccctcagattggttctcagaaccgcagctgtctttgctaaaggtctcagctgtcacctcagggcttaggttgcttctgcagctgtttcttgtctgtctgctgaccctcctccctagaggattgttgcttttgaagcctaaacctggttctttccatgttatgggtggtactgagagccataggagccatgcagattcctcggtcattagaagccacaggtcagggctggagaggcagtgcaggggttacgagtactggctgctcttccaaaggacccaggcgttcaattcccagcacccacatggcagctcacaactatctgtaactcgcagttctagggatccaatgccctcacacagactcatatgtaggccaaacaccaaggcacataaaataaaaataaataaattagaagccacaggtctcttttactccactttacaacccatacataatatatacattagcaactgtgtataacattcaatatatacattataaaaattcagctaggcatactggtacatattaatccagcagttgggaggcagaggcagacagatctctatgagtttgaagccagccttgtctacatagtgagttacaaagcaaccagagctacatagtaagaccctatcttgaaataccaccaccaccaaaataaatcaattaaaaaaaaaaaagttaaaaaatgttggcgtttcttgtaattccccattgcagaggggaaaaaaaaaagacctttcttgttgggaccaaatgtgttacaaagaacagcataagaagggttaatttttgttcagagttggtacaagaggtctatcatcagtaaaaagaggccagtggtcaaacagacaggaaatagggctgggctgtaaagtcctaagggctgcccagtgacccacttcccttggtggaacttcacttctgaaaggcaccatagcaccacaatatgggacaccgtgtgtaacggcttacactaacaatagcatgaacagtgacctctttgtgcatcagtaaatataatctttgtgccaagtctgacttccctgtatctgtacacaaggaaactaaaacacagccaggtgtcgatggtggcacacgccttagtctcagcactcaggaggcagaggcaggtggatctctaagtttgaagctagcctggtctacagagtgagttccaggacagtcacagctacacagggaaaccctgttttgaaaactggaggaggtggaggaggaggagggggagaaggggaagaggaaaaaaaagaggaagaggaagaggacaatgacaacagaatgacacaaaattacttgcccaaatttgcaatattagtgccaggctcagtctgagttgctagcaaacagatccataaatgtgcccagacacaaaatggcttctttctaatttgaatgaaagttgctctgagtatgctaataccttgtgtccttgaagtcatccagagacctggtaccttctgtcctgttactctgtcacctcctaggactgcactgaccatggttccagttatggctcccaagcagtctccttgcagggccagatgcacttatggtgttcattatttctggtgttcatttcctattggctaggtgtggtcacatggtcacacctagctgcaagagaagctactcagtgattccctttgtgattatgactgtgcatcccactaaaatctggagatggtgatcttcatacttaaaggcaaggggaaagtaggttctatgtacagttagcagttcttgcaagagagctgggctcaggtgagcagtgtgctcccagcccagcccttccgcgtgaccctgctccctgctcttctaccaggtggatatcatgcagatgtgcatcattgagctaaaggacagaccaggccagcccctcttccacttggagcactacattgagggcaagtacatcaagtacaattccaactcaggctttgtccgtgatgacaacatccgactaaccccacaggtgagcctctgggcttgctctacccacactgtcaccctccagccccttgggaagagagggagagccctgtgggtggagcctcacatcctcaaaggctcctcacgtccgttggaacatatgtgatcccagggctgcaacatgttagacatggtatctgtcctaccacagaatagtatgcccagctcctaaacaagactcccctgaccttttttccattttcatatgtatgtctgcagtatgcatgtgtgcatttatatctacatgtgtgtgcatgcagctgtgtgtgtgtctttgggcctacatgagtctgagaatcatccttaatcattcttctaccttattctttgagacagggcttcttaatcaaacccagagctcactgatatggctagctagtctttctagccagcttgttctgttgattccatccctaccttctaaggctgattccctgaggtatttgctgagttggttagacaaacccagacatccttcttatgtcttttactctataaaacccttcttgcagagagcaccctcaacagggctgacctcagcctcttcccagtccccaatctggtctgtttacaactgtcttctcttcctgccctgacataggccttcagccatttcacatttgagcgttctggtcatcagctgattgtagtggacatccagggtgtgggtgacctttataccgacccacagatccacactgagaaaggcactgactttggagatggtaaccttggtaagtggggagagccagccatgtcctcgggagccatgtcccctaaacgctgttagttcttactacacccaaggaaacatactgagatatactaggccttcccaagatacacgggtgggagcttggcttgcctgatccatgacccccttctgttcagcatttgtcccccctgtcctggccacatttctagtagccccactgtcctttgtcactgggcaaaaaagtaagacaccatcacccctgttctgcctgcaggtgtccggggaatggctctcttcttctactctcatgcctgcaaccggatttgtcagagcatgggccttacgccctttgacctctccccacgggaacaggatgcggtgaatcagagcaccaggctattggtgagtactcagtagcagtttgctcggctggccggtcctgccaccaagaaagcaggccctgtttcctgtgggatggcattagcttggttttggcctatttatgaccagagtgaggaaaacgggcagaaatagaagtgacagggaacatgcgtgtgtgtatgtggacttgaatacactctcaccacatgtgtgtgcatgtatgtgcacacacatgtgtactcaggtacctttttgtacacatatgtgtatgtgtgagtgtgagtctgtgcacattaacaaatgagtgactagaccctctgggcctgcccagtgtgtactgtggaccacttggcttactcttcttataagaaccaatttaggagactactagcaagtaccagttttggcctctgtgtgtccattggtgtatacttccagctcagcctgcggaatacagcagtgctttaggaaacacaggctagtagcctctttgagatctatccacttgccccttcttggataccataggattaatcctgagctgatttttttttaattccctattaggcatgtataaaagccatgaatcgaaaggcttcagggttccaaggagccctccattccctatagcacgcttacatgacatgaatcccccattaatgtccccagcaatcagccaagaccatcttgagggggacagaggagaagtgtgggagtccccgcataaggacactctctagcagccggccccctttgctccttcgcctgtcagagaactccggggatgagaacatgagtgacgtgacctttgactctctgccttcctccccgtcttcagctacaccacacagccagaaactggaccacctccgtaagtcatggtttggtcccttggatattgtgatcatagcaggcaggcacaaagtagaacatggtaagaaatgaaacagttgagcccagatggcttaaacaacagtaaagtaccaccaaggaaagactggctcgtcatggttggctctgagaatcattctgcattaggaaatctgttaatatttataagctgaaagagcagagctgaggctggcaagatggcccactggagagaggtgctcaccataaaatactttaaccattttttaaagaactatttagaaatgtaaaagtcatttctatgaatcgtgtgtgcatggatgggtgtgtgctggggatcaaacacaggcctcattcttgttttgccttattctgtaccattgagctctccccagcctgcagacttaataaaaatggtcaacctgctgagtgtggtggccacacgtttatcccagcgtttgggagactgaggcaggtggatctctatgaactcaagaccagcttggtctacatagtgagttccacaacaaccagagctacatagtgagatcctgactcaaaagccaaacagtaacaacaacaacaacaacagtaggtcagccagacatgtaggctgcagcttgcttagaacaggagacagaatggtgacaaccgggagaaagttggcttgacagccatgtggtgcccacactttgggccccacagagacaggtggcttctcctccactgtatctgcactgccttcagagctgatgtgctggtcagcacattgtatgtaaagctatgcacacagaggcgcagatctgtcaagtggcagacttagggaggattgagaaagaactatgcttctgcagtggtgccatgatcctttcccatgttgtgcttctctttgaaaaccaaaagtgaaatgctgaggatagtggtgcacacttgtaaacccagcacttggtcagctgagacaggaggatagccaggagttgggctacatattgagctttggtgcaggtgctgaaggcaggtcatatgcagctcttaggcatgtcctacatcacctttgcttgtccctgctcagattggccagtgtttggtgacctcgataacatgggccctagagaccatgaccgcatggacaatcaccgggtgagtggggaggagggagactgctggctgctatccgttcagaatcatcaccttgaccagatggtattttaaagagctttgatttctctttttctttttctttctttttttttttttaagatctatttattttgtgtatgtaagtacactgtagctgtcttcagataccagaaaaaggtatcagatcctgttacagatggttgtgagccaccttgtggttgctgggaattgaactcaggacctctggaagagcagtcagtgctcttaactgctgagccatctctccaagagcccttgctttcttacttaactctcagaatgaatgacatagacttttcttatttcctctgcaaatagattttattctagaattaggtgggggctggggatgtactcagttgatagagtactgtcctagcatgcatgaaaccctgagttcaattcccaatactacagaaactgggtatattggtatatacctgtaatcccagcacttgtggaggccagaagttcataagttcaaggtcattcttggtgacatagtaagtttgaggccagcctggggtatgtgagcccttgtctcaaaacagaatcagagattgtctacgtaaatgaggaaggctgatttcacccaatgtttcctagggttcagccccattgttatttggtttctttaatggtgtgtgaggatgagacagaacccagcatcagaagttgctcacttcatggtggccaggaaacaggggtagggggcaggcagcaaagaggccagaaggatctggggataaaaggcatttgaaggtgtgcttcagtggtctgcttcctccaaccaggccacacatagtactaacccattcagctataaactcatttgtgaacaccattgatgaggttagcgttctcaggatccattcagctcccaactagccgcagactttggggggctcatttttataccaaatcataacaggccttcagtgaagatgctagaatgaatccccacagccaaggtaactgaggctcagggaagttgagcagttgcccagatcttgactgctgtgtagcagagccaggggttggatccagggatcgggttccagggcttaagttgtttgccactactctctggtctcctgaccagcaggaggaagactgtgatgagtgaggtgataaaggagaggaagcagatgactaggatgtccccgtgtccttaccaccaggaactcgaaggctggtagagccctaagaccgccttctctctgcaggactctgagaatagtggggacagtgggtatccaagcgagaagcgaagtgacctggatgatcctgagccccgagaacacgtaagcaccccaagaccctgaggccaaagacctctgttgcctcacctgttatccataaggataaaaacctaacaggccaacgagagctggccccgatgacacataaaatgaagacgacaaaccagatttcagacagagacaaatgcagggatgaaggtgaagtgcagagactcggccagaggaaaaaactagccaccatttccccagtggcttctcaccgactcttgctaccctggggtcagtcagcctcctcacacagagacaggaagactgtgaacacaacagctcggtgtacaaaggttccagcttccctggggagcagaggactagtgttcctagagaagggatcctgcaggggtgcggggggggctggttctgctccccaggaattggctcccccactacagtctctcaatctctgctcccttgcagggccactccaacggcaaccgaaggcatgaatccgacgaggatagcctgggcagctctggacgggtatgcacacataggagcaggcctgcctcttccggctcttttcgtgccccactctcctcctgacacactacccgccccttcaccttgtatatgcccattttacaaagggcaagtgcgagaccatgtcctgggctgggtgccaagagattcctgggaaggggggaagaagatggtcttggaagaaagtaacaggacagctcaggcgttagagagcctgacagggaggccccagcatttgctgctctctccttgcctccacctggtgagatctgtgctgagttgttcatcatgttgtttatatgagagacctggagtcctgggcaactctccccaggttactggccactccaggatatattccgtatctgaaatgcttgagctcagaaatgtcttagatttcagattagttttccatgtttcatgtgtgcacatttgtgtgtgtgtgtgcgtgcacatgtgtgtatatgggtgttgtacatgtttttgcatgtgaatgggtatacgtatggaacccaaggttgatactggaaatcattctttattactcttacaccgtcttcatcaagggagggtctctcaatcaaacccagagcttgcggatctggttagtcttaagagtcatcctgctctgggggtcacgcctttagcttcacaaggggctgtaattacaggcttctgagtaggcgatcgctcttcagacttgtacagcaaatactttaactactgagccattttcctaacctcagattttagattaaaacaaaacaaaacagaaccagggtgggggttacttgcagtttacagttagacaacttgagagggggcccacaatctgaccatgagattccttgtgcatgtttcatacatatttaaaacatgaaggctgaaggtaattttacacttttagtgtgcttgtctttgaactactgtgtgcatgacaagtgtctaaggcacgtctaggaaaggccagccccactgctcttgttattctgattctcaaacatggtgtgaacctcacacttctccatgtttgctaagttgggtctctcctgccctcagagtccttcctcccctaatgactgattcccagagacgccttataagtctgatcactccaacatcgggactctgtcctctgctcatggtcacatgaagtttcctcgccctggagtaggacagagttgcttttggtgctctgggctgggtccttcttgcctggtgacttcggggcatttagatgactgtgttctgtgactgtgacgtgtctcatcgatgttgtgcatttcatcttggttaaattcagagagagagagagagagagagagagagtgcaagtgggcttgtggtgaggaagagcttaagaggtttagcatcaaacctcagctgcagttccaagctgataaatgaaggggagggtttctcagggccactgtactctgctctgttctgctggtcattgtgtcttgttgctgccctctacccatgagctggtagcaatggaataattagaatcagaacctggtggtgtggggggtgcttacttgtaatcccagcacttgagagactgagaaaggaagatcctgagtgcaaggccagccaaggatacatagtgagtgcagggtccatcccatcccaaccacattgtcagaaacaaactgaaggcgctggagccacgttggtccaataaagtctgatgccatcagggctcctatgcctcctggccagccagtctcctgatgtcatggctgcttacttctgtgacagcacatccagtcccagcctgtcacttctctggcctttaaactccacccacccggtctctcccatcaggtctgtgtggagacgtggaacctgctcaatccctcccgcctgcacctgccgaggccctcggccgtggccctagaagtgcagaggctaaatgccctggaccttggaaggaaaatcgggaagtctgttttggggaaggtatgggtgatgcccattcctgagcccagggctcactgttctctactaatcacttcttctcacaggctggctgggctgctcttgggcatagctttgacctctcaggcagccagaccaacacacctttgtgacaggtccatttggccatggtgcgataccacgagggcgggcgcttctgcgagaaggatgaggagtgggatcgagagtcagccatcttccatctggagcatgcagctgacctgggagaactggaggccatcgtgggcctaggcctcatgtactctcagctgccccaccacatcctggctgatgtctctctgaaggtgagaggatgtgtggacccaacctaaaagaaagggctcaccagtccatcgcttaccacccacaccctggtggttaccccctggaggatttgttttgtttgtttgagacagggcctgactatacagatggagctgtcctgaaactcactatgtagacctatgtaggcaggccttgaactcacagatgtctgcctgcctccgcctccggagtgctgggattataggcatgtgccactctgcctggcttcagttagaggatttttatgggcagacaggcatggtggctcacacctgtaatcccagcatttaggaggctgagacaggaagatcaggagtttgatgccagcctggcatcaaatgtatatgacaagtgagatatatatatgtgtgtgtgtgtgtgtttatatatgtatgtatgtgtgtgtgtttatatatgtatgtatgtgtgtgtatatatatattatgtatgtgtgtatatatgtgtgtgtatatatatgtatgtgtgtgtgtatatatatatatgtattatatatgtacatatatataaattgatggctgtcatctgtcgtgtataggaaaggccagctccacaatacccattattatctgattctcaaaatcaaagagttctggtattaactttggggtcagtcactttagaggtagaattgattgctgtctttggccagtaagtgggaggtaacaagtcccaggtccatgtaataaatgacacgatatgctaggagaaactgccgtcctggaaataaatgaggaagagccccgcatgggctctctcttgaccaagcttctgccacattgctatagctggtgcatagccgggcactcagaagcttctcattcattcagggatggatggaaaagggctggccatgggagacccacagaaaggctgggtgggagtgagcgaggcagagtgtgagaggcgagctgctctcttagagaaaccatgcatgctcagactcatgcccagaggtgagaagcaaaatggtgacagagtcattagctggactgtggggtgaggcggggcaggagctggggctgaagcgccagccagatgggagctgaagcaccaagatggtggtgctgtgctagagatggtgcacggctcaccccccaccccttcatggcccttggtcacacaggaagaaagagttgaatggacagggcctggaaaagctttccgtgagaaattgagagtccagtgggtgtgtctgtccttatctgtccccatctgtcctatggtggtggaagctgtgactggataggaggctggacaaagccagactcagtgcaggctcggggcctagccctcttcggagctgtctgtggccagcggctgggtggatctcaggccagcagagggtggagaagagtgtggtggggacctttgttttgctttttgaacaagtaatacattgttgtcattaaaaaaaaaagtttaagagtgtgtgtgtgtgtgtgtgtgtgtgtgtgtgtgtgtgtgtgcgcatatcccaaaccatgtgcatgagatcaaaggacagcttgcaggaatgggttctctaccaccctgtgaatcccaggggtcagcttaggttgtcaggattgatgggaggtgcctttacctgctggggcatcttgtcagctcctaataatcttaatattaaaaatgttcatggcaaacgaagcctctcctgcctttccttccctatctgttgcccgctccctttcacacctgccttactctccctctgcgcgctctctctctctttctctttctccttctctctctctctctctctctctctctctctctctctctctctctctctcctttgctagggatgaaatccagggctttgtgcatgctgggtaagctctccactgctgagccacaccttcagggctattgtcccgttttctaaaatagcaagttaactatttgactggctactcaggtctattcataagtgcaccagttacctgagaccctcacatcaaattaccacaccctgagagtacagcaggagaaatattctgggtaccagtaacagctgtgctcccattggaggctccggggagcgtccttgtctcttacagtctccccagaaaaacctccagagccaggcatggtgatgtaatcatcccagtactcgggaggctgtgttagaggatggtgagttccaagtcaaccttgagctaacaggttcagccctgtctgaagcaaccagctgtgtatccatgtggatttgtatgcacgtgtgcacacgatgtcgtcacagcaacgttgctttctcccatcagtggatgaggggaataaagacaatgggatgatggaataacgtttgatcgggagaaagaatgaagttcagtcgtgctgcaacctatgtggcaggaaccagacacaaagaccacatgttgttatatcattttagtccacttcatgtatatgacacatccagagtccacggagacagaaagtggaccagtcattgcctcaggctgggatattatagacagaagggtttagggaaagcttgtgagttgtgggatatggtatttcttttttaaactggtaaggtgttctgaagttgggccagcaagacggctcagtgggtaaaggcacttgtcacaaccccttgagttcaatccctggggcctgtggaaggagagaaccaactcccacaaagctgtcttctgaccttcacacgtgcatcgtgacacatgcacactcatgcacagtaaataaataagtaaacatgataaacatgtagggttttgttttgttttaagacagagtgtctctgtatagccccaactgtcctggaactctttcttgtataccagactggtctcaaactcagagatctcctgcctcagcctccctagtgctggaattaagtgacgtgtaccttcacaccctggctaaaatttcgtttcttaaatccatggtggagatagctgaacaagtctatcagtataccaaaagccatggacatgttctatggccatctcagcccagaactcttacaacttaaaaaattggagattgacaagggagccctttacacacacacacacacacacacacacatacacatttgatgtttgtgcctttgctttttgacaggagacagaggagaacaagacaaaaggctttgattacttactgaaggcggcagaagctggtgacaggcattccatgattttagtggcccgagcttttgacactggcctgaacctcagcccagacaggtattgtgactgtctcctgatgatgttgggggtaatctgggccactagagatgcttttcctttcattcaggatggacatgagttctagctctgtctgttaccaatctagtggccttcaacaagttacttaacttccctggcctgttttttcgtttggtgaaataggagtaatgatagcatctatcgctagatgatcccatgaaggtcaaataccttccttgcagtgcctgacagagaaagtatgcgatagatggcagctattttgccaggatctataaagatttgctttggggaaaaaatcagaaatactatgcagttcagtatgattgtctatagagaatagagtttggggtggtttttgactgcctttttccgctcttgtttgtaaaagtttagggcttttctacacccacctttgctctaaaataatgacctggagaccgagtatatttattaataagtattttgtactatagctgggcagggttcacatctgttctaaccatactatgctgcctactacctagccatgtgtcctgtcacctgatcccttagtccttggctgctcctgctctattcatgtcctcatggaaattctcctggaaacctccggggatcctttcactgggatcagaagtcctgcctcctcctttcctgtccagctattggctgatcaactctttattaaccgatcagaggtgatggagaagaaacagtctttgcacaacactgagacaggagatgcttggcaataccagcgtcaggattgcaaccagatctctgggcacagaaatcagcatctaaatacagagggcacaaaaccgtctctcaacacttgctttgattgtgttcttatgatggagcatggcagattatatctaggcatggcagtacactagcactgagttctatcacagtctgatgtgtatttcccatctaagaggagtgagacggaaggaggaagctccgggtacatttccctagtggttttgaggctcttgaaggcaccagcaaaacaactgtcagtattccttttgcaaccttaaggctgaaatgcgggggctggtttctgcagtgtgaagagtggaaggtgtctggcttcctcttggttccttggtgtggcatgaaagattgttgaatccaaaaacagaaatcagtgatagaattgatatcataagccaggtgtggtggcgcatgcctttagtcccagcaccagcactcgggaggcagaggcaggtggatttctgagttcaaggccagcctggtctacaaagtgagttctaggacagccagggctatacagagaacccaaaaaaaaaaaaaaaaaagaattgatctcctaatgggaaccattgctggttctctatggatctcacagaagcctggcttttcaggagccttctgaggttttctagaaggaaacgagaaggaaacatactttttctgtatgcccatgttgtgatagcttagcaggaaccgtctctggagtcgagaatccatctcccatgcaggagagatagcttagtcagtagattgtttgccttggacatgaggagttaagtttgatcccctagaacacattcagaaaacactaaatggaaattggtggatcgctgagtttctttacaagattcaggtcagtgatagaccctgtttcaaaaggaaaacaaaacaaaacaaaacaccaaggtggagaacacctgaggaaggacactcatttgtcacacacacacacacacacacacacacacacacacacacacacacagaggactttttctctactgggttccaaagaaaaatcatgtctgtggctattccatatcaagctcttagagtcaaaaactttggcgtgtgacatctggcctccctgtgccaggtgtctgcagcaacaagtgctcttggagggcactttgagagggtgatccaatgtcaccgatgtgtcaccgagaactccctcacgcctctgcttgatgcagagtgcagggctcggctcactgcttctcgggaggagttgcacacgcatgacaggttatgggttttgtggatgactaaactgttctgagaaatgaagagacttgcctgaagtcacctacatgctgagtattcaactttatgtcaaagactaagtagagccaaggttagctcctagacatcaaccttgccagctgaatgcttacatctatttagtcaacactccttcatggagtctttgctcctggccaggcccgggaagcacagcagtaaacgacacacatggctctttccttcttaaggctcatattctggtgaaataaggccacaaagccagagacaagggactgatggccagtcattgttctaggaaactaagtgtttgcagacaaacgctgttctcagaaggggtggtttagttggaaggatgcaaagtcaggtatggacagagctagaggaaagatgttccaggttggagacaacaaaggttcaggggcaggcaggtgctggcttgggcttgggaggattgcagctctggcatggaagggggtaagctggcatagagtagatggtggaggaagccaaggccaggcagtcaggatgaaagtcaccaagagccgctgttcttggcacacttcgggatgctctagcccttctgtcggactttctctctggcctttggcaatgcacagtaaataatccctcagacgggtgacacccaaagagaagcagccagctgctgtgttagctctgtggtttgtattgtgaagctctggctcggacggacctaggtgcccccttggcggtttggcttatgtgtgtttctgtagattaaggagctggagatccagtaaggcagtttccatgtgcagtggagaacagggccagctggcacaggcacaggcagagcctagggggcgcagagccttgtggggctggctgactgtggtggtagatcctgtagtcctagtccttggtaggctgaagcaaaagcacggctctcacaggcaaggccagcctacatagcagaccttgttaccaaataaagaaacaggggtctggtttatttctcttagttcagatggttctagatctgcagctctcagcctgtgggtcacaacccctttggggtcaaatgactttttcacaggggttgcctaagaccatcagaaaacacagatatttacattacaattcataacagcaaaattacggttatgaagtagcaacaaaagtaattttatggttgggaatcatgacaacatgaggaactgtattaaagggtcacagaagtaggaaggttgagaaacactgttccagaggcttcggcattgtccctttctgccacttgggtaaggggaagcgtagcagggacactctccctgcaacgtctaggccatggggtacttaggtacagtcctagatcgatgttcctctcccccaaggtattctccttccattggtgaaagagctgtggtactgaaccagctttgttaagggaagatcccttaaaaatataagggaagatcccttaaaaactgaggccaggtggtcgtggcacatgcctttaatgccagcactcaggaggcagaggcaggtagatctctgaatttaatgccagcctggtctatggagcaaattctaggactaccagggctacacagagaaaccctgtcttgaaaaacccaagagaagggaaggaaggaagaaactggggttggagagtttacccagaggttaagagcacttactgttattccagaggactggaatttggttcccagcacacaataggatgttcacaaccacatgtaactctacccccccactccccccacccccgtgtacactcggggacacataaatccaatttaaaaaaaaacaaacataaacataaaaagtctacagtgtgaaggtgtgtcacttagatgtggtggcctttggtactatagtttgtagctcagaggtggtggtccccctgggatcccaggcttgcccttctcccaggtttgcccctccagctcagtggtcctctgccttcctaccccatcgccatggtaatatccttctcccctcctgtctcctggcaaggtgtcaagactggtcggaagccttgcactggtacaacacagccctggagacaacagactgcgatgaaggcggggagtacgatgggatacaggacgagccccagtacgcactgctggccagggaggcggagatgctgctcaccgggggatttggactggacaagaacccccaaagatcaggtgaggcccacagaccttccctggggcaggatagggctggtgaaggtctatagttctcatcccactgggattaggacaggttaccagatatgtcacttccacagtaggggactctatggacctggtatgtagatgaacattttaattttactttgtcatattttattttatatatgagtgtttacctacccatgtgtgcctggtaccctcagaggccagaaaagagttggatcccctggaactggagttaccaggcagttgagagctgccgtgggtgctgggaatcaaacctgggttctctgcaagagcagcagatgctctaactgctgagccatctctccagccctgattttttttttccttgagtcggtgtggctgtataggcttagctggcctggagttcattgtataaatcaggctggccagagattcacctgccttctgagtgaacagtatgcctagcaaggtttgctccattgttttatcacgtggcagtgaggtggagggggcagagagagacctacctgaggaggccaaaagaaactgtgtgaccctgtggagctggagctataggcagttgggagcttcctagcgtgagtgctaggaactcaactctggtcccctgctactaacttctgaaccagtctcccagctcctttttaaaccttaattctttgtttccttattcattcattcattcattcattcattcagagatggagtctcatgtaggccagtggacctcaaactcactgtgtagctgagaatgaccttggatccttttgactgctcctcccatatgcgtgaggacctgaatttgaataccaaagcccacgtaaaaacaagatgtaagccaggcattggtggtactcgactttaatcttagcactacggagtccccctggtgtgcaaagaggattccaggacagccaaagcttcccagagaagccctgttttggggactggttgggggagagcaggatgtggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattccctagagagcacagcacatctccgtgtgtggcacctgcattgtgtgtggctgtccaagtaatctagagatgattaaagcaaagaggagaggaatgcataggccatatgtaaataggacacactctctgatgcgagcagatttttctctgcttcatggatcctggaaacaccctcaccccctccatgaagggcaattatatattagaatttatggacaggttttgcaattttaaaaatgaggctgaaaatttcataatatttcatctcccttcactattatcaaacaatgcaacctcacaccctaaccctgtccaagttagcacccttgctctttgttttgagacaaggttttgtgtaatctagctggttacaaacatatctcagcttatactgtaattacagcatgtactacctttcctggctcattccgtctatataaaaaatatttttatcatctgtgtgtgtgtgtgtgcatgtagagatcagaacacagcctgcagggattcaccctctctggccaccatgtcagtcctaggtactgaacccagggtaccaagctgacagccatcatctttgcactcagatttcttccctgttgtcattcttttattacttttattcccataaaaaattcttattttaaattcttattttatcttataactattctcttattactagttttcttttattgctaaataatatgccactcggtgaatgtgccatgttttatctactgtaatctgttggacgtgttagatctttttaaaactttaaacttttttttatttttatgtacgcgtatgtgtgaatgtaggccgagtgtgtatacatacccgtggagtccagagagggtgctggatcccagctgtaacttgtgagcttccccgtgaggatcctgggaactgagtgtgggtcctcttacaggcaagcaagtcctcttaacttctgagtccccaacattagatacttcttgtcagttttgagctgtcatttatactggttgcctaggaaaacaaattccttttcagggccgggtgtgtggctcagtggaagagcaggcaactcttgagttccatagcgacaccagagactagaagagtgctctggccagcgagctttcatcatatgctatccccagagacttggattataccatacagctcaggttgctatagaaacctcagatgctctcttggatgggatgaagtttgctggcttgatagagacaagtggctcacctctttgtcccccactctgctctctttcaggagatttgtacacccaggcagctgaggcagcaatggaagccatgaagggccggctagccaaccagtactacgagaaggcggaagaggcctgggcccagatggaggaataactgccccacagaatcactgccaaggagaaaggctggggaagggaggatgggactcatttctagggaggggagaagcagttttattatggtataaactcacttttgtattccgttttctcactcttgatagcctttgcagctggccgagacattataactgcccttttagtggtggtactttgggggaagtggggggttgaagatgcagcctaatgagtctctttcccgtcctccaccccccggttttccctttttcatcctgagatgtaagcaagtatctttctgtctggatgatcagacagtatcagggcttctctcgccagcctttgcaggcaggactcacatctcagggtctccaggccatgtgctgggaaacctttctattggctttccacaatgggtctttctttcagttttgagagcggtatgttgtttttttgtttgtttcctccagtggatgtgagatggttcaatacccaggctccttcatgctgggggagatagttgtataactttcacttaatgcccttccactggacatgtgattcctggcatccttctaaattttttttttttagacctgctatgtaatatagatttttcaaaaacaggtttggcctttatacatgcgtatttactacctctgagtcttgcattgggggtgtggaagcagctgtacctcaaagcattcacagtaagaccatggcttaggagctgggcaactttcctccaaacagaagtgccctctgtacaccatggccacatccactacgtgactgaagcatccttgtgcagaattccatggccgtttggccgtttcttaatgtgatgtttcttggactccgccctcagcctgctgtccttgtcattttctgcttgagactaggttttccttacttaacacgaggtcatctgcagcaagcggcctccagctgcagccccttgggatttgtctaagatgtttgagaatgaggggacaagagtctaaacactgactgggttaggacatttccccagggtcagtctgggactttgatgagcttcctctttaaaaggagttcagatttcatgggagtgctattccagccacagggaaatggcccgctttgatttgaccactgatattagatctaccgcctctatctttgcttaaaaaacagaacagcagagtgggacatgcaagccatcctcacctgttggctaaaacaggccttttaaggatttcactattgagtttgcccaatcaaaaacttgtagaagcagtagattgtaaagtctagggtgtatgttctttgagggaaaaatcagagtcagtttaaccttgggggctggaggccatggtatacatctgtaatcccagcattcaggtggtagaggcagaaggatcaaagtttgagaccagcctaggctatgtaatgagaccctgcccccaaaaaacaaacaaggaaaagagccagttagatggctcatggatgaagctcctgccgaccctcacctgacaatctgagttctgttcttgggacccacgcgtggaagcagggaacaaactcctgcaagttgtcttctgatcttcacttgtgtgctgtgtcccgagagagcccccatacacacacacacacacacacacacacacacacacacacacaaacaacagtaagagaaatgagatagcaaaaactacccttgaaaattcctttcatctacctgcaagttccaaaatccctggatttgcatttgaagccataacttctgattctctctgacagattggcccttgtccgtttttttgtttttgtttttgttttttaattagtaccagaacagtagctggtttgcgttgtcctgtgggtgttctaacatagtgtatatgttaaacataagaagcagtttattgtgacataatctctcagagtaactgtcatataagttgtggtgtgtgtgtgtgtgtgtgctggtcagcagacaacctcaattttgttcctcaggagctggccacctttttccattgagtctctcactggcctagaacttgccaaataggctctgctggctgaccagtgaactccagagatctgtctgtcttatcctttctaattctggaattgtaaactcgaatccttcactcattgattagtccttgtctggatcacttaaagcctcaggcctgcagttcccccaaccacgtggccttcatgtggagaagtggtctctttctcctccaagagactgggatagcctggtgcacagctaagcaaatgcctctttaaggacccttgcgaatgaaaagagagcttggagagcctgctgggtaatattgccacttggaggctgaagcaggattgtgagtttggagccagcctgggctatttactaagactgtgtctcaaaaagaaaaagccctggaaactggagagatgcctcagtggttaagatcattggctgctcttccagatgacccaggttcaattcccagcacccacatggcagctcacacctgtctgtaattccagttttaaggatccgatgctctcccacaaccatgcaggccaaacgccgatggacataaaaataaatcataaaaaaaaaaatagttcaaacctgtaatctcagcacagcacttgggaggctaaaatggaagggtcactgggagttttatgccagattgggctacatcatgacttccacataagcctaagttacagagtgagattctgtctttaaaattaatggctgtttctccttccaaacttagtcttataccttcaaaagctggtcagggcatcttctctttccatataggctgggcatgacaagaacaagccgacaggattcagctctggcagggagacgccagtgcctggcactgatgatcagttctgtcttccagtgctcaaagcaggtaacagcctcgattaacagagctgatatgcgtgctttcatctcagagacagaaaccaggctacagtggtgctgttccttgaggctgagctggagctaggggccagagagctgctgtttccagagcactctaggaataaagacatttaactgtactgtgatggcgcattccattttgcaacaggtatcagggaaatttcaatgagacaggattagagtatgtgcttagcatacagccaaggtcctgggtctgggccccagcactgcaaggaaaatatacaagctttatgagtgtaaaaaagaaacattctccaactcactacttcagaagaatcctgctctctgcacgctgggccagccttggctacttagtgatttccccatctgtccttgctgaccgtcatcccagcatctttgtatcagtaagtgtggtttgcagattcacaaacgtttgcacaggtctgtgcagctcgagatggaagtgaatcgggggcggggggagggtacaaatttacccattccctgcttggatttgtgcctcttccttaacgttttgtctctgacctcaaggcaactggctgaagtgtggctgcaattgtgtgtgtatcagattttagcttctcttccccaacagtttgggtttttttctgaaatatctcaaactcacacattccccctccctatgaaaacatacaaatcaagaaatgagtatgtatctacatggaggctgaagtgagccgcagcgtgcatggatcgaagagcggatgtgctcaccttcaacatgagctccatcgcccacagtgtgggcccaacgtggtcccatgctggcttttcacagtagaaaaacttcttaatatgatagccattggtttttaacatctgtaataaattccaataaagaaagcctttccgacctggcccttacgctatcagtttgctttagagtaaaatagtggatgcaggggctggagagatggctcagcagttaggagcactgactgctaattacagaggacctggactccactcccagcacccacattggcagctcataactgtaactccagttccaggggatccgacatcctcacccagaaatgcatgcaagcaaaacaccagtgcacataaaataaaatagaatcaaaatgtggatgcttttgatttgtcccgctataaaacagtcattccctctgcaggtttgtcatgagctgctgagaaaatcctgcgcacttggtgctttgaagctcgtggagagctgcagagctgtctggcgtgggcatttggattcaagataattgtttgtttggttgggtttaaagaaatttgagttttaactccatgacagtagatcatgtacatttaagtcaatatccccaatgataggagattttaaaaaattgtttttgggacaagctcataaagatgaagccaaaggtgtgaacaacaaaagtctggagatagggaaatgcatggccaagaaccctggatccaaaatccagggtttgggggcttcattgagtaaccccagcactgcagaagctggagaagggagattctgaggttaaggccaacctcaaacagcaagatgtcgcgaaaacccttaaaaaaaatcactgtaggtcgggcgtagtggcgcacgtctttaatcccagcactcagagttcgaggccagcctggtctacaaagtgagttccaggacagccagggctacacagagaaaccctgtctcgaaaaacaaaaacaaaacaaaacaaaaaaatcactgcaaacctcaagcagatcagtgggaagaatgttcaatcatggaaccatggatcagaccggtttgcctgtagcccttgtgttgggggtggggggcgcaggtcagtgtcctccccatcctcctgcagcctgggacaccaggcacaacaaagtagaggtcctttgctgtgaggggtgaagagaaatttccagggtcagtattaaaaaaaaggcttcagcgaccttttcctgtgacctgggcattgtcaatttaacttacagcttaatggcagaaagcagccataggatcctctaagggtatcagatgaattgaaatgaacacaggtcatgaccctggtgaatctccacaggaaacaccacagccatcaaccctgcccctcacagaactgaccagacaacttagagccccagtctcaggctgagcagatagctcaaggtcagcgtgcgaaagtcacatttgaggagcacctgttgcttctgcagaggctgcagattcagttcccagcacttgggtgatggctcacaaccacctatatgtccagttctatggaatccaatgtcttctcctgggcaccaggcatgcctgatgcacacgcatgcaagatacacacataagccaatatatacatatacacatacacacaccacacacacacacacacaattgagttcgaaagagtagacagtagaagagagcatttcagaggaagcaattaggaatgaggtatggtgctttgcacatttaatgtaaactaaataattcaatttgggaatacacgtttaatttttattttttgtttattttgtggttatcatggaatattgtaatcttaaaggaccaattttgatattgtttatgcccatggcaaacacttagctctcacctcaaggggtataataagaaatcgtctagtctgaggctaaataggtcatcccaaattcaatctgacatggtaagtttgatgaagtttttgtagtaacagaacaaaggaagtctttgaagaagaaagttgtaaaatatatgggtgaaaacattaggtagatgacttaagacaagagggacaaatctctgttctaggccctagatgctctctctctctctctctctctccccctctctcagcatttgtagtcttttggttgataggagttaggcatctgtttgtatatatcccaaagggtttgcttcacagacaagaaggcaataaatggccactaacagggctagagatagcccaagatcctatagctctgggctcgataatgtcccgaactctctgcttagccttggaaagtggagtactttcaggaacttttattcacagttaaatatgaattctagtctatagctgcagcactctgaatacttaggcaagaagattatgaattcgaggccatcttgggctactgagactgtctcaaaaaatattctaccaccaacactattccttagacatacagacaactccgtctcttcagtatgtccaccatatacgagttactttcacagcattttccttttgtttttgttttatatacatatgtgtatacacatatatacacatacatatatctcccaggctgtggttatcctaaaactcactatttagaccaggctggcatgaaactcacacaaatgcacctgcctatgttttctgagtgctggaattaaaggcaggcatcaccacacccagctcatagtaaattcttttttttttttagttaattgattaattaattattaaatgctgggcagtggtggttcatgcctataatcctagcactcaggaggcagagcaggcagatttctgagttcaaggccagcctggtttacagagtgagttccaggacagccagggctacacaaagaaaccctgtctcaaaaaaaatttttttaatttagatttttttttctttttttgagacctgatttctcttttctctgtataacagccctggctgtcctagaactcactttatagaccaggctgaccttgaactctcagagatctgccaacctcctttgcctcctgagtactgggattaaaagcatgtgctgccaggcgtgggggcgcacacctttaatcccagcacttgggaggcagaggcaggtgaatttctgagttcgaggccagcctggtctacagagtgagttccaggacagccaggggctacacagagaaaccctgtctcaaaaacccaaaaaaaaaaaaaaaaaaaaaaaagcatgtgccaccacaccctgcaatttttttttttaatttcacgtgtatgggtgttttgactgcccacttttctgcactatgtgtgtgcagtacctgtagaggccagaagagggcgttaaaccactggaactgaagttacaggcttttataagatgggttgtgggaattgaaccctggtcctctggaagagtagccagtgctcttaaatgctgagccatctcttcagctttccacattaaattttttttttttaatattttatttatttattatatgtaagtacattcagacactccagaagagggcatcagattttgttacggatggttgtgagccaccatgtggttgctggggatttgaactcaggacctttggaagagcagtcagcgctcttaaccgctgagccatctcaccggccctaaattctttatactataataaagtcaggctttctagaaggtttggtttctttacttccaccttgacatactcaacatacttcagaatatttccaaacctgcaacagaagactgttcaggctttgtgaggtatttgaggggtcaggtccacttgtttttcttcccacatttgggctgagcatctctagtctggacccataattctcccaaatcaggaatttgttgttttgggagatgtaaaaccaggctcaaaatctttaaagtgctaacacagtactgcagcagaaaaatccacaccatgaaactttttcacgtacaaaattattttaaaatagtatatgtggctggggatataacttagtgtagcttagcacacacaagaccctaggaccctaacattaaattaaaagctgtgtgtggtggcacatgcctttaatcccagcactcatgaggcagaggtcagatggatctctgaatttgaagccagcctggtctacatagtgaatatttcaggaaagccagggctccaatgagagagaaagagagagagagagagagagagagagagagaaagagaatttttttttttttttttggtttttcgagacagggtttctctgtatagccctggctgtcctggaactcactttgtagaccaggctggcctcgaactcagaaatctgcctgcctctgcctcccgagtgccgggattaaaggcgtgcgccactatgcccagcctgagagagagagaatttaaaccttaaggactggttggttgtttgcctagcatacatgaagcccttggcttgatccccagcatcacatagaacaagtaaggaggaatgttacaagcctttgatcccagaactcagaggcagagggagggagaactctgtgagttcaaggacagactggtctaagtagagagttccaggacaaccagagctacatagaaaaaaaatctatctcaaccatccgtcacaaaagaaagcaggtgtagtggaggaaggagggtcagttcaaggtcattattatatgaagttcaaggccagcctgtgctgcatgagaacactaatggtaataatattaacaattaataaataatgtatataagcatattccatgttgagtctcgtgctcaggatatctcacgatgtatatgcaaatatttctaaatctaaaccctgaaacacttagttccaagtggataaatgttaaaggttattcagtctatggactagaaaatggagtggataataggaagataaaagaccaaaactcgccaagtgtggtggtgcacgtctttaatcccagcactagggaggcagaggcaggcggatttctgagtnnnnnnnnnnnnnnnnnnnnnnnnnnnnnnnnnnnnnnnnnnnnnnnnnnnnnnnngttgttgtatcacatatatgtcgtttttattacagctttgctgcaagcaaggatctccccaggagaacaattgaaagattcagactgagtacagagaaaatgtagtatgttgtattaaccttcacagaggaagctgcataacgtacagcttggtgcgtgtttgcgtatgtaagtatcaacacacaccgaggtacagaacatctgcaaatcacaacaccttgttgggccctgagatgtttgatacagatggtcaactcgccatgacctggaatcacctaggagaccaacctgtgggcttgtctatgatggaacttcaagactggtgttacagagctcagtccttcatcaaagcagggccatcgtcattggatcagctgtgcgtgcatctgactgcctactgactgaggtctgttccctcagagaaggaccaggtggggaaggtcttgcgactgcagcctctaatcccagcaatttgaatccaattctgtcctaattgcacatggtcatgtggtctggcaagtgtcgtgggttggtctgctatgtattcaaatactgacccccaagatctggttaccactccggacaagcagatcctcatgtacaccaagtgatgatatataaaccttgttccccagcttaaaactattgcttatttaaatctggtaacagccagccaattgctgggaggtatagaatgaggtggagtttgagttaccgggctggaagtcccaggtatgaacaggaggaggggtgtggaagaggagcagatgggagaacaggagggctccaggagccatgatggactaatagcacatgccagagagacgtgcctccccaggaccccagactgctggaacagaagtaacccagagagtttcaaacagcaagtatttggggagtacagttgagtcagtagccagactggcatttagagatttagattgggtggggggtaatctcccagtaattgtgcagatcctaatacataaatagcatagtttgagtctcatttttatttaaagttcaatcaggataagtttaatagatatttttatacatttgatacccagtgcggggcatatcactctggcacaggctgttggtcatagggtttttagactggggaagcttagtggagaaggcagctggcttggtagagacattatataggatgagaccatgattagccattgttagatgaggttggaaagaattctcttaaaatatttacttaatacagagtcctctgtcttcatgcacaccaaatgaaggcatcagatcccattatatatg

SEQ ID NO: 740 - DNA, 1938 bp, Mus musculus
ctgcaggaagcctggaagcatgcgatcgagaaagccaagcacatgcctgacccctgggctgaattccatctcgaggacatcgccacagaacatgctactcggcacaggtacaacgctgtcaccggggaatggctgaaagacgaggttctgatcaagatggcgtctcagcccttcggccgtggagcaatgagggagtgcttcaggacgaagaaactctccaacttcttgcacgcccagcaatggaagggggcctccaactacgtggccaagcgctacatcgagccggtggacaggagcgtgtactttgaggatgtgcagctccagatggaggcgaagctctggggggaggattacaatcggcacaagccccccaagcaggtggatatcatgcagatgtgcatcattgagctaaaggacagaccaggccagcccctcttccacttggagcactacattgagggcaagtacatcaagtacaattccaactcaggctttgtccgtgatgacaacatccgactaaccccacaggccttcagccatttcacatttgagcgttctggtcatcagctgattgtagtggacatccagggtgtgggtgacctttataccgacccacagatccacactgagaaaggcactgactttggagatggtaaccttggtgtccggggaatggctctcttcttctactctcatgcctgcaaccggatttgtcagagcatgggccttacgccctttgacctctccccacgggaacaggatgcggtgaatcagagcaccaggctattgcaatcagccaagaccatcttgagggggacagaggagaagtgtgggagtccccgcataaggacactctctagcagccggccccctttgctccttcgcctgtcagagaactccggggatgagaacatgagtgacgtgacctttgactctctgccttcctccccgtcttcagctacaccacacagccagaaactggaccacctccattggccagtgtttggtgacctcgataacatgggccctagagaccatgaccgcatggacaatcaccgggactctgagaatagtggggacagtgggtatccaagcgagaagcgaagtgacctggatgatcctgagccccgagaacacggccactccaacggcaaccgaaggcatgaatccgacgaggatagcctgggcagctctggacgggtctgtgtggagacgtggaacctgctcaatccctcccgcctgcacctgccgaggccctcggccgtggccctagaagtgcagaggctaaatgccctggaccttggaaggaaaatcgggaagtctgttttggggaaggtccatttggccatggtgcgataccacgagggcgggcgcttctgcgagaaggatgaggagtgggatcgagagtcagccatcttccatctggagcatgcagctgacctgggagaactggaggccatcgtgggcctaggcctcatgtactctcagctgccccaccacatcctggctgatgtctctctgaaggagacagaggagaacaagacaaaaggctttgattacttactgaaggcggcagaagctggtgacaggcattccatgattttagtggcccgagcttttgacactggcctgaacctcagcccagacaggtgtcaagactggtcggaagccttgcactggtacaacacagccctggagacaacagactgcgatgaaggcggggagtacgatgggatacaggacgagccccagtacgcactgctggccagggaggcggagatgctgctcaccgggggatttggactggacaagaacccccaaagatcaggagatttgtacacccaggcagctgaggcagcaatggaagccatgaagggccggctagccaaccagtactacgagaaggcggaagaggcctgggcccagatggaggaataa

SEQ ID NO: 741 - protein, 645 aa, Mus musculus
LQEAWKHAIEKAKHMPDPWAEFHLEDIATEHATRHRYNAVTGEWLKDEVLIKMASQPFGRGAMRECFRTKKLSNFLHAQQWKGASNYVAKRYIEPVDRSVYFEDVQLQMEAKLWGEDYNRHKPPKQVDIMQMCIIELKDRPGQPLFHLEHYIEGKYIKYNSNSGFVRDDNIRLTPQAFSHFTFERSGHQLIVVDIQGVGDLYTDPQIHTEKGTDFGDGNLGVRGMALFFYSHACNRICQSMGLTPFDLSPREQDAVNQSTRLLQSAKTILRGTEEKCGSPRIRTLSSSRPPLLLRLSENSGDENMSDVTFDSLPSSPSSATPHSQKLDHLHWPVFGDLDNMGPRDHDRMDNHRDSENSGDSGYPSEKRSDLDDPEPREHGHSNGNRRHESDEDSLGSSGRVCVETWNLLNPSRLHLPRPSAVALEVQRLNALDLGRKIGKSVLGKVHLAMVRYHEGGRFCEKDEEWDRESAIFHLEHAADLGELEAIVGLGLMYSQLPHHILADVSLKETEENKTKGFDYLLKAAEAGDRHSMILVARAFDTGLNLSPDRCQDWSEALHWYNTALETTDCDEGGEYDGIQDEPQYALLAREAEMLLTGGFGLDKNPQRSGDLYTQAAEAAMEAMKGRLANQYYEKAEEAWAQMEE

SEQ ID NO: 742 - DNA, 78268 bp, Homo sapiens
gcctgaccaacatggtgaaaccccgtctctactaaaaatacaaaaattatccaggtgtggtggcgggtgcctgtaatcccagctactcgggaggccgaggcagaagaatcacttgaatccgggaggcggaggttgcagtaagccgagatcacgccactgcactccagcctgggtaacagagggagactccatctcaaaacaaaagaaacactaaacataagggtatttgagttcatgttgagcacctgtgcactgaaggcaatacaaggtatggggggagggatggagacagcagtgcagaccttaggatgtcacagcccacctgacaagtctattgtctaggagagggtcccagctcctaatggtggggcccaggattcaaaccctggccatgcggctgtagaggacaagctgttagccactgtattgggctttggtttttgtttcttgtttgaaggaaactcgggactccagctagggtttaaaatatcttcagaacaagccaggtgcagccctcaacagcctagcgctgtgtagttccgctcccttaaggttgccttttcagaggtagactgtcacttctggacctagcagctcctgtcattgtcagaggagagtccagtgtagcacctggtgtgcagtcagtctttcacgtgcattatttgtctttcttatttccatagaaattacgcctttttgaggttgataagcttttgaggttgataagcagataagtagctcttctgcttacttatcactcattcacagcacaaaagccacactctcccttctctgaattcgtgttaaactgtgagaaactcagcttcttctagttggtggaataagacagtgtccttggcatggtatgtaaaggaaccagatggctgggcactgtgactcatgcctgtaatctcaacattttgggaggttgacgcgggaggatcacttgagaccaggggcttgagactagcctaggcaacacagcaagatgccgtctgtaataaataaataaaggaaccagaagaagacctaccagtgtagggatagggtggggaagggaagtagtaaggggaagtagagctaaagtctcatttatcatacctggaaatcagaagataggatgaaaatagataaattaagaaataatcagggccgggtgcagtggctcatgcctgtaatcccagccctttgggaggctgagatgggtggatcccttgagtccaggagtttgagaccagctgggcacatggtgaaatcccatctcaacaaaaatatacaaaaattagctgggtatggtgacgcgtgcctgtggtcccagctactccggcggcttatatgggaggatcacttgagcctaggaaacagaggttgcagtgagccaagattgcgccactggactccagcctgggtgacagagcaagaccctgtctcaaaaaaaaaaaaaaaaaaaaaaagaatcaggaagcgtattatttagtgatatatatagatagatagatagagagagagagagagagagatgcgaaggataacactgagaatagttggaagtagttgcctctagggttgggaagtagggctgcccgtgcaaagttgcaaaggttgttcactagagttgagcagtaccccacctatatgatcatatacagtggccctagtaagaaaaaggtgtttaaagcatttttaaaattatatataaataatatacaatggcccaaaccctggctgggtttggacagagtctcactctgtcgcccaggctggagtacagtggcacgatcttggctcactgcaaactctgcttcccaggttcaaacaattctcccacctcagcttcccgagtagctgggattactgggattaccggctcgtgccaccatgccccgctaatttttgtatttttagtagagacggggtttcaccatgttggccaggctggtctcgaactcccgacctcaggtgatccacctgccttggccttccaaagtgttgagattacaggcgtgagccaccgtgcctggctggtttggggattttcatattgcatgtgacagaaaacctatctgtaactagctaaatagccctttcccctactgccccccaaaaggcggggtttattgtatcatctgattcagaaatctacgctgggcttggtagtttggtttcgggaacatctggattccaggtctcaaatgacatcatcgctattcatttttctctttctctggttctgccctccaccacgtatcagctttgttctgtgttggcctcagccccattctcaagttcacattcagcatgaaaaggctgatcacctcttccagtcactcaagcaaaaagccccaggtttgctgcaatgggctagaatagtttgactgtaatcacatgaccacctctaagccaatctctgtggccaggcaccccagtggttggtttaggcctggatcttgtgacacactcctgaacacatgactcgagggtggggcagaggcagatcctcacacagaagctggtgcgtgattccaggtggctgatcaatcacctgtgtccactgtggttgtagtcaagggcgtgtgggttgtgctgtgctgggcgtacactagtgtgtgcattggccagctcggggtgccacgttattggctttgggatgctggttcccaggagtggcggtgggaagattccacctgctttctatggtaggaaggcaggtcctggggtgagggtgagccccgagggggaccagtggccactgtggcttgacccgcaggccttgacctgagcattgcaggcatagtttcctgcccctgtaactgccagatcgagacccagtgagacagtggtttccgtcgccagagactgaaatagtgtattccctgaggacccctgaagaagcttggctttgctacgagccagacgtccaggtcacaagtctggctgggacccaaggctcagtccctttataatagctgttgagttcacggagtgagtacaattatgcatccccactgaggctcaagaggtgaagtcacatagccagttagtggtagagatggggcttgaacctgggtcttcctgactcactcagctacctttccatagaaatagggactggaggccgggcgcagtggctcatgcctttaatccccagcacgttggaaggccgaagagggtggatcacttgagggcaggagttcaaacaaaaaaattaaaaaaaaaaaaaaaaagagaaaaaagaaaagaaatagggactgggaggagaagatgtggatgcctgagtgaggtagagaaagctttcaagaaaaatcctgatgtctttcagctggagtcctattcttatcacaggagtagatcctttctttgggccaagggaaccccaggatagatagagacccctaggaggctgggcatcttgcctggtgttagaacaggcctcctggaactgacttaaaggctaaggaaggttccttgcttgtttggggaaatccaacatcctccaggtacccagtcttcatgtgcaaatgtaagagtatctgccaagttaggactatggattgaggccacagttttcccaggttgaccctgcccaggcacccatttgtcataaaggttgtgacctttaggccaggtgcagtggctcacgcctgtcatcccaacacttcaggaggccaaggtgggaggattgcttaaggccaggagttcgagactagcctgggcaacatagtgaaactgtgtctctacaaaaataaaaaattaggtgggcatagtgacacacacctgtagtcccagctactcaggaggctgaggtaggagaatcacttgagcccagagatcaaggctgcaatgagctctgattgcacaattttactccagcctgggcagcagaacaagaccctttctcaaaaaataaaactttacaaaaaagaggatgtgactttttatgatatgggagagaaggagctactgttaccaaataaaattagcaagtagaaaggaaaaaagaaaattacagtagattatacaagtttagctatcagagtatgaagtttctgaatccaggattgttatgctgtcccatggtataagagacccaggttctgtttgtctcatagctcttccagcctcagcacagggccatccgcctcatggtctagggtagctgcttgagctccggcaatcacatgtgcatttcagccagcaggttggaaggagagccaaggggcacactccctttaagaacccttccctatggttgcacacagtccttcttatatcccattgactaaaacttgttcacatgtttatatctatctgcaaaggagtctgggaaatgtatcctgagtggccacgtgacatgcttagccaaaacccggtggttctcttatcaaggaagaaagagtgaacagctattgggggatagtttgccacagctgccttaagagcaaatttatgacaactcaaaagccataaaacagatgacactcacttagctctggaatgcatatcaagtgcctgctgtgtacaaggcgctgtgccaggcagggtcacagctgcttgtcttcatttcccagggccgaggagaacgtcaggtctgtggtgggacatggccgagggccgagctccccacactgtaagatgagggagtcggctccgtgaattaattgggtaaggagccagatttgctcgctagcagcccagatcctgaatctgagcgtgcttttttttttgttttttgcttatttgagatgaggtcttgctctgttgcccaggcagtggcacaatctcaattcactgcagcctctgcctccccagattcaagtgatcctcccacttcagcctcctgagtagctgggactacaggcacacaccaccacgcccggctaatttttgtattttttcgtagagacaggatttcgccatgttccccaggctggcctcgaactcctgagctcaagcgatctgcccaccttggcctcccaaagtgctgggattacgggcatgagccatcacgcctggccctggatctgagcttttaaccaccgaactacactgtctggaggtctgcagcttggggctgtggttctggccctcctcctggcactgtcctggcccccagtggccgctgactaggctgggcctgctggcagctcctggcaccacgccgtgttggtcagcagggattctggccaagggctgaccagggcagagtaggcgctggggctgggagcagctgacagtgaggagaggccagtccagggctcagggaagattctggtgacaagcaggatcaggtggctctggcattggatccaggcctgtgactgtgtcttgcccagaggataagaaacaaactcagtagttcacgttggttttcaaacggtgagtatagaaatcaatgtgtgggtggtgtgttaaggaaaaagattaaacagaaagaaaaaacagaggacttaagtagaatagaaaatagcaagagtgggccaaacacagtggctcacatcagtaatcctagtgctttgggaggccaaggtgggaggatcacttgaggctggaagttcaagaccagcctggccaacatagtgagactctgtctgtacaaaaataaaaaactttagccgggcatggtggcatggactgctctggaggctgaggcgggaggatcacctgaacccagctgttggaggctacagtgagctgtgatcacaccactgcactccagccagggcaacctgtctctaaaaataacatttaaaaaaaaaaaatagcaagagcgcattatacaaagtaaggctaagcacaatttcttgaaattttactgtccattttataagcatgtagtgggttaggatataaatatatttcctgcttcggtagccagagtaccaaagccttggctctagaagactgtgcacctgatggacagcactgtcaaaaaaattggaattattggtttgatgtaaaaaaatttttaaactaatttacttactattttgtgtctaaagcaatccagctttgtaaaaaagttaaagcagtatagaaacatacaaagttttaaaaagctggccaggctcagtggctcatatctgtaattctagcactttgggaggccaagacgggcagatcacttgaggtcaggagttcaaggccactgtggccaacatggtgaaaccccgcctctactaaaaatacaaaaattagctgggtgtggtggtgggctcctgtaatcccagctactcgggaggctgaggcaggagaatcgcttgaacctgggaggcagagcttgcagtgagccaagattgtgccaccccactccagcctgggcaacagagcaagactctatctcaaaaaaaattaaaaaattaaaaataaaaagtttcctccagctctacagctgcttatttcgagtgctgtacagttcctgtggatttttcagggaagttttcatgcatgtacacaggtcctttttcttttcttttctttttttggagacagggtcttgctgtattgcccaggctggagtgttgtggtgcaatttcagctcactgcagcctctgggctcacttgaacctcctgggctcaagtgatcttcccacctcaaccacctgagtagctgggactacaggcacgcaccatcacacccagctaattttttgtattttttttgtaaagtcagggtcccattatgttgcccaggctggtcttaaacttctgggctcaagcgatcctcccacctcggcctcccaaagtgctgggattacagacatgaaccaccacatccgactttcttttctttaaaactttggctttcttgagataaaattcacataccttacaatctgctcatttaaaatgtacgattctggctgggagcagtggctcatgcctgtaatcccagcactttgggaggctgaggtgggcagatcacaagttcaggagttcgagaacagcctggccaacatggtgaaaccccgtccctaaaaaaaaaaaaaaaaaaaaaaaatacaaaaattagctgggcacagtggtgcgtgtctgtagtcccagctatttgggaggctgaggcaggagaatcacttgaacctgggggtggaggttacagtgagccgagattgtgccactgcactccagcctgggtgacagggtgagactccatctcagatagatagatagtacaattcaatggtatattcatagtcatatagccacagtcaattttagaaccttttcatcaactcaaaagaaaccccatacccattagcaatcattccccatttcccccaaccattcccaccaccacaccctacctccatcctcaggcaaccattaatctattttctattgctgttgctttgccttctctggaagtttcatatacagagaattagtcaatgtatatagtcttttgtcactgcctttcacctcccctagtggttgtaagtttcatccatattgtagtgtatgtcagcacctaggagtggaattgctggatcatacggtaactcagtgtttaactttttgagatgttgtttttttctgttttttttttttttttttggttttgttttgtttttagacaaggtctcactctgtcacccaggctggagtgcaatggcacagtctcagctcactgcaacctctgcctcccaggctcaggcaattctctcacctcagcctcccaagtagttgggattataggcatgcaccaccacgcctggctaccttttatatttttagtagagacagggtttcgccatgttggccaggctggtgccagagtgttttctaatttcttaatttttgggtatggcgtaaggaaggggatcaacttcatttttttgcatgtggatattcatttatcccaacaccatttgttgaaaagattcttccttccctgttgaatcatcttggcttgttgaaaatcaagtgactgtaaaactgagagtgaattatcttggcacccttgttgaaaatcaggtggctgtaaatgtgacagttctatcctacaatcttcctgaactctttcttgattatttttgtgtgtttgtgggtatgggaccgtcccctttctaacagtcacggagtatttcatggtgtagagagaaatactgtaatctgtataatgagcttctattggacatttggggttgttgggttttgttttgttgctgttactgattgtgctacagaaagtgcttttaggccaggcgtggtggctcacatctgtaatcccagcactttgggaggccgaggcaggcggatcacctgaggtcaggagtccaagactagcctggccaacatggtgaaaccccgtctctactaaaaatacaaaaattagccgcgcgtggtagtggatgcctgtaatcccagctactcaggagactgaggcaggagaattgcttgaactcgggaggcggaagttgcagtgagccgagatcatgccactgcactccacagagccagactctgtctcaaagaaaaacaaacaaacaaaaaatgcttttagggccactccttcattctgggaaagtgcattgagtgccttctctgtgccaaacacttttggaggtattgggcatacagacaataacaaagtaaacggggtgatttcagtttgagaaaagcacaatgaagaaatgaagcatgcctgtaatcccagcattttgggaggccaaggcaggaggatcacttgagcccaggagattgagaccagtctgggcaacatagggagaccctgtttttacaaaaaacaaagaaaattggccaggcttggtggcatacacctgtgatcctagctacttgggaggtttgagtgggaggattgcttgggcctgtgaggtcaagcagtgacctaggtgagctaggattgcaccactgtactccagcctggatgacagagcaagattctgtctcaaaaaaaaaaagaaaagaaaagaaaaagaaaaaagtccggatgtggtggctcacgcctgtaatcccagcactttgggaggcccaggcaggaggatcacctggggtcagaagttcaagaccagcttagccaacatggtgaaatgccatctctactaaaaatgcaaaaattagctagttgtggtggtaggcacctggaatcccagctacgcgcgaggctgaggcagcagaatcgcttgaacctgggaggtggaggttgcagtgagccaagatcgcaccattgcactccagcctgggtgacaagagtgaaactctgtctcagaagaaaaaaaaaaaagaacaaagaaagaaatggaacggggtgatatgcaagggagtgattggatatgcatgttgggttaagggttctttgatttggggattcacagaagatttcactgaagaggcatctgtgagctgtgagctcaatgatgagaaagaacccactgttagaaaggttgttccaggcacaaggaacagcaggtacaaaggctcggaggtcggaatgaacttaatgtgttcacagaacagaaagaaacccagtgtacctggagagcagccagggccggaggagaagtgggcagcacgctagatgaacgcagctcttgcagccttaccaaggcatttggattttattatgaatgtgaaaggaagctgccaggggtgggcgttaagcagaggagtgcctcgatctaattgatgtgctaaaaagagcactctgcttaagaagccattcctttcccaacctggttccaacatttgcaaacactgagttcttaaaagtggaatgacgactgggtcagcgggtttcgaatttaaaatgtgcctgggtgctgccaactgcctccccaaaagatagctctaggttttaccccaagggtgccagctcctgcgatagcctgcagcatttggggtgagggtcgggcgaattcgcagccctgggccccagcacccactctctggcccttgctttccttgtaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggtgagtgagccacctattccaccttccccacctggcttagctgctgtaagggatggagggttggagtcgctggttggggacttcttcgtatttccaaaccctggacagtgctctaaactctgagctgaggatatacttgttaagcagggagggtattattgatttaaaataaatttcattaccttggaactgggtgtttttcaaatagtagcccaggacacactacggagttgtgaaaaccttttgctgagttttgtccaatgttttgttttgtttgtttatttattttagctttctttagagacagagttctcctctgtcacccaggctggagtgcagaggtgctgttctttttttttttttttttttttttttaaagaaatggaacagaacagaataaaacagcaactattggggaacattgcaaactgtaaagatcttatttctttgtaaaaacgtttatttatttatggcaatagaaaatccccaaactaaggaccttatttctctttctctctttttctttcttttccttcttcttctttttttttttttttataaacgtggtctcgctttgttgcccaggctgcagtgcaatggcacaatcatggcttactgcagccttgaattcctaggctcaagcaagcctcccacctcagcctcctgagtagctaagattataggcttgtaccactatacccggctcattaaaaaaattttttttgtagaaatggggtttcccaggctggtcttgaactaccacgcccagccacttgttgttaattttttgaaagaatttatttaacaacataattttaggtcaggcgtggtgtctcacacctgtgatgccagcactttgagaggacaaaagggaggatcacttgagcctaggagaccagcctgggcaacatagtgagaccctgtctctcaaaaaataaaataggctgggtgcagtggcttacgcctgtaatcccagcagttggggaggccaaggcaagtggatcacctgaggtaggagttctagagcagcctggccaacatggtgaaactccatctctactaaaatacaaaaaattagccgggtgtggtggcgcacacctgtaatcccagctacttgagaggctgaggcaggagaatcacttgaacctgggaggtggaagttgcggtgaactgagattgcaccactgcactccagcctggacagcaagagtgaaactccttctcaaaaaattaaaataaaataaatacatttattattcattttatttttttgtattccactctgctgcccaggctggaatacagtggtgggatctcggctcactgaaacgtccgcctcctgggttcaagtgattcttgtgcctcagcctcctgagtagctgatataacaggcatgtgccaccacacccagcaaaagttttgtattttcagtagaaacagttgcactgtgttggccaggctggtctcaaactcctggcctcaagtgatccacctgcctcaggttcccaaagtgctgggattacaggcatgagccactgcacccagcctaaaataaatttaaaaacataattttattgaaaaccgtttggtaggtgccagcgtgggtacttgattacatgaaatttgcatttatttattacatattatatatctgtcaccaggctatgcactgagtacagacaggcaaacagcaattgtttacagacttaacaatctccccatttatcagcagagacattcaagcggagaaacaaatataataactattagttactttgatagaaacttgttttagggacactgaaaaaaatgatctcatttaacatttatagctatcttggctgggcacagtggctcaagcctgtaatcccagcgctttgggaggccaagatggtaggatcgctttaggccaagagtttgagaccagcctggtcaacataggaacaccccatctttattaaagaaaaaaaaaaagaaaaaatgcttacagccatcctatgtagttacagctatgaaggataaaccaaattctttttttttttttttttttttttttgagatggagtctcactctgtcgcccaggctggagtgcagtggcacaatctcagctcactgcaacctccacctcccaggttcaagcaagactaaattcttatgaatcattacttttgaaacaatacctagtattgtgtgtcacacattataggtgcttaataagtgttatttccctctctgttgccacattccaggagtgtggtcctaataatttgtcactgattatgagaattaatatattttttaaaacctttccacaaattaattaccttttcccaaatttgtttactgattaaaagctcatactgtgggctgggcgcgacggctcacacccgtaatcccagcactttgggaggctgaggcggacagatcacaaggtcaggatttcgagaccagcctggccaacatagtgaaacccatctctactaaaaatacaaaaattagccgggcatggtgttacaataaaactccagccaaggaaaagacaaagagacctttggaaaccaaagagaactttatttaattcaggtacccgggccgacagcaggcccacgcctaaaatggctgccgactgggacacagaaagcaggcttgcttatatgtcgtttgaggagggaaaacaaggcaggatacaggtttcagacaaagacagtaaattatttaacacgtgacaattctgagaaaacatataatttagttatcttgaccagtcaactttgaagctggacagctcgagcttcggggtaagggaaaacaggaattacagaaatacgcgggggtctggaggcaggcaataagcttggaagattgagataagctcatagctgcaacttgttagcaatgctgggaggggctgcttaaatttcttagcctatgtataacttctaaataacctatacttaatgttaactattacttatgtttattatttttaactttattattacttattttattttccttccacaatggtggtgcatgcctgtagtcccagcttctcaggaggctgaggcagaagaatcccttgaacccaggaggcagaggttgtggtgagccgagatcgcaccactgcactccagcctgggcaacagaggagactccatctcaaaaacaaaaaacaaaaaacaaaaacctcatactgtggaaggtttccgtctcaagtgtcttctacatttgtccaattttgtgttgaatattttgaaagcacccctgcatatgcgtgtatgtgggtacagagacatatgtgcaatgtgatccttcatgttggttatcgtaaaaaaacaaacaaaaaaacactttttagagttggacatccttctctggactgaggaaaagtgtacttattttggtagggatttgtgttcataccatagcaaagctggtataaagaagacggggagaagccgggcgcggtggctcacgcctgtaatcccagcacgggcaggcagatcacctgaggtcaggagtttgagaccagcctggccaacatggcgaaaccccgtctctacgaaaacacaaaaattagccgggcgtgttggtgccacctgtggtcccagctactcgggaggctgaagcatgagaatcacttgaacccaggaggcggaggttgcagtgagccaagattgtgccactgcactccagcctgggtgacagagcgagactccatctcaaaaaaagaagagggggaaaggcgaacattattggactttttataataactggtgggggtaaaaaatcaaaagtgcaataccattaccctttcttaatcaaatcctcacaaacagttaagtatcagtactgtaaacaaaatgcctattaccacttggggatttgaaattaaaaataatcttccataacttctgaattaatctgtttttagaaaattaataattttagttcttggagatagttgggtaatgttttccctttaggcctagagttctagctggagttactctggggcaggcagctccagaaatagccccgtgggtctcctctggggtccgggggcccctgaaggggcaggtttccactgatcctgtttcctgtcctaaggcagctttgaaatgaacacccaccccgaggaggacagctcaagtgtccgcaagaggggctgatttaaattacaggcattggttctcacagaatgctgtgtttacgttagaacaaagtgatgtttctttccttctttttttttttcgagacagggtctcactctgtcgcccaggctggagggcagtggtgtgatcctggctcactgcaacctccacttcctaggttcaagtgattcttgtgcctcagcctcccaagtagctggaaccacaggtgcacgccactatgccctgctaatttttgtatttttcgtagagatagggtctcgccatgttgcccaggctggtctttaactcttggcctcaagtgatccgcccgcctcagcttcccaaagtactgggattacaggcatgagccgacatgcccagccttttcttcttcttttcttttttcttagagacacggtcttactctgtcacccaggctggagtgcagtgacatgatcatagctcattgctgccttgaactcctgagctcaagcaatcctcacacctcagccttctgagtagctaggaccacaggtacatgccaccatgcctagctgatttttaaaaaaattttttgtagatatgaggtcttactatgttacccaggctagtccaaagatgaagatgattctatgtgatttgaccttttttgttgttgttattgttttacatttttttgtagagagagggtctcatactatgttgcttaggctggtcttgaactcctgggctcaaacaatcatcccacttcagcttcccaaagggggattacaggagtgagccaccacgcctggccatgatttcactctaaaacagtgcctactattacatatagtatgtgtgtgtgcaaatccataaagagcctttggcacaagcctggtccataataaagtcaaaaaatgttagcatttttatatatgtagttaagttaaaaagcaagttgaaatatagtatgatgcttttttttttcttttctgagacagagtcttgctccatcacccaggctggagtgcagtggtgcaatctcggctcactgcaacctctgcttcccaggttgaagcaattctcctgcctcagccttccgaatagctgggattacagccgcccgccaccacgccttgctaattttttatttgtttatttatttatttattttttgtatatttagtagagacgggggtttcaccacgttggccaggctggtcttgaactcctgacctcgtgatccacccacctcgacctcccaaagtgctgggattacaggcatgagccaccacgcccgacctgatcctatttttattaaaaatgtatatacatatatattggtatctgcatagcaaaaaccatttgaaggggaagtttgcacccagcagttagtggcagttctctctatgggagaggtaccattaaaggggggctttgtatattttttaaacattttaaacttttaaagttacacatatgtatcacttatgtggagaaaaagatgttgttaagaaaaataaagtaaaataaccaggtaacttcctcttcctcaaatacattgataaataccccctcctcaaaactcatcacttctggccgggcacggtggctcacacctgtaatcccagcactttgggaggctggggcaggtggatcacgaggtcaggagtttgagaccagcctgacctacatggtgataccctgtcactactaaaaatacaaaaattagccaggcatggtggcacatgcctgtaatcccagctactcaggaggctgagccaggagaatcacttgaacctgggaggctgaggttgcagtgagccaagatcgcgccattgcactccagcctgggcaacgagagcgaaactctgtcttaaacaaacaaaaaaaaaaaaaaaaaaaaaagcttcatcaccaggatgggagtgtcttctaggtccctccgctccaggacctttctaggctctgttcatcccctccactcacacacatctggaagctcctggaatgggcttccctttttcacacctctgccttataaaatttctttcaactgatgtcctggtctatcaaaattacagttctgcctccttcagaacccagctttaatttttatttttttaattttaaagacaaggtcttgctgtgttgcccaggctggagtacagtggcatgatcataactcactgcagcctctaactcctgggcttgagcgatcctcccacctcagcctcctgagtagctgagaccacaggcgtgcaccaccacacttggccaacttcttaatttttttttggaacgatggggtctcattacgttgcccaggctggtcttgaactcctggcctcaagcagtcctcctgcctcagcttcccaaagtgttgggattacaagcataagcgattgagcctggcccagagcccagattgaagacaacctttccaggctttctgctctgccttccgtggggctcttagcagacctttatgtgtgtgagtcattctccagtgtcgttctttgtttgagtcagcacctgactgcaagagtagggttgtgtctgatgcgacctccattcccttggtcctgcgtagtaggacttgataaaatgtttgactgtgtgtggacgggagttggcacttcattgcttactttctaggttatcgaaagcaggctctgttgggttagtgttgccaggggtggcttcagagggagacaacagctcagctttccaacctttgttccctcagcatcccataaacctaagtggttttttttttaacgcactgtgacctggaaacttggattgtttaaccaaaatggcccgctggcctccctccaaggaacacacccagcaggtattgggtgtggattgtgaaaggtcagattctatcgctgtcaagcccagccttctgcccaagctcccgtggagacgtggcagaaccattcagggggccgccctctccatagaatatcaggcagtcatccaaagatgtttatagagtttatgataacgtgggaaagtgcctctgctccagagttaaatctaaaaagaatacagcatgattatagctctgtgaaactcgcacgtacacatacagccaaggcctgaggggaagcacatcaccagggcagcaggaattgtctttggattggattaggagggactgtgttccttttctccttctctgtcatttctacattttctagaataagcatagggagcaaatacatgtttttaatttgttattaaggtgggaaattttatttttaaatattattttcagccaggtgcactggctcatgtctgtaatcctaggacttttggcggccgaggcaggtagatcacttgaggtcaggagttcgagaccaccctggccaacatggtgaaaccccgtctctactaaaaatacaaaaaaaaaaaaaatagccgggcatggaggtgggcacctataatcccagctactccacaggctgaggcaggagaatcacttgaacctgggaggcagaggctgcagtgagagattgcaccactgccctttagcctaggcaacagagcgagaccctctcccctgccccctggcaaaaaaatattttcctgatctgagaatatctcagagctcattccacatcaatacacatagatcaccttatttaaaaaaatttcttttgagatagggttgcccaggcagaagtgcagtggtgtgatcatagctcactgcattgaaatcctgggctcaagtgatcctcccacctcagcctcccgagtagctgggaccacaggcatgcaccaccatgcccagcctgttgttggttatttaatggctgaatatcatttcattgttggaagcaccataataaatgtagccagcccctccttgtagggtatgtaggttatttccagtcttgtcctgccacaaacagcacttccttgtgcatgtgtctttgcacccatgaatgggcgtgcccaccagaggaccccccccagaggtgaactggctaggcaaaacgtttgtgtgtttaaactgggataggtgttgtcggttgctcctcaaagaggttacaccatcgtgtgtgccccccatgatgggtgggtacacctgcttcccatgcccttatttggccaactttggtgattacactcatacttgtaacccactgagggcagctctaacagcatgatcaaagaataatgattgccttgggaggccgaggctggtggatcacctgaggtcaggagttggagaccagcctgaccaatatggtgaaacttcatctctactaaaaatacaaaaattatctgggcgtggtggtgtgagactgtagtcccagctactcaggaggctgaggcaggggaatcacttgaacccgggaggcggaggttgcagtgagccaagatcgcaccactgcactccagcctgggcaacaggaaaaaaaaaaaaaaattttagcagtttttggaaatataattcacatgccatacaatttacccatttaaaatgtactattcaaagcctttgagtatattcataaaattatgcatccatcaccacaaccacttttagaacattttaccccaaaaactaaattctataccccttagccatcacgctctaatatacacatcccacccagccccaggcaaacaccagtccactttctgcctctctggacttgccttttctggacgttttacataaatagaatcatacaacatgtggccttttatgtctggcttcttttgctaagcataatgttttttgttgcttttttttttttttttttttttaggggcggtttcactctgttgcccctgctggagtgcagtggtgccatctctgctcactgcaacctctgcctcccaggttcaagtgattctcttgcctcagcctcctgagtagctgggattacaggcaacatggtgaaaccccatctctactaaaaatacaaaaaattagccgggcatgggggcgcacacctgtagtcccagttactggggaggctgaggcgcaagaattgtttaaacctgggaggcagagattgcagtgagctgagattgtacaactgcactccagcctgggagacagagcaagactgtgtctcaaaaaaaaaaaagtgcagatattttgctattaagatcttagtgtatagttcagactttactgtatttcactttaaatatacacaaatatggacattttgttgctactgtagaatcatgctatatatgtcttcagtaaccagtttttttcggcaagcaagaaatcatcatgtcttttcagatcagtaaatatggatgtagtgtcttgatggctctgtcagcccattgtatggctacaccacagtttctttaagcattgcctcttgtgggatacttaggcagtttccacgtttgtttgtttttgagatggagtttcgctcttgttgcccaggctggagtgcaatggcacgatctcagctcactggaacctctgcctctcgggttcaagtgattctccagcttcagcctcccaagtagctgggattacaggcatgcaccaccacgcctgactaattttgcattttttagtggagatggggtttctccatgttggtcaggctggtctcgaactcctgacgtcaggtgatctgcctgcctcagcctcccaaagtgttgagactacaggcgtgagccaccgcgtctggccagtttgtttgttttttaagagatagggtctcatgctgttgcccaggctggagtgcagtggcacaatcatgggtcactgtagcctcgacctcctgagctcaagtgatcctcccaccccagctccccaggtagttgggactaaaggcatgcgccatcacgcctggctaatttttgtatttttttttttgtagaaatggggtcttgctatgctgcccaggctgctctggaactccaagtgtcaagtgatcctcctgccttggcctcccaaattgctgggatcacaggcatgaccactgtgcctggtttccagttttttgctgctgtattccatgctgggttccactgataattgtaccaaacctctaagtgcatgtggcatagattgtggcctctacacaccactgttggtctctttccattccagagcctcactgtgttcccccacttcttcccgcttcttttatttgagcccttgagtttggttaagcccattactgctctgcaggaggggagagtagttgggctgtctctgagttgtatttctttttttttttttttgcctcgacttcccaggttcaggtgatccttccacctcagcctcctgagtagctattactacaggcgcatggcaccatgcctggctaattttttgtatttgtagtagaggcagggtttcgcaatgttgcctagacttctgagctgtatttcataaagtctgcagaagtgatgatggggaaaaaaatgattttataacatgaagtgactgtaacaggtgataaaggcttgggtgagtcactggatgtgtcctcaagtaaccaggggccttgattactgtgataatggcaataataacagtaatataaaattggcaacaacagtgataacatcccacgtgccaaaacatttgcaaacacattgccggcactccaccctcactcctggcatactcgatgaagtaaattattattactatagtaatcattattattatttccatctccctttcctggtatataattattatgatttcactattatttatttttattttgtactctcagactttgaagaaccacagcctttctattctgtagccagaattatgttttcctttttttatgaaatatccacagacctcttttttttttttttttttttttttttttgagacagagtcttgctctgtcacccaggctgtagtgcagtggtgcaatctcagctcattgcaacctccacctcctgggttcaagcgattctcatgcctcagcctcctgagtagctgggagcacaggcacacgtcaccacgcccagctaatttttatattttttgtagagagggggtttcaccatgttcaccagactggtctcaaactcctggcctcaagtgctccacctatgtcggcctcccaaagtgctaggattacaggcatgagccaccacacccggcccatagccctctgttctatgtaagattaattaacctactcaacaactgagttccggaatccttagaaatagaggatattagagctggcacggccttaagaatcatctaacctggccaggcgcagtggcttatgtctgtaatcccagcactttgggaggccaagacaggtggatcacttgagtccgggagtttgagaccagcctgggcaacatggtgaaactctgtctctacaaaaatacaaaaaattagccaggcgtggtggcgtgtgcccataggcccagctacccgggaggttgaggtggaggttgaggtttcagtgagccatgattccattactgcactgcaggctgcgcaacagagtgaaaccctgtctcaaaaaaaaaaagaaaagaagaaaactcgtctaacccagtaatttttgtttcttaactttgatttacacaggcattacctaaatacattctcattgtaaaaagaatgcaaacaacatagataaactgaggtctctttgagcaacttcttatccctttctattcccagagataagaattatattagtttcatataaattacttttcagacctctttttgtgcatttgcatataagtatacatttgtgtgtatgtctacagacacacacatccttagaaaatccatggtattgatttgtgggtttccgccaccagtaagtggtatcatagtgtttgtattgttctgtaacttgcttttttcccccctaaacaataggtcttagaaattgcccatgctgggtgcggtggctcacgcctgtaatctcagcactttgggaggccaaggtgagtggatcacctgaggccaggagttcaagaccagcctgaccaatatggtgaaacctgatctctactaaaaatacaaaaattagccgggtgtggtggcactcacctgtaatcccagatactcaggcagctgagacaaaattgcttgaacccaggagacggaggttgcagtgagcagagatggcgccactgcactccagcctggacgacagagtgagaccacgtcccccactccctgcccggggggaatacaaagatcacccgtgctagcatcttattttgagtataccaagtgtatgtgatcatccccctacagatgggcagtttgtactgcctgatcattatggcattataagtgctgaccttgaggctagagttcaagaccaccctggacaacatagagagactgtcatctctacacacacacaattttttaaattagctgggcatgatggtgagcacccatagtcccagctacctgggaggctgagttgagaagattcgttgagcccaggagttggaggcttcagtgagctatgatcccaccactgcacttcagcctaggcaacaaagtaataaatacctggtctcaaaaaaaaagaaaaaaggaaaaaaaaaaaaaaaaaaagcactgatcatccttggaccagcttacctggacacacctgggtaggtgataggaatggctgggtcagaagtcggtgcagaagaaggttcatagccactgccaggtggctctcaaagatggcagtacctgcttccattccccacctgatggtaacattactggtgatttgtagctccagcaggagtcacccataataagcactgccaccccagtgagccactgtttttggtgggagtgtgtctaccctgggtgcaggggccacaaaaaagtggaccaccagcagccaaaaccttcttcatccttgtttgtaaacaaggaaatggaggttcccacagccagtcagtaagctggaaccagagtcagggacatgaatgttagtacagtactttttatactgtgcttattaaaaaaaaaaaagtcagttgcattaatcccacctgttgccaataaggtctggcatgactctgttctgggtttggaaaaaaggtaatttttattctatgaaataccacaccctctaattctgcagtactttcctccctgttttgtggttggtgccacggcatccagccaggaggtaatttctgttgctaatcttcactgaatggggacggtccctgttagtggcttacggagtggcggagtcgtttgagagaggcactgtcagagaattgtgtgtcgtagacagagaacagggcacctgtacagacatgcttggaagggtggcctgctgaattctcaaccctgcaggctctcctgacaggtggaggtcgaaggctgtccctgccatttgtagcagccggaatatgagctgagactggtgctttaagttacggggattgggctgggcgtggtggctcatgcctgtaatcccagtgctttggaaggacaaggcaggaggatcacttgagcccagaagtttgagaacagcctgggcaacataccgagatcctgtctgtacagaaatttaaaaaattagccaggcatgatggcaagcgcctgtcatcccagctattcgggaagctgaagcaggaggatcacttgaacccaggagtttgaggctgcggtgagctgtgatcatgccactgcattccagcctgagtgacagagcaagaccctgtctctttaagagaaaaagtacaggggccaggctcatgcctgtaatcccagcactttgggaggccgaggcaggcggatcacaaggtcaagagatcgagaccatcctggccaacatggtgaaaccctgtctctactaaaaatacaataattagctgggcgtggtggcgcaagcctgtagtcccagctgctcaggaggctgaggcaggagaatcgcttgaacccaggaggcagaggttgcagtgagccgagatcatgccacttcactccagcctggtgacagagccagactccatctcaaaaaaaaaaaaaaaaaaaaggtacagggaccgaaattcagaaaaatgttttagacatacacatgtctgctgtggggttatttacaacagggagcaatcagtgacaagcttgaagtctaacagtggagagcaacaggtgaataatcaagtcaataacaaaaaagttatacagtagattattatgcaactattaaagcaggatgcaaataacttataaattttatagttatctgatgtactgtctgtgccaaaagaattttagtgatttgtttactgcttcttggagtataacttgggataaattttttggcagagaactcagtcatttctagattttaaatgtgatccagcagttacatttcccaaaaaatatgtactactgagatcttgcacaagcgcccaagatttggataggaagatgttcacttcagcactgtttgtactaggaaatgttggagggaacccaaacattattcaattggaggttaggcaaataccttaaggtacatttatataattatatatctggtagttctggaaatgaaaggaggttaccccagccagtctgcacatatgacatggaaagatgtccaagatcttacattaagaaaagtcagatgcacaacagaacatgtggtgtggtccaattgctctttctttttattttgttttatttttatttttttgagatggagtctcactgtgtcgcccaggctggagtgtagttgtgctctcttgcctcactgcaacctccgcctcctgggttcaagcgattctcctgcctcagcctcccaagtagctgggattacaggctcgtgccaccatgcccggctaatttttgtatttttagtagtgacagggttttaccatgttggccaggctggtatcaaactcctgaccttgtgatctgcctgcctcagcctcccaaagtgctgggattacaggtgtgagccaccgcgcccggcctaaactgctcttaaatatgtgtttatgttcacagaggcataggaaaaaattttgcagaatgtctacatcaactgtcagctgtggttttcagaggaagtggattagggaggacttccgctttctaattcagagttctatagtgcttgcagtttttatgtgatgtggatcatactttggaatcagaaaaaaaaattgagatcactaaataaagcacaaaatcccattgacccactcttctgtaaggaggtgaattatattttatggtatgataccaatcttattaaaaaatgcatgtaggccgggcaaggtggccacgcctgtaatcccagcactttgggaggccaaggcgggtggatcacctgaggtcaggagttcgagactagcctggccaacatggtgaaaccccgtctctactaaaaatacaaaaattagccaggcatgttggctcacgcctgtaatcccagctactcaggaggctgaggcaggaaaattgcttgaacccaggaggttgcagtgagctgagatcaccccactgcactttagcctgggtgacagagggagactgtctcaaaaaaaaaaaaaaaaaaaaaaaaaacatatagaagatctggaaaagaattagtctacggcattgctccagtggatggtatatggtggatttgacttttgtcttctgtattctccaacttttaaattaagtctaaattagctaccaaaatagaagaaaagaattacaggctttattttttgaactctgcagaggtaaaaaagccccagcaggctaggtgcagcagctcatctctgtaatcctagttccttgggaggttgaggcaggaggatcacttgaggccaggagttcgagaccagcctgggcaacaaacgtagtgcaacccggtctctgcaaaataaaaataaaaataaaaaaattagctgggcatggtgacacacaagtgtagtcccagctactcaggaggctgaggcaggaagatcgcttgagcccaggagttttgaggttgcagagagctatgatcacactaccaccacgtagcctggacaacagagagagaccttattcctatttaaaaaacaaaacaaaaacccaaaaacaaaagaaagccctagagagagtgagaggcctgggctctgtgtgtgtgtattggaaggcccagctccactgcctgagctgcttctattttgagcaggacccagtgctggggatgaggtgaagccctgtttgggctgagtccttgggaagctggactcttttttttgggtacagagtcttgctctgtcacccaggctggagtgcagtggcctgatctccattcactgcaacctccacctcctggttcaagcgattttcctgcctcagcctcccgagtatctgggattacacgtatgcacccagctttttttttttttaaagtagagacggggtttcaccacgttggccaggctggtctcgagctcctgaccttggatgatccatctgcctcggcctcccaaagtgctgggattacaggcgtgagccaccatgcctggctactctcaataggttttgatagatttgggagttcttttgggccatcataatgatggggtggtgggcactgctggcatagagttagggaaggccgggaatgccagcaaccctgaaacagggctgttctgcacgatgaattttcctgcatcccacaagatcttggaacagctcatgggaatcgtttcataattatctgaggccagagttaaatgctatgttatgtgtaaaggcggcgtatcctttgggaggctgaggtgggaggatcgcttgaagttcaagaccagcctgggcaatatggtgagaccctgtccctacagaaaattaaaaaattaaccaggtatggtggctcagcctggggtcctagctactcaggaggctgaggcgagaggatcacctgagccgtgatcatgccactgcactccggcctggggacagggtgagaccccgtctcttgaaaaaaaaataaaaaataaaaaaggcaacatatctttggcatggttctagctctgagcttagaaatttatgttatctatgaatttcacatagggcagtaaaatggggtgttatataatatttattataaaaagaggtcattgggtctggtaaggtcaagaatctccaccagagatgcagcctattttttttttttttttttttctgagacagggtctccctctgtcactcaggctggagtgcaatggcacaatctcggctcactacaacctctgcctcctgggttcaagcgattctcctctctcagcctcccaagtagctgggattacaagcgtgtgccaccatgcccagctaatttttgtatttttagtagagacagggtttcaccgtgttggccacactggtctcaaactcttgacctcaggtaaaccacctgcctcggcctcccaaaatgctgggattacaggcacgagccactgcacccagcccagcctagaaaagttttatacccccgatggtgtgtgagggtacccgttccctgatatccgggccagcactcgctaaaatgtttcatctcattaaaataattgccagcctgctgtaatcccagcactttgggaggccgaggctggtggatcacttgaggtcaggagtttgacaccagcctggccaacatgacgaaaccccgtctctaccaaaaagtacaaaaattagccaggtatagtggtgtgcacctgtaggtccagctactcccaaggctgaggtgggaggatcgcttgaatccaggaggcagaggttgcagtgagccgagattgcaccactgcactccagcctcggcgacaaagtaagaccctgtctcaaaaaaaaaaaaaaaaaaaaagaggccgggcacagtggctcacgcctgtaatgtcagcactttgggaggccaaggcgggtggatcacttgaggtcaggagttcgagaccagccaggccaatgtggtgaaaccttgtttctaccaaaaaatgcaaaaagtagcagtgcgtggtggcgggcgcctataatctcagctacttgggaggctgaggcatgagaattgcttgaacccgggaggtggaggttgcagcgagccaagatcacatcactgcactccagcctgggtgacagagtgagactctgtttctatatatatatatacgttatattctgtttctatatatgtattgtgtgtgtgtgtgtgtgtgtgtgtgtgtgtgtgtgtgtgtatatcctatataatatatatataatgaaatgttagccaacctgaatgggggaatggtatcctattttcattctcaactctttgatccaagcgttgtgtagttaagatgtgccatttctgcccacagggaggctgtgcctgtgagtgcagataggttcttttggggactgtgttcctgaaaggctactagacaggagtctctctctgtcctgatactgtctgcctctccagaggaaataacagggcaggaggagtccacgctgtccccaaagcccctgacctgggcctgatgttcctaccttctcctttgccttccacaggaagcctggaagcacgcaatccagaaggccaagcacatgcccgacccctgggctgagttccacctggaagatattgccaccgaacgtgctactcgacacaggtcagcagcttgtgtggggtctcgaggagtcctgggggctatacgtccagcttctgttcccaatcagtgaggcctaagtactcttgggggtcaggggaagggagtaatcataacagcagctaatattggcatgctaatgcgtgcttaaggcccggtgcattacctcactgaatccttctcgtggttctcacaaggtacctattagacaggctagactgagctagtttttttaaattgttgcagatctctggccgggtgaggtggctctcacctgtaatcccagcactttgggaggctgaggtgggcagatcacttgaggtcaggagttcaagaccagcctggccgacatggtgaaaccccatctctactaaaaatacaaaaattagccatagccaagcgtggtggctggcacctgtaatcccagctactcaggaggctgaggcaggagaatcgcttgaactcaggaagtggaggttgcagtgagctgatatagcactgctgcactccaacctgggcgtcagagtaacactccatgtcaaaaataaaataaaataaaattgttgcaaatctctgaaacattttccaatatattgattgaagaaagtccatttataagtagacccacgcacttcaaacccatgtcattcaagcatcaactatacttgccctgggccggtgcaaactgtgcagctctggagagctttcctccctctgagcctaggggaggttaacctgccaggcctctgcttgtttttcccggtggaggcatcaggctctgggaaacctgttctcaccgagggtggggtgttctggagtctgccccggctgagaggtgcgctaagggaaacctccaactagagttaagaacacctcagcccggagggaggtttcaaactttagggatccattgagctgaggagatttccaccaggcaaacttgtgtgaggcctggccaggcccaggggctgatttactctgggaaaggagagatggaaatgttccctgaaccctctccaagctctctctgccttaggtatgcacctatctgtgacaaaaacaaacttaatttaacctactgtacccttacaacacagaatgcttctgtgagctcaaaatgtgtggcggtttctccccacccacaagcaagtaatcagctctgcagtggacaccagcagatgtgcgtctaattctgttcctctaattgaaggaattagaggagttttgagttgggtatcctatgattcaattcaattctgacaccatctacctggagatagcatcagatcccacaggttggaggctcagtcctacaagaccgtccccgactttcactgctgatcgcaagcccgaagtggtttcacctgtgcttctgaccagctataaatcagggttcccatgaacccctccttgggtttgattaacttgctggagcagctcacggaactcagggaaacacttactcatatttactggtttattataaaggatgttacaaagggtacagaagaagactgggcatggtggctcatgcctgtaatcccagcactttgggaggccgaggtgagtggatcacttgaggtcaggagttcgagaccagcctgaccaacatggtgaaaccccatctcttctaaaaatttagccgggtgtggtggtaggcgcctgtaatcccagctactcaggaggctgaggcaggagacttgcttgaaccctgggagacagaggttgcagtgagctgagatcgtgccactacactccagcctgggtgacagagtgagactcagtcttaaaaaaaaaaaaaaaaaaaaaaaaagacgtcactttggagattccaaggactttcagagttgcatgccaggaaatggaatctaaaacaaaatatatatttaccatcacacaacctggtactggggctcagaaaatgataccccaaagtgaaggcttcagaaatagcccctctctgatcatctcctgccctcctgtctctcaccccttgttgtctccttaagcaagccattgaaactagaattggccgggtgcgatggctcacgcctgtaatcccaacactttgggaggctgaggcaggcggatcatgagatcaggagtttgagaccagcctggccaatgtgatgaaaccccatctctactaaaaatacaaaaattagttgggcacggtggcatgcgcctgtaatcccagctactcaggaggctaaggcaggagaatcgcttgaacccaggagacagaggttgcagtgagctgagttcgccccactgcactccagcctgggtgacagagcgagactccatctcaaaaaaaaaaaaaaaaaaaaaaaaaaaaaagaaactagaattgcccttgcccactaccagtcatagaaactagaacccctttttcccaaagccagccataaagcttaaaaatattactctaggccaggcgcagtggctaacgcctgtaatcccagcactttgggaggctgaagcaggtggatcacttgaggccaggagttcaagatcagcctggccaacatggtgaaactccatctctacaaaaatacaaaaaaaaaaattagctgggtatggtggcaggcacacctgtaatcccagctactcggaaggctggagcaggagaactgcttgaacccaagaagcggaggttgtagtgagccaagattgctccactgcactccagcctgggtgatggggagattctgtgtcaaaaaaaaaaaaaaattctctaaccttacatgaattttctgtgcaatagctggccataaataaattatggaatgagaccctcattccaaaggggtcctactccatacacaagagaaggaaatgctataacagagtggccaagaagaatcgcaacaggccttgctggccaactcagtctgttaccattagctcatctcctttttgcccaatcacattgcttcacgccatccctgcttcactgaacctcagcataaaatcggattggttcttctgtatctttgagtcttcattctgaaggcttccgtgtcacataaaactggttgtccatgacccttatgatggggaggaaagagatcactcctttctacccgtacaccggcagcccttctcctgtctagactcagagacgggacccttaccctccactgtgtgcggctgttacttctcgggagatgtgcccagctgcctggcaagatcgagggcaccaccaccacctcccctccctgggccatgccgtttgttacggagaccagttatgatcagcatattatttattcagtcattcatccaccttgtatatttattttatgtatgtatttatttttatttttatttttatttttattttttatcttttgagacagagtctcgctctgtcacccaggctggagtgcaatggtgcaatctcggctcactgtgacctccgcctcccgggttcaagcgattctcctgcctcagcctcctgagtagctgggattacaggcatgcaccaccatgctcggctaatttttgtatttttagtgcaggcagagtttcaccttgttggtcaggctgatctcgaactcctgacctcatgatccgcctgccccagcctcccaaagtgctgggattacgggcgtgaaccaccaagtccggccatgtatatttattaagcatccacacacactgggtcctggtgactaagacagacatgggtctgcttttgtggggttacagtccagtgggagccccagatgcagaacaagccagtaaacagcacagcagtgagtgctggggatatggaaatgggggacatggtagagagggaacagtgggtttgaggaaaggattgagaccagtgtgttgggacgtgggagggagggacagtgtctccaacccaacccaggaggttggctgggctatgggccaaggtggagagtgggttggttctgaggtcagtggggagcccagaagggtctttgacctttagccagtgagaaacaggaccacgtgatggacgctgtgccccatggtggatgggtctctgcaggtacaacgccgtcaccggggaatggctggatgatgaagttctgatcaagatggcatctcaggtgagcagagcgttgagccccgtggggacagggctgagcaaagactttctgcagctaactttggtctgtgcacccttctctcccactcccactttatttaatttttgtaacttcgggggattctttgttattgtttatttattggttgtagccagcatttttttttttttttttttgagacagggtctcactctattgcccaggagcacagtggcacagtcacagctcactgcagccttgacctcctggtctcaagccatcctctcaccttagcctcccaagtagccaggaccacaagtacacaccaccactcctggctaatttttttattttttatagagacatgggttccactatgttgcccaggctggtctcaaactcctgggctcaaatgatcctcctgccttggccgcccagagtgctgggattataggcgtaagccaccacacccgtctctactaaaaatacaaaaaaggcttttgaagaaaaaaaaaaaaagataaaagactagaaaatagagtattccctgcatattgaagttaggattgctttatgaaactttgttttagtgtaatatacaatatacacagaaaagtgtacagcttgctgagttgtcacaaaatgagcacactgccttaacatcggcccgtatcaacaaacagaaggcaaccagcctggccaagcccctctcagtcactcctcccatacccacagggtaagcacccctctgaattctatcaccctagattacttttgcctatttttttgcttcatataagtgggggcatacaacaggtattcttttttagagacagggtcttgctctgctgcccaggctggggtgtaggggtacatgatcttgccttactgcagccctgaactcctgggctcaagcaattatcccacctcagcctcccgagtagctcagactacaggggtgcaccgtcacacccagtcaatttttaaaaatttttttttttttggagatagagttttgctcttgttgcccaggctggagtgcaatggtgcgatcttggctcatcgcaacctctgcctcctgggttcaagcaattctcctgcctcagcctcccaagtagctaggattacaggcatgcaccatcacgcccagccaatttttctatttttagtagagacagggtttctccatatttgtcaggctggtctcgaactcccgacctcaggtgatccacccacctcagcctcctaaagtgctgggattacaggcatgaaccactgtgcccagccttaaaatatttgtagagggaggtcttgctatgttgcccaggctggtcttgaactcctggcctcaagtgatcctcttgcctcagcctcccaaaattctgggattacagacataagccgctgctcctggtgctgcaggtgttcttttggtcaacattttgcattggttttcatcgctgcatggtatttcattgaaggaatacacctggttgatttttccagtatattgttgctggacacgtaggttatctccactttttttctcttacagtcagggctgggaaaacgtcctctgagatgcactgtccctcccccatcatcctgcccccgtggattcttcccctcagctggggtggaggaatgggggttccttgtcatcctggcagcctctgggttggaaggcctctatggctttggtgctgagacatagaagggagatccccagggatttcaggattgagatgaggcccagggcacccatttgataggtggcatgtaaggggagcacctcctgtcttagggtcccttttgggtggggcatggggactgataacactctgtgtggtgtctttcagcccttcggccgaggagcaatgagggagtgcttccggacgtaagtgactcagcctggctcttggggccctgcccagagtccccccaggctcctaagagctgaggcattgggacattttcagccaaggaatggagccaggggcctctgccttcttgtagcccaggttcctgtccatctagtctccctcgggccacacattgggcctggctgtgacgatgggctcaggaagaacagggaacaccccacttacctctgccctggtgttgggaggtcaagggaaatgggataggagacctttaacagtgacctttaatccccctgtcccagctctttgaaggatgcagaggggtggggacgtccttcttacctcctgcattttgttcctgctgccagccacccagccacatcagacagggtcttgctgtcctgaggaccagggctgtgtccctggtgaaccccagagtacccaggtaggccccctgttgcctcttcccacaggaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtgcgtggccccactacctgccccctttccatgccagggcagctgggcacagtgtctgggaaagagggccatggtgaatccctatttcaccttctttttttttttttttgagatgaagtcttgctctgtcacccaccaccaaggctggagtgcagtggcatgatcttggctcactgcaacctccatctcccaggttcaagcgattctcctgcctcagccaccccagtagctgggattacatacaggtgcctgccaccacatctggctaatttttgtatttttagtagagatgtggtttcaccatgttggccaggctggtctcgaactcctgacctcaagtgatctgcctgccttggcctcccaaagtgctgggattacaggtgtgagccaccatacctggcctctttcaccttcttaatagtagctaataacaaccactgtttactgagcatgatgaaccaagtcatttattttatttttattttttttgagacaggatctttcttggttgcccaggccagagtgcagtggcataattacagctcactgcagcctcaacctcctgggcttgaacaatcctcccagcttggcctcctgagtagctgggactacaggggtatgccaccatgcctagctaatttttgtattttctgtagagaaagggttttgccatgttgcccaggctggtttcaaactcctggcctcaagcaatccatccacctcggcctcccaaagggctgggattacaggcgtgagccattgcacttgttccagagtcatttattcctaaaaacagagctctgaggtcggaatgtttttatcctcaattacagatgggatctattagtcaggatttttgtttgcaaatgacagaaacccactcaaactgcttaatccgaaaagggaattcattgccttatgtaactgaaaaataatgctgccacaggcacggctggatgcaggattaaactgaggttgtcagaatcttcctccatctctggcctgggtgttcttctgggttggcgtcattctcaggcagcctctgcactagtggtagcactctggcccccagcaggcccaagttcttgttggaatgacaaaacctatttccccagaagttccaataaaagtcccagagctgcgtttcattggctctgattaagtcagatccctattgccgagccaatcacagtggccaaggggcaggaatatgcagattgggcacaccctagccatgtgcctgcccttagagctaggaatgtaggtgttccacccagaccacagggactgagactggaaaaggtgagattcccaagaaaaagcggaagaaagagctgggaatgtatattagtccgttttcacacttctgataaagacatacccaagactgggtaatttataaaagaaaaagaggtttaatggacagatagttccatgtggctggggaggcctcacaatcatggcagaaggcaaaaggcacatcttacctggtggcagacaagagagattgaggaccaagcaaagggggtttccccttataaaaccatcagatctcgtgagacttattcactatcatgagaacagtatgggggaaaccacccccatgattcaattatctcctaccaggtccctcccacaacacgtgggaattatgggagctacaattcaagatgagctttgagtggggacacagccaaaccatatcatagtggatactatgtctgctctttgggaaaccctgggctcaaagaggctaaatgacttccccaaccaggcagagctgtagccaggtctcaaatgcaggcttttcaaccccctgctaggttggcaccttcatttgagcccctagggtgatgagtgactgaggccaagcagaattccctgttgcctttcggcatttgaggaaggatccatgcctctgccctgcatgagcccacagctgagatcttccacagcttgagcatctactacatacaacgcacagtctcctgggtgtgcagaatttattgagcacctgctgtttgcagagcccttgatgaagcatacttgaggcaggcgcaagaagccacagtccccaccctggggggctgtggcttcctctgcaatttgcggccttccagcctggcctcctttctcttcctccacaagcttgttcctgccccaaaaccttggccctggctgtgggcttggcgggcatcttgtgtcaccgtaattcttgcatggctagctacttcttatagttcaggtctcagatcctgtgtcacctcctcagccagcccatctcagacaaccctaagaagtggtccctctgccccagtcacctctgtcacatcattctaactttttttttttttcctgttctttggagcagttagtatgtcattcatttagttaatattttaggtgcttctctcccctaaaggcagagattttattttatcatgttcactgctgtctcctagtgcctaggtgtccagtaaataatactgtggtaggcctggcacagtggctcatgcctgtaatcccagcactttgggaggctgaagtgggcggatcacctgaggtcaggagttcgagaccagcctggccaacatggtgaaacccccgcctctactaaaaatacaaaattagctgggcatggtggtgcacgcctgtaatcccagctacttgggaggctgaggcaggagaatcacttgaacacgagaggcggaggctgcagtgagccgagattgggctactgcactccggcctgggtgacagagcaagactccatccccaaatagtagtagtagtagtagtagtaacaataataataataataataataatgtggttgacttaagggagggagagagacgtggttgtttgagaaggtgctggttgtccactgtggctgtaccactgcccctcgcccagggagccctctggcccagcaggtggccctgctgtaagtttccttgtagggatgggaccagcctttgggcagaaccctctgagaaccgccgctccctgccttcccctcaggccggttctcagaacccattgaagccttgtttggggcaagttctcacctctcagatcaggaccccttcggcctctgcatctgttgtctgcatgtctggtgacccactctccatggatggtcgtttccttgggaaacctggacctaatcctcccaggaggtggcattgaggaggacatgggaaccaaggatgagtccttgtgtaacagggcaagaggtgcaagctagagtccctaatctcccctactccactttacaaaccatatgcactatttatacattttcttctgtgtacaaaattaaacatagactttataaaaacaaaaaaaattcggcaaggaatgtcaaagttccctataatttcccattgcagggagaaaactgctgtttagaggttggtttatatttctctagaattgtagctcctgataaaaatgagttgccaggcacagtggctcatgcttgtaatctcagcactttggaaagcccggggtgggggggcggatcacttgaggtcaggagttcaagaccagcctggccaacatggtaaaacccatctctactaaaaatacaaaaattaggcaggcatggaggcgggtgcctgtagtcccagctactcaagaggctgaggcagaggaattgcttgaacctgggaggcagaggttgcagtgagccaagatcgtgccactgcagtccagcctgggcaacagcctgggcaataaaatataaaataaaatgaaagcaaacattgcctggctcctttttgcatcaataagtttaattcacagactgagcctgagaccctctttatgcaggtaaagaaactgaggcacagagaggtgaaattcagaaatgttcccaaattcacagttttactgtaaggcatagtctaagttgcttagcaaacagacccacaaaatatgtgtggacacgaaatggtttctttttcacttgtgtggaggtcttgcattggtgggtggcttggggtaggcttgtttgtgcctcatctccttgaagccatctagagaactcgttcctttggtcttttttctctgccatcccctcaggggtttgccatggaccacataatcaattctggctcccaagcagagtccaccttacagggcaggctggagttacatcattgcaatgctcacttcccattggctgggcacagtcatgtggccacacttagctgcaagggaagcttagcaatgtcatccctagtgggtggctgtgtacccttttaaaactcaaaggaaaacagagctgagcacagtggctgcagcttgtcatcctaatgctctgggaggatgctggaagacaagaggattgcttgaggccagttcttgaggccagttcaagaccagcctaggcaacatagtgagacctcgtctctataaaaaaatttagatatgagccatgtgtagtgacacacgcctgtagtcctagcttctcgggaggctgaggtgggaggatcacttgagcccagaagtatgaggctgtaatgagccatgattatgacactgcactccagcctgggcgacagagtgagaccctgtctctaaaataaatttttttttttttaagacggagtctcactctgtcatccaggctggagtgcagtgacatgatcttggctcactgcaacctctgcctcctgggttaaagtgatactcctgcctcgacaccctgagtagctgggatttttggtacgcacaagcacgcccagctaatttttgtatttttattttattaattttttttttgagacggagttttgctcttgttgctcagggctggagtgcagtggtgcaatcttggctcactgcaacctctgcctcccaggttcaagtgattctcctgcctcagcctccagagtagctgggattacaggcatgtgccaccatgcctggctaattttgtatttttggtagagacagggtttcaccatgttggccacggttggtctccaactcctggcctcaggtgatccacacaccttggcctcccaaagggctgggattacaggtgtgagccaccatgcccagccttaatttttgtatttttagtagaggcaggatttcaccatgttggccaggctggtctcgaactcctaacctcaactgattcacctgcctcagcctcccaaagtgctgggattacagatgtaagccaccgtgcccagcctaaaaatatattttttttaattttaaaaaaattaaaggaaaagaggagattagattctgggcatcatcaggagctcctacaatagagagctagtaagtcatggagccagggtctgagcccaggcaggcgagttcctctgagccctccccttgccgcttctcagaggaggtgcgcctgggccctcccgcctgagcccactccccatcccaccaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggtgaggccgagctcacctccaccctctgcccaccacagcccttggggtgagatcctggccaggctcagcccctaaagaggaaggtccctgtgggcttggagtctcacccccagagaagcctcttggagcattcagaaggagacccgtcaccccatgacagcttctgtcacctaaggtggccacaggacctgcagcccaaggtccctgcccaactgaagaggcctttttcctttgtcttttcctctatataactccttgaagagaaagcccctcagcatgggcagaggcgtggccagtgcctgcacagacctcagcctgtctcttgacatctcgttttccttcctgtcccctgtaggccttcagccacttcacttttgagcgttccggccatcagctgatagtggtggacatccagggagttggggatctctacactgacccacagatccacacggagacgggcactgactttggagacggcaacctaggtacgtggggaaagccagcctgtttctgcagaaaccacgctccctgctaaaacctctgagttcttcgtacagccaaggaaacaggctgagacactgtacgcgctttttcaagatcatggagatgggagcctggatgtctgatgcctcccagcttggcacgttttatacctgccctggccatatgtatgaggcccaccactgcctgtcccccgtcacagagcaaagcaacactccagacacccccgctctgtccacaggtgtccgcgggatggcgctcttcttctactctcatgcctgcaaccggatttgcgagagcatgggccttgctccctttgacctctcgccccgggagagggatgcagtgaatcagaacaccaagctgctggtgggtgcccagtgtgaccctgcttggcctggcaggcccttctgctacttgcaaagcaagccctgctcccctgtgtggtgacagccaggtcaagcagtgcttaactgatgaataccagggctggaagcatctgtcccatccatgccccagcccgtcccctccagctcagtgcacaaagccctcctgagcgtccttccaatcgagcagctggtatctgcttaggttgggcccattttttaccagagtgaggggaacaggcacgtggagatagtgagaaggcatgtggtgtgtgtgtgtgtttgtgtgatgtattgacaaatgactgaactagtcttagacctggctctccaggcacctcaccaacatacctcccatcctcccattgctacttggaccagggacaagagaatgttgcaaagaccagcttgggatgctggacatagagtggaatgctttctccagctctgggctgtggaatgtggtcagtgctttaggggatactggcaggtcctctgagcctctgttccagatgccctttcttggaggccttaggtttaatccctgactgattttttattttttaagacaatatatcagctcctaaacaggcatgtttaggagctgtggatgaaggggtttcagggttagagggaacaacaggaagagccctttaattcccagagggtgtgtgcgtgacatgagtatccctattaatgtccctagcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccgtgagtgacggttcggtccctagtcactgtgattggaggggacaggtggagcagagctaaaccagctttcatttatgttagaaaaatcagacatgctaatcgaaaaggttcatggccccagtggttttataggtgagtttcattgagtgaactttcaaaacagatcatccaaatgctataaaaacaacccctattgtaggaaacaaagtaacttttatcagtgtgttttatgaaaccagcaaaacctatataataaatttgacaaactaaaaaagaaaattatatcccaaccttatttaaaatttgtatttgtgtatagagaacaaaaaaaaaatctaaatagatattaacaaataaaaatagtactatgttaaaaggttcacctgtcacagttaaatagggatttcacaggaatctgagggttgttcaatgttagaaaagctatgaatgtgatattaatgggtcaaaggagaaaaacagaatcattatttctgacactgaaagagtggagtttgctgatgattcagatgagagtctgtaggaaaggatagaggcaagactgaccccagggtattggcctaaagagctggaggtcatgtattcagggaaagtgtgagcgggagcaggctcagagcaggagagcaagattttattgtttagttttttaatttttctcattttgatacctttgaaagagagaaagattttagtgtcaaacattaaagaagccctttagatgtttccactggaaggtctttggaatagtctggaacaggagtcaacagacttttttaaaaggtcagagagtaaatattttaagctttgcaggtcattcagtctctgcatttggagcatgaaagctaccatagaaaatattaagtgagtggatgtggctgtgttccaataaaactctatggatggtgaaatttaatttttgtcatccatttaaaaatgtaaacactgttcttacaaactataaaaacagacagatagatttggctgtagagggcaggagacagagatagggaaccaccaggagatggttggtgttttttttttgtttgttttgttttgagacggaatctctctctctgtcaccccggctggaatgcggtggcgtgatcttggctcattgcaatctctacctcctgggttcaagcgattctcctgcctcagcctcccaagtagctgggattacaggtgcatgccaccatacccagctaatttttgtatttttaatagagatggggtttcactatgttggccagattggtcttgaactcctgacctcaggtgatccacctgcctcggcctcccatagttctgggattacaggcataagacaccgtgcccagctgaagatggttttgaagctatctgaggcccacttcttgagccccaaatgtataaacgtctgttcttccttcacaactgcattttattgaggaccaagtggtggccaggcacatatgctaataaacacattacaaggataattgcattgtgacaaccctgaggacacacataggtgacaccacttggccagaatcatgtagctggcaaacagcagacttagaataagttctcaaggaagaactttagcctccaggtgctgataacattcttctccttttttgtgcctttctttaaagcttaaaaaaaaaaaaaggcttggtggcaggtatggaccgccctaggccgtgggttggtcttatgcatgttccagtagtggaaccaggacatgatgtctgtttctccctgcccagattggccagtgttcagtgacctcgataacatggcatccagagaccatgatcatctagacaaccaccgggtgagtgtgaagggagggaggctgcaggcttcagaccccagcaggggtaggagtggattcactcccagagtgaatcttcagcttcggaggtgggcagcctagcccaggcactgccaggagggcacagaatgggggaattagggaggatgcagatgaatgtcagcctccagtccaaggctgagctttcctctgagaaaaggtgggtcccttgcagttcccagagatggttagggaagagggactcccagtcagcaacaatgcgatcttgtagtaaatgccagtctcagctccaggtttggtttgaccccacatgtgttggttgtcctatagagccctaatactgggtcttagatgtgtaacacatagcacagtaagccatgtgttctagctcttcacacctagctctccagttagataaacagaacatttcctgaagctttgggttgacttggtggtaagaaactgaaggcatcttatctgcattctcacaaatgtatattatggcaaattataatactctctatgcttgtgtgtgtgtttgaaatatttcttagtaaaattggccaggcatggtagctcatgcctataatcccagcactttgggagaccaaggtgggcagatcacttgagcccaagaatttgaaactagcctgggcaatatgacaagacccccatctctacaaaaaaatacaaaagttagccaggcatggtggcacatacctgtagtcccagctactcaggaggctgaggtaggaggatctcttgagcctgggaggcagaggctgcagtaagccatcatcacaccactgcactccagcctgggtgacagcgagatcttgtctcaaaaaaaaagaaaaaacaaataccttttagtagaggctgggcgcagtggctcacgcctgtaatcccagcactttggcaggccaaggggggcagatcacttgaggtcaggaatttgaagaccagcctgaccaacatgccaaaaccccatgtctactaaaaatacaaaaattagccgagtatggtggcagtttcctgtaatcccagctactcaggaggctgaggcacgagaatttcttgaacccaggaggcggaggttgcagtgagcagaggtcgcaccactgcactccaacctgggcgacagagcgagactcagtctcaaaaaaaaaaaaaaagaaatacttcttagtagaggcggggtgtggtggctcacacctgtaatcccagcactatgggaggctgaggcaggcagaccacttgaggccaggagtttaagaccagtctggccaacatgatgaaacctcatccctacaaaaaatataaaaattagccaggcatggtggcatgtgcctgtaattccagctacttaggaggctgaggcaagagaattgcttgaacctgggaggtggaggttgcagtgagctgagatcacgccactgcactacagcctgggtgacaacgtgagaccctgccacacacacacacacacacacacacacacacacacagaaaagatacttcttagaagaataaagaaggaaataaaactattccgttactaattgtgcaggtgacatgcagagagagctataattcaatgttggtaggtacatggctgaagttttagagattctaaattataccagattcgctttcagaacagaactcagacctgggagaataaaaaatatgcccaactaggccaggcacggtggctcacgcctgtaatcccaacactttgggagtccaaggcaggcggatcacaagttcaggagtttgagaccagcctggccaatatggtgaaacctcgtctctactaaaaatacaaaaattagccaggcgtggtggcaggcgcctgtagtcccagctacttgggaggttaagacaggacaatcacttcagctcaagaggtagaggttgcagtgagctgagatcgtgccactgcactccagccagtgtgacagagcgagactccatctcaaaaaaaaaataaaaatgtgtggttttggttgagggcttatttgtattaaatattgttcccaatgctatatttttgtccgtgggtcatagcccttaaccagcctttgtttttctgcctgtgaagtgggtgagtcactctcagtaaagcacttcctgtgatccacactctcagaatgtaacagtgcatttcacccacacagcccttcgatgtaggggctataatgaatcccataactaaggacactgatgctcagagaagttaagcaactgcccaaggtctcagctggcaagaaataaagccaggatttgagcccaggtcatttggctgtagagcccaaggtccttactgttaccttatactgctccctcgttggccaggcaggtcttgaacttgtgtcctcaagtgatctgcctgcctcggcctcccaaagtgctgggattacaggcatgagccaccacacccggcaagggacagcaggagcagggtgttaggtaatgggacagaggggagaaagctaacagttggggtgttgagatgtcataaccatttccaggtgctcaggggaccaccaggaccctaaggccgtcttctctccacaggagtctgagaatagtggggacagcggataccccagtgagaagcggggtgagctggatgaccctgagccccgagaacatgtaaggaacccccaggaaatgagaccggtgtcacctgttgccttgtttatcctccaggaaaatgaaaactccccttcctggagggggaatatgagtgggtcctgagaagataacaagtaaattaataaagagtatttcaggccggtcatggtggctcacgcctgtaatcccagcactttgggaggccaaggcgggtggatcacctgacatcaggagttcgagaccagcctggccaacatggtgaaaccccgtctctactaacaatacaaaaattagcctggcatggtggtgcatgcctgtaatcccagctactggggaagctgaggcaggagaatcactttaacccagaagacagaggttgcagtgagccaagattgtgccactgcactccagcctgggtgacacagtgaactttgtctcaaaataaaataaaataaagagtatttcagataaagataaatgcaaagaagataaaacaggatcatgtggaccagtaacggggcaagtgtggaggcttagatataaggctgataatggctgacaaatcttatggtgaagtgggagtcctgggctgctgagcagagaggatcctgggtaatagctggacccactcataggcaggatcctgtgaggccccagggaggagggccttggaggtcagtttccttgggtagcctcccagcagcatcctggtgagggcaacctcagacagtatctgccatttagaggtcttaccctgtgctgaaatggagcctgcacatcaaggccagtcttgccaggacacctctgatctcagctttatgattgtgaataaagaacatgctggccgggcgtggtggcttatgcctgtaatcccagcactttgggaggccggggcaggcagatcacttgaggccagaagttcaagaccagcctggccaacgtggtgaccccatctcaactcaaaatacaaaaattagccgggtgcagtggtgcactcctctagtcccagctactcaggaagccgaggcatgagaatcacttgagcctgggaggtggaggttgcagtgagccaaggtcatgccgctgcactccagcctggaccacagagtgagactgtctcaaaaaaaaaaaaaaaaaaaaaaaaaaaagtaaaacagctgggcctggtggctcacctgcaattccagcactttaggagggcaatgtgagaggattgcttgaacctggggagttggaggcagcagtgagctttgatcacactgctgcactccagcctgggcaacagagcaagacccatgtctaaattaaaatataaactaaacatgcagtaggagctctgcccgttaccccagtggctttgtgttgggatcctgcaccatcaagtcagttccacctgctcacacacggagggggacagcaaggctgtgactgcaccagcgttgtcatccctgcctgtgacccagcatcccttctgcttggcagagaagggttccagtgtcacctgggaacatagggccaattttctgagataagggtcacctaggagggccaggctggttccagggaggagggctggaccagctctcaggagaggttcctgggaagaagcttgtcgctttggatcagtgtaatttcttcctccgttcagggccactcatacagtaatcggaagtacgagtctgacgaagacagcctgggcagctctggacgggtaatgcgccctgaggcacccttgtctctgcctcttccctgtctcctccaggctctgttgctgtttctcctgtctcatatctctgctgcctgcccatctgtcttgcacatgtgctaaaggaagattttgcaaagcagcaaatctgggcaaatgctctttgaacctctgcagggcaggatgctgggggatttgtggggaggattagagaagagcagctcagccccatcctggaggggaaatcaccacagggacagctcctgtcttaagtgcctgccatgaaggcacttcgcagtaatcagtttccttcttgcaaccacccagagagacaggctaatgtgactctcatccccattttatgtatgagaaaactgggctcttaagcaactttccccaggttaccctcgcttgtatgtctaacaagcatcagcaagtctgggaaagaccagctctgtgccccacccacccctctaagtgattccctcacacgctttgaactgcccatctttggagcctttactaaggcaagtctctttcctacctgcaaagtcctttctctccctctgtcatctctcttcaaatcctacctgctctccaagcctggatcccagggcccctcgtccaggagccttccctggcctccaccacaggcatgactctggcatctcccagaacactgattatttaccctgtggtattttgtagccagattaggatcttctcagttaggtatggaacagggttgctcaagcaaggcactactggcattctgggctgaatcgttccttgttgagggggctaccctgtgcattgcaagatgtttagcatgcaaacgtgcacacgcacagctgcctggctgtatcctgcaagagcctttggagggggcatctttggccaggagaaatgatgtgttttttaaacccatttcctacagcaacctgctgatgttgctcatgtcgttgtggtgccttgcagaggaaagcaaggggatttgctggaaggtctgaagtgggagtcttctggtgccttatatggggagctggcgaaggggttggtttagagtgagacccccacccccaaccaaatccagattggtaaatgatggggaagcgcttccttgagctgctgaaatctgttccactggctcttgaatgcatgagttgatggaatttgaatgattaaaattggagctgtattagccgggcatggtggtatgcacctgtcgtcccagctactcgggaagctgaggcagaagaatcgcttgaacctgggaggtggaggttgcagtgagccgagattgtgccattgcactccaacctgggcaatagagtgagactctgtctcaaaaaaaaaaaaaaattggagccatgttttgccaataaactttgacatcgtgagggttcactccccatctccctccagccaggctcctgtgtagtaggggctgctgacagctgtgatgctgcgtccacccccagcccctcgcttccctggccggttctttcccttcaggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtatcggcgatgcccattttggagccctgtctgcactaacctggagccccccagctccagcctctcctccgctaatcacttcctcccgcaggctggctgggcggtcttgggtgcggctttggcccgccagacagccaggccgacaccgtagtctgtgtggcaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggtgagcaggtggcggggacccagctgcaggtgggggtgggacttggtcaccctgtggttcacctgcctcccatcctggaagtcatgcattcacctgccttctatcctgaggtttatgcatgccacaaaaatgtcccaggcactggtttgggggcaggcccctccaagttagttgaaactggcagaatcgatctctgtctttggagagggaggggaaggtaagtcacgtttccaggtaataacgacatggtgtgatgggggaagcagaagacaccagtggaaacatgtgaggaagggctgtaactggggcctggaggggttggttcaggcttcctgctcatcagttctgtgtgtatccctagtggctggggcctggcactgagtagatgcttggtagagattcgtagaatgaacagatgaagggatacctacctcaggccagagtggtggcttaaacctgtaatctcagcactttgggaggttgaggcgggtggatcacatgaggccaggagatcgagaccagcctggccgacatggtgaaaccccgcctctaccagaaaaatacaaaagttagccggacgtggtggcacacacctgtaatcccacctactcgggaggctgaggtgggagaatctcttgaacctgggagacagaggttatagtgagctgagatcacactactgcactctagcctgggcgacagagtgagatcctgtctccaaaaaaaaaaaaaattgggggggatatctgctttcgacctgaaggcccaaagggagtgagccaggccaagtgggggaggtgagcagctcaggtagaaggaacagcatgtgcttaggcccagaggtgagagacaaggtgcacccgtgtagctagaggtgcaggagctgaggcagagctggagctgaagcagcagggtgtggacctgcagggaaattgcgtaggagcctgctgctgcttctgtccctggtccgtgagcagagggaggaaaggattgaatgggatctggcaaggcccaggcaaagtgatcttttcccaggagaagttgagaagcccttggcgggcacatcctcccatctgttcccatcctccccatcacgtgggccaacgttgcgcatggacaggtggcctaggctcattgtgggtgcaggacatcagctctccttgacgggttggtttggctgtggcccagtgggtgaatggatctcagactcgagggtgggaagatactccaaagtcctttatttatttagctttttgaattggtaattacattcatgtgattaaaaacttatttatttattgttttgtttttgttttttttgagacagagtctcgctttgttgcccaggctggagtgtagtggtgcgatctcggctcaatgcaacctccacttcccaggttcaagcaattctcctgcctcagactcccgagtagctgggattacaggtgcctgccaccgcacccagctaatttttagtagagacagagcttcaccatgttggccagactggtctggaactcctgacctcaggtgatctgcccacctcagcctcccaaagtgctgggattacaggtgtgagccaccatgccggactatttatttattttagagacaggttctcactctgtcacccaagttggagtgcagtggcatgactgtagctcactgtagccttgacctcctgggttcaagcgatcctcctgcctcagcctcctgagtagctcggactataggcctgagccaccatgcccgaccaaagaagtttttttttttaatttttaaatataaaaagcttaacgatgggtgcagtggctcacacctgtaatcccagcactttgggagatggaggcgggtggatcacctcaggttaggagttcacaactagcctgcccaacatagcaaaaccctatctctaccaaaaatataacaaattagccaggtgtggtggcatgcgcctgtaatcccagctacttgggaggctgaggcaggagaatcacttgaacctgggagacggaggttgcagtgagcagagatcacgccactgcactccagcctgggcaacagagcaagactccatctcaaaaaaaaaaagctttacagtgaaaaatctgccttccaccttccccacatcctctcattctttgaataataggtagccatcattattagttacttatatgtaattccagagtgtattcacttcctaggacttccttaagaaattccacaaaccagttggcttataacaacagaaatttgttctctcacagttttggaagctagaagtccagaaatcaaggtgtcagtagagccatgccttcctctgaaggcttgaggggagaatccttccttgtttcttcgggcttctgggggttgctggcaatcttcagcgttcttggcttggctcactgaaatctctgtctccatctttccctcgtgtccctatctccctgtttcttctgctcttgtaaagacagcagtcatataggatttagggcccacctaacatccagtgtgacctcatcttaatataactattttttttttttcagtcttgctctgtcatccaggctggagtgcactggcaggatctcagctcactgcaacctccacctcccaggttcaagcaattctcctgcctcagtctcctgagtagctgggaatacaggtgcctgccaccacacctggctaatttttgtatttttagtggagatggggtttcaccatgttggccaggctggtcttgaactcttggcctcaggtgattcacccacctcggcctctcaaaatgctgggattacaggcataagccacagtgcccagccagtataactaattatatcttcaaggaccctatttccaaatcagatcacattctgcatggacgtgaatattgggaggatattgttcggcccagtacacggtttccatatacaaatatgaaataggctcctattttcaccctgctttttcctccaaagttagcatcctacacacacactcctgaacctagtgtttttcacttgacagtgtcctgtggacattttacctcagtggtatagagatagcttcctgattctttttttttttttttaatttgagacagaatctcgctctgtcacccaggctggagtgcaatggtacaatctcagctcactgcaacctccaccacccggttcaagcaattctcctgcctaagcctcctgagtagctgggattacaggtgcctgccaccaaacccggctacttttttttttttgagatgaagtcttgctcttgtcctccaggctggagtgtgatggcatggtctcacctcactgcaacctctgcttccttggttcaagcaattctcctgccttggctccccgagtagctggttttacaggcacctgccaccacgcctggctaatttttgtatttttttttttagttgagacagggttttaccatgttggccaggctggtctcgaactcctgacctcatgtgatccacccacctcagcctcccaaaatgctaggattacaggtatgagccaccatgcccagcctaatttttgtatgtttagtgcagatggggtttcgtcatgttgttctcaaatttttgacctcaagtgatctgccttcctcagcctcccaaagtgctggattacaggtataagccaccatgcccagccagctccccgattctttttgacagctgcataatgttctgttatatgtgtggggcatacctgtgagctattgatggacacttgggttggctgtattcttttgatatcacaaaaattgctgtagtgactggcctcctgcataatgggtggaacctcatgaaactgctattttggaaggtcataaatggtagaatattggcagtttcttatggttcagtcagattacatcatttgacatgtgggcagggcgtcgcccaccagtttttgtttcatgatggtgagacaaaaacttagatggtgaggaggaggtttggttggaagagaggatttttcacttttttgtctctctctataatctctctctctatatatatgtgtgtatatatgtgtgtgtgtgtatatatatatacatattttgtttttcttttttttttttttttgagacaggctctcgctctgctgcccaggctggagtgcagtggcatgatcttggctcactgcaacctccgcctcccaggttcaaacgattctcctgcctcagccacccaagtagctgggattacagatgtgcaccaccacgcctggctaatttttgtatttttagtagagaagggatttcaccatgtgggccaggctggtctcgaactactgacctcaggtgatctgcccacctcggcctcccaaagtgctgggattacagaggtgagccaccacacccggcctttctctggaatctctatgctcattcagccagtggtgtgctggggaacatttgacaattgactcttggaggtgggaaggaaatgtgtgcccacatatatgtaaatatattaaattttgctaatttaaagaataagtaggctgggcatggtggctcacacctgtaaccccagcacttttggaggccaaggcaggaggattgcttgagtccaggagtttcagaccagcctgggcaacatagcaaaactccatctctacaaaccccccacccccaaaaaaacaaattagcctggtgtggtgcacctgcctgtagtcccagctacttgggagagtgaggcgggaggataaaaaccatacactacaggagtttgaggcttccgtgagctatgatggagccactgcactccagcctgggcaaaagatcaagaccctgtctcaaaaaaaaaaacaagaaaaaataatatgtggtatatggtttacaaataacaatgaaaagtaaatttcatatcatcaactctcacacaatacttgcactgatttttgcaaactcttacacccatagccaacctatggttgcaattgatggagaagtgtagttctgacataagtgagatgaaagtgaaattaacaaagacctatgttagaactggaacttcatttgcctctgatgtgagcgacctccttcctgaatcagatggtagttttaaatactggaaggatatttcttcaatttgctgtactcgtcacaatagaatagctacaggcatgacccgcttgttagtttcatctgcagtgttcatgttttccacgcctttcttacaatagaaaaaacagtacatcaaaccctgatttgcagcattgtctgctttctaccaggtaagttatatgtgacccagcagtttcactcatagccataaacccaaaagaataaaaacacactttcacacaaaaacttgtacacaaatcttcatagcagcattattcataatagccaaaaaatggaaaacaacccaaatgtctgtcagtggatgaatggataaacgaaatgtgatacagccatacaatggactattatttgatcataaaaaggaatgaaatattgatatgcgctacaacacagatggaccgtgaaagcactgtgctaagtgaaaagagtcgcaaaggaccacatattgtatgactatattattatgaaatgtccagatccagaataggcaatccatagagacagaaagtagactaatggaagcctagtgctgagcaggatgaggagagtaggggtagagggagattgacagttaagcggtatgagatttctttctggattggtgaaagtattctgaaattgactggtgatggccatactgttctgtgaatatactaaaaactacggatgtgtactttttttttttttttgagacggtgtctctgtcacccaggttgcagtgcagtggcttgatctcggttcactgcaacctccgcttcctagattcaagcaattcttgtgcctcagcctcctgagtagctgaaattacaggtatgcatcaccacgcctggttaatttttgtatttttagtagagacggggtttcaccatgttggccaggctggtctcgaactgctgacctcgaactgctgacctcagatgatccacccgccttgacctcccagagtgctgggattacaggcatgagccacccagcccagctgtgatgtgtacttatgatgtgtacttctgatgcagggcaggcaggccccacattggagcttagcccaggagggttttttgcttcacccagaaaagaattcaagggtgagccaaatgtagaagaaaacagctttattgaagtgtcagtgttatagcttaggcagtggtacagctccatgactgcttctacggaatagggctgccccacaggcagtgtgctgagattagcagcttagggcagttctgcagtcagatttatacctacttttaattgcatgcatattaagaggcggtttatgaagacatgtctagggaaagggtagtaacttctaggttgtggggccatagccatagaaacaggcagtaactctcaagtgttgccctgacaatggtaaactgacatgttgcacaggtgggcgtgtcttatgaaaagctgttttcccaccccatccctgttttagcttgtccttgatttgttccagtgtctgagccaagcctctggagtcaagtgccccctcctatctcacttctatagcctcccaacccggagctctcaaaaaacagggtgaagattgagtagtgagatcttggcagccctcgagtgtaagcctcattcactcttctttctccctctttggtttgtatcaacaggagacagaagagaacaaaaccaaaggatttgattacttactaaaggccgctgaagctggcgacaggcagtccatgatcctagtggcgcgagcttttgactctggccagaacctcagcccggacaggtactgcagctgtcacccaggaggagctggtaggaacctgggctgcaggtgggcgcttgtcctcggtatcagcacaggcctgggttccagtcttggctgccccatgaccagtccagcaaccatgggcaacttattttacctccctggcctcagtttcttcatattgtaaactgggagtaattatagcacctgtatcctggggttgtcccatgaagggtaaacgagatgctgactgtaacccttgcggtgcctggcacataaagcatgtggtatggctgggcgcggtggctcatgcctgtaatcccagtactttgggaggccaaggcgggcagatcacttcaggtcaggggttcaagaccaggcttgccaacatggtgaaactctgtctctactaaaaatacaaaaattagggccgggcatggtggctcacgcatgtaatcttagcactttgggaggccaaggagggcagatcatgaggtcaggagttcaagaccagcctgaccaacatggtgaaaccccatctctactaaaaatacaaaaaaagaaaagctggcctggtggcacacacctgtaatcccagctactcaggaggctgaggcaggagaatcgcttgaacccgggaggcggagattgccgtgagccaagatcgagtcactgcactccagcctggggtacagagcaagattccctctcaaaaaaaaaaaaaaaaaagataaaagtcatgtgatacgaggcagccattctaaccagtataggtaatgatttgcctgagaaaaaaatctgaaagactatgcagcatccaggtgagagtgggtatccctagataggattatgggtgattttaattgacttttcctacttattattatattttagaaacagggtctcactctgtcacccaggctggaggacagtggtgccatcatagctcactgcagcctctacctcctgggctcaagcagtcctcccgcctcagcctcctgagtaggtgggactacaggcatgtaccaccacacccagctaaatttttaaatttgttggagagatggggtctcactatgttgttcagactggtctcgaactcctgggctcaagcaaccttccctcctcagcctcccaatgggattacaggtgtgagccaccacgcctgactagggcaggtattttggctctattttttgggtgactaaactagttctgagatgtaaaggggcttgcccatggtcaaatatttagcaagtggcagagccaacttacatcttctcacccctcctctgatgtactgtctactggcatggaggagaggtaaacaaaaaagactgacatgattgtattaggtcaaatgtcagtgtatacatatggtgcccattgagtgcactggggaagcacatcatgcatggggcggggcctggagctgggcactgagtatttgcatctgtgctttctcttcctggcctttgtctaccttttatttccatttgaggtgataagtttttattgacttgtaaaagttctttatatattaaagctattaaccctttggtatacttttctctttattttttatttttattttttaattattattatttatttatttatttatttttgagatggactctcactctgtcaaacaggcttgaatgcactggtgcaacctcagctcactgcaacctccacctcctgggttcaagtgattctcctgcctcagcctcccaagtagctggtattacaggtgcctgccactgtacccggctaatttttatattttaaatacagacaagatttcaccatgttggccaggcttgtctcgaactcctaacctcaggcagtctacctgcctctgcctcccaaagtgctggaattacagacctgagccaccactctcagcctttttattttatttttgagacagagtctttctctgtatcccaggctggagtgcaatggcgcgatctcggctcactgcaatctccacctcccaggttcaagtgattctcctgcctcagcctccccagtagctggaactacagatgtgcatcatgatacccagctaaattttgtatttttaatagagacagggtttcaccatgttggccaggcttgacttgaactcctgacctcgggtaatcctgcctgcctcagcctcccaaagtgctgggattacagatgtgagccaccatgcctggcctattttttatctatttatttatttttgagacagggtctctctgtcacccaggctggagtgcagtggtgtgatcatagctaactgcagctttgacctgggctcaagtgatcctcctgcttaagcctcctgcgtagctgggaccataggcatgtgccaccctacctggctaatttttataattttttgtagagacaagggcttgctatgatgcccaggctggtctcaaactcctggcctcaagcaatcctcctacctcagcctcccaaagtgctggtattacaagtgtgagccgctgtacctggccacatttcattttaaaagacattttttttttcagatatgtctaccatagatagagggagggcacagatgccacataatgaccattgtttactgggtttggggacacactggtttttaatatttatttagttaaaatctatcaaaagtatttctttattgcttctgctctagtcatttccttattcttcttccttattcaaagcagttccaaccccacccatgcaaagaacattaattaagggccagctatgggtaaggcagggctctgtgcaggcccaaatttgcgtttaagggattcaggccccagaagttactatccaataggcgaaggagaaggtgctagaaacgccaaggaaggatggacgccctcgccaatgggatagcatcgggttggggtggacaggggtcagcgattaggcctttcccatatgttttcaggccaattttgctttgccctttaagaccagggaaggtcagagcagaaaggagataaacaatctagtctagtgtctcctagtcagtgttaaaaccgagcccagcatggtggctcatgcctgtaatcctaacactttgggaggctgaggcgggtggatcacgaggtcaggagattgagaccagactgaacaacactctgaaaccccatctctactaaaaatacaaaattagctgagtgtgatggcagatgcttgtaatcccagctacttcagctacttgggaggttgagggagaagaatcacttaaacccgggaggcagaggttacagtgagccaagatcacatcattccactccagcctgggcaacaagcatgaaatgccgtcttaaaacaaaaacaaaagtttgttgagcatgtcaccaataattttcaaatggtccattttttaaatttaacttttatttatttatttatttgagacacaatcttgctctgtcacccaggctagagtgcgatggtgtaatcatagctcactgtagtctcaacctctcaggctcaggctatcctcccgcctcagcctctcgagtagctgggaccatagccatgcaccaccatacccaactaacttgtattttttgtagagctggggttttgccatgttgcccaggctggcctcaaactcctgggctcaagagatcctccaacctaggcctcccaaagtgctgggatcacaggcatgagccatatctggccattttttaataagataaaataaagtcaagattatttcctgagcaccatcccagccagccacttgcttgctttttttcatttaccagacatttattgacactatgctgtttgccagaccctgggaatgcagtagacaaatacagcaaaatagacaagggtctcctgccttcatggggcttaccttctagtcaagggacaccatgataaacaagtgaataaggagaattaaagattttggtagttgtaagaaacagtgtttgggggcagaatctctaaagaggtgatatgtgagctgagattggagggatgatgagtgtcttagcctgttctgtgctggtaacagaatatctgaggctgaggaatttctcatgaacagaaatttgctggctcttagttctggaggctgggaagtctaatatcagtatgccagcgtcttgcatgggccttcttgctgtgtcatcacctggcagaagagaaggagagggagagcaggtcaagcacggtggcttatgcctgtaatcccagcactttgggaggctgaggcaggaaaatcacttgagtccaggagttcaagaccagcttgggcaacctggtaagagtgtgtctctataaaaaaattttaaaaattagccaggcgtggtgacatgcccctgtcatcccagctactcaggaggttaaaatgggaggattgctggatcccaggactttgaggctgcagtgagctatgattgtgccactgcactcctgcctgggcaacagagtgaaacgctatctcaagaaaagaaaaaagagagagcaaaagggggctgaactcgcccttttataacaaatccactttcctcatactggcagaaatccattcatgagggcagaaccatcaaagcccaatcacctctcaaagatcccaactcctaatacctcacaatggcaagcaaatctcaacatgggttttggaggggacacacgttccaaccagagcaaggagccaggtgcagaaagagttggaggaagaatcttccaaggtgagggaacagcgggtgcaagggccacagagcaggcaggagcaggcatcgttggggaatggatggcagccggtgagcctggtgcaaaggtagacaaacaggagaccgtcctggagggcagcgcctgtcagacagggccgcagagggcactgtggcagcaaggcagggacagcaagtcatcagacctattgcttctggaatgtttcacgagacccacaggccttcttacctgtgtcgctgtatttgctctttcctgatatactataaatagttactcacacggattacacccaaagaaaaagagccctccgccctgtttgctgtgtattctgtggtgcgtgggtttggctggaaactttgtgtgccctggctggtttggccatacatgggctgcagtaggaggagttgagggtcgacgggcagagctggaagtggagactcaactattctggggtgagttctgcattgtgctggaggcaattttacataacaaaattcacagctgtcccgcacagcagagcatacggtgattgccattagtgcagatggctctagaggcctctgcagaggaccccgcccccaatccacttctctacaagtcagagggcagcttagctaggacactcaggcattgctaatgctagctcatggctgcctctgtgtagactgtaaaaatgggccccttcctcaagggggtgtcctagttaagctgccctttactttcatctatgggaaaattgttgtaatatactgattttattaaggaaagcaacttgactcctctttttttttttttttttttaacacagggttatactctattgcccaggctggagtgcagtggcatgatcatagctcactgcagcctctaactcctgggctcaagctatcctcccacctcagcctccggagtagctgggactacaggtgtccatcaccacacccagctttttgtgtgtttattgtattttttaatttttgtgggtacatagtaagtgtgtatatgggttacatgagctattttgatatgggcatggaatgtgtaataatcacatcaggataaatgggatatccatcatctcaagcatttattcattgtggtataaacaatttctttatactcttttagttattttaaaatatacaattacattatttttgactatagtcactgtttttttgttgtgtttttgtttttttgtagagacacggtctctctacgttgcctgggctggtcaactgctctcttaataaatattggccgagcacagtggctcatgcctgtaatctcagcactttgggaggcctaggcatgtggatcactcgaggttaggggttcgagaccagcctggccaacgtggtgaaatgccgtctttactaaaaatacaaaaaattagctgggtgtggtggcgtgcacctgtaatcctagctactcaggaggctgagacaggagaattgcttgaacttgagaggcggaggctgcagtgggccgagattgcaccactgcactccagcctgggcaacagagcaagactctgtctcaaaaatgaatgaatgaatgagtgaatgaatatcacagtatgaaggtgcctcatagatgtattggccttggacaagataggtcgtgaaccataggtggtggccctgctgggatccctgacttgcccctcctgctggaaggccctcctcctgccaccctgttgccatggtaacctccacctttccctctgtatctcctggcaaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggtagggcctggcagacctgcccctgggctgcaacagggctgggcagggaggaacctaatttccattccactgggagttatttatgacaagatgacaggctgaatcttcttccagggaggggaatttatggagctagtatgaagatgaacattgttattttaatggttatatattacggctttgtagggggtttttgcaattttaaaaactgaattgagattttcataacaaaattcaccatcttaaagtatatagtttagtaggggggttttcctttcctttctttctttttttttttttttttttgagacggagtctcgctctatagcccagactggagtgcaacggcataatcttggctcactgcagcctccacctcccgagttccagcgattctcctgcctcagcctcctgagtagctgggattacaggtgtgccaccatgcacagctgatttttgtatttttagtagagacagggttttgccatgttggccaggctggtctcgaactcctgacctcaagtgatcggcccacctcggcctcccaaagtgctggattacaggcgtgagccaccacacctggcccagagtttcactcttgtagcccaggctggagtgggccatctctgctccctgcaaccttcacctcccaggttcaggtgattcttgtgcctcagcctcctgcatagctgggactacaggcacacacccagctaatttttctgtttttagtagagatggggtttcaccatgttggccagactggtcttgaactcctgacctcaggtgatctgcccgcctcagcctcccaaagtgctgggattatacgtgtgagccaccatgcctggcctcctttccttttctttctttcttttttctttgaaatagaatctcactgtgtcactcaggctggagtgcagtggcacaatcatagctcactccagcctggaactcctatgctcaagcaattctcctgcctcagcctcccaagcagctgggactacaggcacttgcttccacacccagccaatttttaaaagttctttgtagtgacagagtcttgctatgttgcccaggctggtcttgaactcctagcctcaagcaatctgctgccttggcttcccaaagtctttggattacagatgtgagccactgcacctggtcctagtgggttttagtatagtcataatgttgtacaatcatcactgctatgtaattccagaacatttccatcaccccaaaaagaaatcccgtaccagttagcagtcctccccgaacctagcagccactatactttttgtccctatagatttgcctattctggagattttatataactgggagtatacaatttgtggctttttgtatctgcttctttcatttagcataactttttcaagattcatctgtgttgaagtgtgttatcagtacttcattccttcttattactacataatattccattgtgtggatatacagcctttatccattcatcagttgatagacaagttatatatatattttttctgttacataatgtattagtcttcttgggctgccaaaacaaaatactatagagtgggtggtttaaactaaaaaaattgctgggcacagtggctcatgcctgtaatcccagcactttgggaggccaagatgggaggatcacttgagtctaggagttcaagaccagcctgggcaacataggtaaacctcacctctacaaaagaaattgttttaattaactgagtgtggtggcacactcagtgagctatgatcataccaccgcacttcagcctgggcaacagagtgagaccctgtctcaaaaaacaacaaaaaaaattatttctcccagttctggaggctgggaattccaagatcaaggtgctggccagtttggtttctggcttgtagaaaacagctttctcactgtgtcctcacatgacctttctcctggatgcaagtggggagacagcaagagagctctgctgtctcttttgcttcctaaacgggaatgagctctgtgtgattagggccctacccttatgacctcatttaagctttatcacctcctcacaggctgctagaatatgaacgtcccctccaagtctcatgttgaactgtaatcaccactgtgaaggtgtcaagaggtgggactgttaagaggtgattaatgttgttatcatgcagattggtcagtcatcacaaaagtagctttgttataaaagcaaatttggccccctcttgctcgcttgctttctacgtctcttgctctttgccttctggcatgggatgatacagcaccaaggcctgtgccagatgctggtgctatgctcttggacttgccgggctctagaactgtgagccaaataaatttcttttcattataaattatctagtctgtggaattctgtcatagcaacataaaatggactaagacacagactgtgtgtctccaaatacagtgcagttacatcatgaatgaagagttcaacatatgaatttgtggatggggagcccagtggggacacagcattcagtccctaacatataataaacatactaagttcctaatttcacaggtataggatgaggctaagttttaaaagtttttaagttatattttaaaaattaacaaagaataatgcaaatctaggctgggcagtggctcgcgcctgtaatcccagcactttgggaggccaaggcaggcagatcacctgcggtcaggagatcgagaccaggctgggcaacatgatgaaaccccatccctactaaaaatacaaaaattagctgggcgtggtggcaggtgcctgtaatcccagctactcaggaggctgaggcaggagaatcgcttgaaccccagaggcagtggtgacagtgagctaagattccgccactggactccagcctgggtgacagagtgagactccatctcaaaaaaaaaaaaaaaaaaaaaagaagaagaatgatgcaaatctataatcttttatttgaaaattttaaatccaaaaagctccaaaaacctgaagtatatttgtatgttttacacaaattcacttggtaaaacctgacctagctgacatgaagctgtttgtaagtcgttatttcttccacttttgcacatccccacttagttctgcaaaagttctcaccctgattctcattggctcaaattagttctcagcctgattctcattggctcaaactcaatcatctacataccccaaaccaacagtagttgtttagatggcttactctgattggccatgactaaatctggaccaatcgctgtagcttggtgggggataggaggagtgctattattggctagattttatcacaggcccacctttagagccccgcccggaacacctggagggagagggcacacggagtagtttgagttcttaaggaaacgtcagggtgttcttctgggaggggtgatgggggacactgggctggcaaaaacaacaggtggttcacctctttttgcccccctttgctgtctttcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttttgtcacgagatataagaaagtgctttttgccttgaatggacaattttagggctgtgctcactagtcttttcaggctggactgaaatgtcgggcccatggagccctgtgttttgtgcatcgggatgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaattttgtgttccccagggcaccaaaacacagtgctttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccaccttcaaaacctagtttgggctgggtgcagtggctcacgccactttgggaggctgaggtgggcggatcacctgaagtcagctactcgggaggctgaggcaggagaatcgcttgaacccaggaggcagaggttgcagtgagccgagattgcgtcactgcactccagcctgggcgacagagtgagactccgtctcgaaaccaaaaacaagaaaaacccctagttttgtgccttctgaagatagttaggacatcttctttttccgcaaatgctggacatgccaaaaacctaacgcaaaacccaggacattccagcccaactgggacgatatcagagaccatcttcaagtgcaagaagcaggtgaaagcccaggaaattggcagagccaggattatcatccagtactttcatttcacaaatggagaaaccgaggttctgccagctagattttttttcacagtgtcactgctagcaagccactaagctggagctgggatttgagagctgctgctatttagaggatcttgggaataaaatttaaactggagtttaatggccctttcagttttgctataggcaagagaataaaatgaatgaatggataggtggctttatgggtgtaagaaagaagcgaaaaaaactcccaaaccccagtgttcctgaatatctgttctccccctgaccactctgggaatttatcaaatgcagctttgacctccaagccaagtaaactgctcttgttgctattttagtggtttttgtttttttaagacacaaggtctcactttgttactcaggctggagtgcagtggcatgatcataactcattgtaggctcaacctcctgggccccagtgatcctcctgcctcagcctctcaagtagctaaaactacagatgtgcaccatcacatctggctaattttttttttttttttttgaggtggagtctcgctctgttgcccagattcaagtgcaatggcacgttttggctcactgcaacctctgcctcccaggttcaagcgattctccctgtctcggcctcccgagtagctgggactacaggcacctgccaccacgcgcagctaatgtttgtatttttagtagagacgggggtttcaccatgttggccaggctggtttcaaactcctgacattaggtgatccacctgcctcggcctcccaaagtgctgggattacaggcatgagccaccgtgccaagccacgcctggctaattttttaaaattattttttgcagagacagagtttcactatgttgcccaggctggtcttgaactccttggcctcaagtgatcctcccacctcagcctcccaaagcattggggttacaggcgtgagccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaatgtctcctggtttggaaaaaaaaaaaaaatggccaggcgtggtgcctcacgcctgtaatcccagcactttgggaggccgaggcgggcgggatcacctgaggtcaagagttccagaccagcctggccaacatgatgaaaccctgtctgtactaaaaatacaaaaattggccgggcatggtggcgcacacctgtagtcccatctgctcaggaggctgagacaggagaattgcttaaagccggaagatggaggttgcagtgagcccagatcctgtcattgcaccccagcctgggcaacaagagcgaaactccatctcaaaaaaaaaaggtgggggatcgggtgcggtggctcacgcctgtaatcccagcactttgggaggctgaggcaggcggatcacaaggtcagtagatcgagaccatcctgactgacatggtgaaaccccgtctctactaaaaatacattaaaaaaaaaaaaaaaaaaaagctgggcgtggtggcaggcgcctgtagtcccagctactcgagaggctgaggcaggagaaaggcgtgaacccgggaggtggagcttgcagtgagctgagatcacgccgctgcactccagcctcggcgacagagcaagactgtctcaaataaataaataaataaataaataaataaataaagctgctgcaggcaggggtcaacgagaaggctcataccccatctgaaaggggcagccatgattcaacttcaaatgattgccaccatgggaagcgcgggctcaatgttaccctattttccaatttttcaagagctgctgaaaacttttttttttttaatgcaaggccttctgttctttaacatttgtaataaattctaataacttttcaaagccttccagatttggctcgtctgctgtcagtttgctttagagaaagtattagaacctctcgtttcttcatttgctcatctataaaacatagagtttttctgtttgtttttcagacagtctcactctgttgcccaggctagagtgcagtggcaagatcttggctcactgcagcctctgcctccgaggttcaagttatcctcccacctcagcctcctcacgagtagctgggactacaggtgagcaccaccgcgcccggctaattttgaaggggggcaggttgtgtttcatcttgttttttcctttcttccagtggagacagggttttgccatcatgcccaggctggtctcgaactcctgggctcaagcaatgcaccggccttggcctcccaaactgctggaattgcaggcgtgagccaccgtgcccggcctgaagaataatttttaccattacagagttgtaagcttcagagaagataatacatggtaaagtgtttttttttatttttatttatttattttaagatggggtctcattctgtcacccgggctggagtgcagtggtgcgatctcaactcactgcaacctccgcctcccgggttcaagcgattctcccgcctcgacctccctagtagctggcatggcagtacaggcgcacaccaccatgcctggctaatttctgtatttttagtagaggcagggtttcaccatgttggccaggctggtatcaaactcctggcttcaggtgatctactcaccttggcctcccaaagtgctgggattacaggtgtgagccaccacgcccagcctaaagtgcttttttaattccaagcttaagaaaatcttggttaccagttgatcttttggttttaagctaattttttttaattttaagaaatttgaacattagtataactatgcatggtaggttgaacatacatatttaggtccacttgttcctaaatccccactgcaatgacaggaagtggattcttttgtttgtttttttgtttgtttgtttgtttttaaatagcataagccggtgaggatgaagagaaagaggattgaacagcaagttttgggtgctggaaagtaggtagactgtaattgaattaacagacccaagaagtctggatcctagatcagcagtagagaaatctgagaaaaacccaattttcattgctgaacaagtcctgcaaggctgagaaattggcacgaggaggcctggcaccgtggctcacacctgtaatcccagcactttgggaggctgtggtgggcagatcacttgaggtcaggagttagagcccagcctggccaacatggtgaaacaccatctctactaaaaatataaaaattagccaggctgaggcgggagaatcacttgagcccaggaggcagaggttgcagtcagccgagatcacaccactgtactccagcctgggtgacagaatgagactccatttcaaaaaaaaaaaaaaagattagagagaagttaataaagaaaacttttctgttggttttgttacagcatacgtcaaaattttattacagtcttgaccgggcgtggtggctcacacctgtaaccctggcactttgggaggccaagatgggaggattgcttgaggccaggagttcaagaccatcctggtcaacacagtgaaagcccatatcttaaaaaaaaaaaatcacagtcttgctgcaagtgtaaacccactgggaattcaaagatttatacttggtagggacattttctaaaaatttattttttattacagtctgcctatgtagattaaactgcacgctcttaagtatacaggttgatgaatttttacatttgtacacatctgtgtcttaacaacccaattcaagatattagaacatttgcaggcctacagaagcccccctggaccccttcccaggcaatacaccctctctccaccccgaaaaatgttggccactcttctgacctctatcttgatagagacattttctaggagaagaaaatgattagataatcactgttagacaaaatagaaaagaaaagaatgttccgttaaaggtcactgcactcttgactgacaaatgaccatcaactgagtgagtagaaagctagtttcccagtgtaaatctcaatgctcttaaatttcaaaagaaaaatgctcaatgctcgagcatttatcagaaatgctagtttctttccagaaggaggttcttacagaaagatatggtctcaggccaggtttgagagcattttccttttatgggagcaagggaggaaagaatggaggggatccaggactgagaccccacacccatttccactatccacagcctagtgtttatgatatagggacaggcacacaaagaatagtcggagtttcagcccatccctcccttgtcaggcatcccgctgctgagaccttgtaggtccaggggttctgatgcaacattctgcatctcttgctcattgatttcatgtctgattgtcatgagaaaactgtgtaaggggctgctggactgtaagaaactctcaaaagggtgctgtgccttccaggatcagctgtttccctgcaggcttcctcttaattaagcatcctgctcagtatgtgtttgtagaaagagacaagttgctccagaatgttctagcagaaatatctcagccttaggagttcaagaccggtcctggcaacatagcgagacccctgtctctgtgaaaaaaaaaaaaattttaagtagccaggcatggtgtcatgctcctgcagtcccagcaactaaggagactaagatgggaggatcattttagcacagaaggtcaaggctgcagtgagcaatgattgtgccactgcactccagcctgggaaacagagcaagaacttgtctcaaaaaaaaaaaaaaaaattctacacacacacacacacacacacacacacaaagacacacacacagcttcatttgagcctttgccttgcaagggggagggggttattgtttacagttgacaactaccaagtagcactgggctttagcagagaaagggaatttattacagtgataaagggatgcctccaagagtggacaacccactgggccttggaaagggtctggagctggaagccagaaaaccatcaggatttccctgactctgctcttctcactctctcattccctctttttctatacactggcttttgtctacctctccaactcacctcacagaatatagccatgcgaaatccccctttcttcctagttttagccagcctcagagactaattccaacgcaacacggtcaaattaacaaatcgggccgggtgcgggggctcacgcctgtaatcctaacactttgggaagctgaggtgggcagatcacttgaggtcaggagttcgaaaccagcctagccaacatggtgaagccccatctctaataaaaacacaaaaaaattagcccggcatggtggcgtgcatctgtaatcccaactacctgggaggctgaggcaggataattgtttgaacttgggaggcagaggttgcagtgagccgagatcacgccagtgcactccagcctaggcaatggatcgagactctgtctcaaaacaaacaaacaaacaaaaaaaaaacaaaatcagtaactcacggagtctcagttcacattctcaagagagaatttgattggtccaacctgaatcctacgtccactgaagaacggtagaacccactagccatggctgtgggggtggggcgtgcagcacaaaggtggctgccagggacccactctctggctggtcaggcagttcctagaaaaatcagactgggcaaagatgccagcaattatccttgactgtgaggatatttccttttggaaaatccagtacccaactcacaaacaaagtccttcctggtactaaaataccatgacaaacactcctattgacttaaaggggttattcctcattcagctttgaactccccacaatgcctaccctttgtcttcaatccatggctgcttctgtatttttttttaatgtcttgaagagcaacaaacttttctagcacaagaaaatctttgcatatcattacatatgttaaaggtagatggatggccaggtgtggtggctcactcctgtaattctagcactttgggaggctgaggtgggaggatagcttgagatcagcctaagcagcaaagcaagaccccgtctctacaaaaatacaaaagttagcccagtgtggtggcgcgtggctctagtcccagctacttgggaggctgagatgggaggatcatttgagcccaggatgtcaaggctgcagtgagctgtgatcataccactgtactccagcctgggcaacaaagcaagaccccgtctctctaaaaaaaaaaaaaa

SEQ ID NO: 743 - DNA, 2178 bp, Homo sapiens
atggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaa

SEQ ID NO: 744 - protein, 725 aa, Homo sapiens
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPRVRTLSGSRPPLLRPLSENSGDENMSDVTFDSLPSSPSSATPHSQKLDHLHWPVFSDLDNMASRDHDHLDNHRESENSGDSGYPSEKRGELDDPEPREHGHSYSNRKYESDEDSLGSSGRVCVEKWNLLNSSRLHLPRASAVALEVQRLNALDLEKKIGKSILGKVHLAMVRYHEGGRFCEKGEEWDQESAVFHLEHAANLGELEAIVGLGLMYSQLPHHILADVSLKETEENKTKGFDYLLKAAEAGDRQSMILVARAFDSGQNLSPDRCQDWLEALHWYNTALEMTDCDEGGEYDGMQDEPRYMMLAREAEMLFTGGYGLEKDPQRSGDLYTQAAEAAMEAMKGRLANQYYQKAEEAWAQMEE

SEQ ID NO: 745 - DNA, 30752 bp, Mus musculus
  misc_feature (1)...(30752): n = A,T,C or G
caaatgaaagatgggaactaacagcagccatctaagagaaggaaaccacagctgcctgctcacagcccaaggctgaccagtccaatctcaaaagaagaaccaggctgcgagtgagataagggatgtgtgctggggcatgaacggaggctgggattataggaagaatgcctgagttctggggagactgactgatccatgcagtgaagccagggaagtgtccagcggtgtgtctctagggctctaatgggagggctccagatgctgaactaagggtctgctccttcagggcaccaccctagtgtagtttccagcttcgacatcagatgctcataaccacctgtaactctagcttcctggggtctgctacctcccctctgcagttgcacgtgcacacccacagacacatacacacacacacacacacacacacacacacacccctacacataaacacaaacaaaattctcaggaattgaagttagtagatctcctcctaaccttggggtcctgtagaaagtaagagcctcattgcataacaacatagacctataaccccagcatgcaggaagcagaggctctctgtgagttcaaggacagcctggtcaacagagcaagttccaggccacagttacaacagtgaggtcttaccctgtctcaaacaaacagacaagcaaacagcacacaacacaaaacctcaagaactggaattagctgtctagtgctacttcctgcatttcaccatctcccctccccctctctcaacaaaacaagaacaggatgtagcatctgcctgcctagggtacacagtcctccccccgtcaacctcgggaggactggagtcataggtgtttaccaccgtgcctggattaaggtgttcattcattgatttaacacagatttgccaacataccaaccacattccagacctctcacaacaggagatgtgttgaggaagttacctttcaacactgataagtgtgaaatatacaaaaggcaggtggaaggcgtatctgcagtacatggtttgtttcagcttgggtttaaagacagcatagtaaaggcagagaaacttcatgttgatctttctctttctttcttttttatttgtttgttgttgttttgttttacaaaacagggtttctctgtgtagccatggctgtccaggaacttgctttgtagatcaggctgaccttgaactcccggggacccacctatctctgcctcttaagtgctgggatcaaaggtgtgcccaccactcccggtttagtctttgacttttgatgatgcatatttgccaagccctactctgccctaagccnnnnnnnnnnnnnnnnnnnnnnnnnnnnnnttctctctgtttactgacatacccctacaacctggaagagtgcttgctacattaaaagtttgtttgtttgtttgtttgagacaaggtctcacttctaatctctggttggcctggaactccctgtgtagagcaggctggtgttcaaaggggtcagacagttcaaactccaggagttgctcggttctgcctttttctacctgaggaggactcaagcgaacacatctcctacctgatccttagtttacacatctgtgtgatctccctaacaaagttgtttacttattctttagttaggatagaaagacaaggaaaactgcatatagagaggtgttttgtctgcatgtttgtgcaccgtgtgcttgcagtgccccaaaacgccagaagggggcgtctgaaccccaggaactggagttacagagtgtagtgagtgttgatgtattaactcaccctatggaagagcaaccagtgatcttaacccaagagccttctctgcagcccattgctttggttttctgaggtagggtctgacgtggcaaggctagtatatgaagtcaagaatgcctttgatctggttcctacctcctgagtgctagaattacagccctgaaccaccatacccgacaaaaaggttttaaaatcaattatattgtgagttctaggccagactgggtggcaaaacaaaattctgtctcactttcctacctataccaaaacaaacaaacaaacaccttttaatgatttatgatcagcaaatgctttatttgtatactattatatatagctgtagacctggggtcacgtaaaaaaaaaaaaaaaaaaaaacaacaacaacaacaacaaaaacctctggtgagagagggttagataaactctgtcctcataagcagacatatacttatttataagtaaaaagcattaaaagaagaagaaaagataccctaatttagaggagtccaaagataaagttggagatgttcccacccaacttgttacctggagggtggaaaagttcaggactgtcacacttgtgccttgacaccaagctccttctgtgacctccattcctctcccttgtaaggcaggacccatccagattcaagctcaggggttcatagatccgcagctctactcaggctctgggccaccaggtcatgtgatgatggtgtgacttgaagtcaatcatccttgacatgcagtctgggctcgggtagcagctgtcacagccagggacttgagcgactagctggccacagcaggaaaagcaggtcactcccaccactgtgtggcccattttggaaggttcccagatatgcaaaaactgggagctggaaaagtcttaggatacagaagtggagccctgcccagactctgtcaccattagtgcaaaggatgctgaggaaggtcagttaatatacaaacaccaatcccaagcctccaagatgatctcatagaaaagcataattggtcctgcatccctgccactggcaggataggatcctggtcctgggctgagagacctttccatgtctgaatctctttttagatgtagaactgtcagaccgggcgtggtgacaaatgcctgtgactcaggaggcggaggcaggaggaccaggaattcaaggaccatcttgcttccatactaataaataagttcatgcaggtgtgatggcagatttacttagacagaacggggctggggagtggcagaggcaagaggatgtctgtgagtttcaggctagccaacattatgcagtgagaccctgtctcaaaaacaaactcacaaacagtctgaggccaccaagactatatgcataaggctctgtctcaaaagatgagagaggggcctggcgagatggctcaatggttaagagcgcagactgctcttccgaaggtcctgagttcaaatcccagcaaccacatggtggctcacaaccatctgtaacgaaatctgatgccctcttctggagtatctgaggacagctacagtgtacttacatacgataaataaataaatcttaaaaaaaaaaaaaagatgagagagccggggcaaggtggggggctgctaaagagatgactcttgctcaggacctggattcagttcccacacccacgtggcagttccctactgcctataactacggctccaggagatccaacgtccgtccagcctctgcaggcaccaagcatgcacgtggtgcaaacacacttatataggccaaacattcatatacataaaattaattaatttaaatataaatcaaaacaacaacaacaaaacttagctaatactagagaatctacctgaagttctctagccttgcacacaggtgcatacatacacactcacattcacactcacacacacactcactcatacacacacacaagcaaataaataaatgcaataaagaaaagagttaacaacaacaacaaaaagccgggcggggtggcgcatgcctttaatcccagcacttgggagacagaggcagatgaatttctgagttcgaggccagcctagtctacagagtgagttccaggacagccagggctatacagagaaaccctgtctcaaaaaaaaaaaaaaaaaaaaaaaagagtcactgacccaccttcaagtcctcagttgcctcctcctagtgttctcttacttctctacactaccaaacccccaacacacgtacagctgcctcccattggcctttccacccatggaaaggaatcgtattgaatgtccactatccagaacctacattctgtggacctctttgatgatgcaaggagggtgatgccctgcttcctgccagcactgaggagtctatccatatattaacgatccaacagagacccttactacttttcaagggtctgccaatagttaccataaaaagaaactactgaagctatttagggatgaatttgcctacagtggtgctataattgagcctccagaatatgaagtaattcaactacaagatgaccagagtagggacataggacagttcctgatagagggtacaaaggctaaggatgatcagctgatctttcaagagtttccaaatgctcatggctctcgaaaggtacagtgaatagaatatcccttctgtcccttgccatgagttttaaaacctcaaagcttgtataatgttcttggacagtgtaactcctttatgcaacaacctgaaagaatcgatgaacagacaccaagcagagtgcctgtctaatatgcacgaaggactaggtgagaccccctggtttagtgatgtacttcagaggtagagctggaagaggatcagaggctcacatatgagtttgaggccagtctgagataaatgcaactgtcgcaaaaaccaatcaaccaatgaaacaaacaaaaagcaacacactctaactttgctggctaattttatgttgatttgacaaaggctagaatcatctgagaggggagaaccccaacagagaaaatgcctccatagattgggttggggggctggagagatggctcagtggttaagagctctgactgttattccagaggtcctgggttcaattcccagtaaccacatggtggctcacaaccatcagtaatgggatctgatgccctcttctggcgtgactgaaaagagtgacagtgtactcacatacataaaacaaacaaatagataaatctttaaaaatgacattaaaaaaaaagattggattataagcaagccagttgggcattttcttaactggtgattgatgtgggaggccccaggcctttgagcatagtgtcagtcctgggctgatggtcctggattctataagaagtcaagctaaatgatccagtaagcagcaccccaccattgcctcaacttgctttttgtcatggtgtttcatcacagcgatagaaatcctaactaggactccaacagaaagcagatatcaacacttctcctgaaatagctcataagactaaatatagagacctggaaaggtggttgagaactctggctgctcttccagaggaccctgattcgattcccagaaactacatagtggcccaccacaatctgcagctccagttccaaggagtcagaaactctctcttttctgggtgccaggcacacgggtggtggtgcatagacctccttgcattcaaaacaaccacacacattaaggaaaagaggaaggaaacgactgagctgggccctagcggtggactcctttgatctcagcacttgggaggcagagtcagtagaactcctgattgtaggccagcctggtctacagaatgaattccaggacagccagggctacacaggaaaactctgtctcgaaaaacaaacagaaccagaccagaagaaagaagtaaagaaagaaagagaggaaggagggaaggagggaaggaaggaaggaagggaagtaagaaggaaggaaggaaggaaggaaggaaggaaggaagggaagaagggaagaaggaaggaaagaaggaaggaaggaaggaaggaaggaagggaagaagggaagaaggaaggaaggaaggaaggaaggaaggaaggaagggcatttaaaaaaagatatatctattcttttcacttcttgcatgcttgtacatgtgtgtgatgtatgcagacaagcgccagtgcctgatgaggtcagacgacggcactgagtctcatggagctggagtacaggaggctctcgagctgcccagtgtaggtgttggggatgtggacttaactattcgtgatggaacctttcttcagccacaaatgttcataaccactgagccatctctccagtcccaatggcatggttttagcaagtgctcttactaattttattctgnnnnnnnnnnnnnnnnnnnnnnnnnnnnnnnnnnnnnnnnnnnnnnnnnnntggtggctcacaaccatccataacgagatctgacgccctcttctggtgtgtctgaagacagcaacagtgtacttacatataataaataaataaatctaaaaaaaaaggtaacctgattttttattacttttattttaagtgcattggtattttgcctgcatttttgtctttgtgaaggggtcagattccctgcaacaggagttacagacaggtgggaactgccatgtggttgctgggaatcgaaccctggccccctggaagagcagttagtgctcttgatcactgagctatctctccagcccccataacctgattttagatagagtctcatatgtccgaggatgaccacaagcctctggtcctcctgcctctgtcaccagtgcatgcgtctgtgctgtgcccactttattcggggctggagactgaacaccttccagggtgttagtgaatactcagctaggtaagctatatccccagcccaagtacagaatctgaataagaaataagcatggggggctgggagatggttcagtggttaagagtgccgactgctcttctgaaggtcccgagttcaaatcccagcaaccacatggtggctcacaaccacctgtaatgagatctgatgccctcttctggtgtgtctgaagacagctacagtgtacttacatataataaataaataaatcttaaaaaaaaaaaaagaaagaaagaaacatggaacacagacacaaacattgaattcctgtacactattctcacactctgtgctaactcacaggaactattatcaagagttctgtgtattttccttcatgcgtattttttgctttagaggggtggagagctaatcaaagccttgcatctgctaagcaaacacactactcagtaactatcggttcccagagtttaatttatttaactttatttttttaggtttagtttcttttttttttttaaagatttatttattattatatgtaagtacactgtagctgtcttcagacactccagaagagggagtcagatcttgttacggatggttgtgagccaccatgtggttgctgggatttgaactctggaccttcgaaagagcagtcgggtgctcttacccactgagccatctcaccagccctaggtttagtttcttacttaaggtgttgaggtctgccctccaccaacatgtatgtagccattttgtttcatgcctaccaactatttcatattattgctataaaatgcctgccagtcacggacacagaaaaataacctgactcaagtttgggctaatcatataccctgtatgttctgtatgtggtatgttaatcttaagaaattccacaaagctttacgtcggacccataaaaatcaaaggtcaatatgaactgttatgtctaaaatggcttgagtcagagctgaccactgggcagcacttcctacgcctacatatgagctcagtgtgtgtttcctttataagcctttcctgagaatacactagtaccacaaaattaggttcccgagtcctttttgtggccctgaatgtccaattttggggtattcattcaataaactgtttttgcttaactgagaacagtgtttttatggtggttcctggtccccaacaaaggcaatcttgttatgtagcccaggttggcctttaacacacaactatcttcctgtcccagccacctgaatataaacatatgccactatgcctgactgaaattaattttgaacacaagggtctcaactaggcatggtgatacatacctttatcccagcattcagatgcagaggcaggcggataggcagataggcagatttctgcgttcaaggaaagcctgggctacagagtgagttctgggacagccggactacggagaaaccctgtctggaaaatgagagagagagagagagagagagagagagagagagagagaagaagaagaagaagaagaagaagaagaagaagaagaagaagaagaagaagaagaagaagaaaggatnnnnnnnnnnnnnnnnnnnnagcagttgatgtccttccgagggacccaagttcaatgcccagcacccatattgggtggctcacagcttctgtaaccgcagctccagggactacctctggtctttacagacaccagcatttacatgcacatactcacactgacatacataattagaaataaaaataaaaaaaaaaaagaagaagaggggatattgggaggaggaggagagatagggacagggagatggagggagtagagggagagaagagaagagaagagaagagaagagaagagaagaagtttctctggctggcctagaacttggtatgcaactgagaatgaccttgaaccctgaccccccttgcctctacctcaacaagtgctaggattgcaccatgcctgttttaggacatgatgaagactgaacccaagggaccaggcaagttctccaacagatgagctacttcttcagcctaaatattattattatttttttttaataatggcttactgttttccaagctatcctggaactcctggaggccaggtggtgtggcctcttctgaggcctgggcttgctcagttcttggaaacagagatttatgtctagtctcctgaactgccaatgtgaagcctgtcatggagtcagcctgtctcagttatacagaacaaagcaagtaagcttctagatgtatccagtaggagtaggttaaggagggaggctccaaagtaaaggtcaggccttctcatcctggaccatgtattctaagggctccctctagtgattacagatataaacaagataaaaagaacacggataggtggatgtgggagcttgtatctgcaacagtactcagtaggctgaggggggaggattgtctcaaagtgagattctatcaaaggaaaaacaggagaagccatacataaaagtcagttttagccagaggctctggagtaacgcagagcttgtgctatcctgtgaaagatgtgtcatggaactgcttttaaaaccatgagtccattcccaatcggcctttccctttctccttgccccaataaacctcttcggtaagatctgttgcatcatatgacttcatagtgttccttggcttcaatccgccatgctgctgttctaaaactattatagtgaccatgttgtcactataatcccgaccactgatgtgttctaatcataactcgcagtcatattaatatggatgattttgatgggtctacaaagaatatagagataagggcatcccgtggcaattgcacagatttatttatttcggtttttccggccatatttgggacacacaaggtattcaaaatgcttgccacccaaatgaacgaatgctttcggaatagatttcaagttctgttttacgatgcttcagagtacttggtggtgagctgcagcccaacgctgtaagctttggtaaggctgggacctgagctcccggctgtgtcggctttagaaccggaactgaagaatgtctggctgatccagactacagggagaaaaccattaaggggcagtatggcctcagataaaccgacgcagaaacctgggagagggctgtccaaaaagaagaataaaagcctggaggggtggggggggtggggagctacccaccgcaaaggatgatgggaagcggtaatcgtctccttccttccaacccgcccccgtactgaggagcgctgacgtcacgcacgccgccggcatgccccgcccctgggctggctcacgtaactgagggtggagccacaaagcgatttgtgggagtcggaatcatggcgggcttggttgacttccaggacgaggagcaggtgaagtccttcctggagaacatggaggtggagtgtcactaccaatgctaccgcgagaaggacccggagggtgagcgccaactgcgcagcctgggacataggggaggggagcgagcgtggggtgcagtcgtggtcacgtggcgggccgaggacgcctaaggaccgggtcagggtcactacgggcctgtgggcgggaagttgtagtgcatcgggggcggggcctgcagcggagggcggagccctcaggctagatgctgtgtagtcaggtttagggtgctaggactggaggtgtgagggtgaagtagaacctcggtgtacatgtctttgagggaatcatttaacatgcaggaaataaatgaaatatatgctagtagtaaatgcgagccagaattggttggcatcttgcacctgtaattctagcgttcgggaggctgaggaaggaggatcacttagaactcaggagttaaggactagcctgaactacacatagcaaaacccggcccaaacaaagaattggagagggagattggagtggtggtccagtaattaggagcccatttaaagttctaggagatccaatgcctctggcctctgctgccaccacaccacatgctcgtatacacacatccataatttaaaataataaaaattaaatctttttttttttgagactgtcattatgtagccttgactggcctagaacttacagtgtaggccacgctagccttggactcagaactgcttcctctatcttctgagtttttggcatgagccacaggcctgttaacaaattaataaattaattaatttgttgaggtgttattctttgtgtagtcctgactgtccttctgttgatcaggctagcctgaaactaagatatctgcaagcttctgtttctcaagtgctagaaggtgtgggctgccaccatccagcacaaaattttaaaaaaaaattttttttttgttttagttttttcgagggaaaaaaaagtttttttaaggtaagtgaaatgtgataaaaagaactgagtgaagggcactgcccaatgacatggcttttgaataaagctttgaaggaggaaaggaaccattgtaagtctttgccaggcagaggtaataaaaggtcagaaattgactatatttatttatttattatatgtaagtacactgtagctgtcttcagacactccagaagagagcatcagatttcattacagatggttgtgagccaccatgtggttgctgggatttgaactcaggacctttggaagagtagtcggtttccttaaccactgagccatctcaccagccccagaaatggactcttatgtgcagtgaggaggtggagtgtatgagtgaccagtgcccaaacaagtgtccagtgtctgtaggttgttttcctattgttttaattaagggaaaagaatgaaaatggctctggccctcctttccagtagcttacagtctagttcccaagaaatgactttctgtttcttgaaattagtccactatagtgtgactctggataaggaacccaggattattctgtttgtttgtttgtttgtttgtttgttttttcgagacagggtttctctgtatagccctggctgtcctggaactcactctgctgaccagtctggcctcgaactcagaagtctgcctgcctctgcctcccgagtgctgggactaaaggtgtgcactaccacgcccggctaagattattctttgggagctagtccatgtcccaattgaagagaaatttcagaggaattgaccttctgtggtctctgaggaccagggtggttgggcatagtccacagaggccagctgtgtagtcagtgcgggagaggttggggaacagagagctcttttggaaggtgaattaaggattgctcagaatcaagtcaaattaatgtctgttttgcagtcctgaggcacaaagccagggcttctgagtgtagcggggaagttttctaccactgggctctagctccagttccagattaagtttgttcagggagcccggactacagtgtaccctgcctttctaagcaaggaatttagacctgactctgtaggcatgtttgaggagtttgtggtagttgatatgagttacatgaaggacatgtggagcagggagtgcaggagagccctgtgagcactggccatgggctggggttgtaggttggttggaagagcactcacctagtgtacctgaggccctgactgagtactaggcctggctcagactgcatatgcacatgcttagcatgagatcccagcactcagggaggtagagcaacaggatcagggacatccttagctacatagtgagttctggtccagcctaggttatttaagaccctgcctcaaattaaacaaacaaaaataacatcaattattgttattattcttggtgcaaacatatgctcttatgcaattttttttttgttgtttgtttttttgttttgttttgttttgtttttttgagacagggtttctctgtatagccctggctgtcctggaactcactctgtagaccaggctggcctcgaactcagaaatccgcctgcctctgcctcccaagtgctgggatgcccgctcaatgttttttaaaatgcaaagtgaatcttaatcacttcccttctcttgaagagatttctcagtcggtagcttacttgtgtggttttccattgtggggactgggattaaaccaagggcctcccgagctctaggcaaggactatgtcactgagttccactcctccagccccgctttcctactcctaagaaccctttgtgcgttatggtctgtagtaacatgcccattgtggagagaggcgcagctctaatttcttcatgtgtttgaggttcttgcctccctaacccataccgccttatcttggcctccttctaccacatttgtgccgtgtttatttccccttccacctgtttctggactctctccatttctttgtcttgattcgatagggatggagccacccagggccttgtactttgccttgtcatgcatggagtgacaccttcaactccttagtccttatgtatcctgtgctctcttcagctcagctgtcacagtcctccgtgggaccttccttggtgcccaaactgtcttaaccataagacatacaatgaactttctcatcaggctgttctatttcagttataacttagtgtttgaaaacactgcatttctttaatgtatctcctcctttcctagcctgcctgaatggttctctttcacaaggttgtgaagggtgactttgaactccttatcacgtctccaccttgggagtgcaggcaccatagatgtgcacttgcatgcctggcttaagcgtataaatatcaaaagggcaaatgacaatattcccagcagctctgaatgtgtcatatacctttatacatgagctggtgtgtgtgtgtgtgtgtgtgtgtgtgtgtgtgtgtgtgtgtgttttcaaatatttgatgactgaaaatgaaggagaatagtctttgatgttgctgggaacgctaagaggctggctagaactggaacatcctagatatggaaaactatttcccactgctttggtagcttccctttctattttcaggacttcaggtttccccaggccaggtagtaaggtaattacatctgatttctggttttctgctgcaaaaggcatccacaaactctttctaggttttagtgtttttattacagaccttgcagagaggttccaaagctagcaaagtgtcagtcatgggaagtcagctagggttaggcctggctggtctgccaggggtgaatcttccagatctgaacattgctggccagcggggggacatgtccccttttaagaagggctggacacttcgtttctgtgctaaatctgactggcacgtttgagagctaggcttgctctgattgtacctgggcccctgaacagcagctgctggcacgattgacctcttgcctcctctctaggttgctatcggctggtggactatctggaaggaatccaaaagaattttgatgaagccgcaaaggtgctgaagttcaactgtgagaaatacgggcatggtgacagctgttacaagctgggggcttattacgtgactggcaaaggtgagcttcggggcttctcaggcatgggggactgtggtgcacagagtacacacaggggctcagcagggaggtagtggaaggacttgaactgtaagtgaagcaacctctgggtttctgtttgcacattgtaggaccttgactggttctctctctttttttttttttttggttttccgagaaagggtttctctgtagcccttagccctagctgtcctggaactcactctgtagaccaggttggcctcgaactcggaaacccacctgcctctgcctcccaagtgctgggattaaaggtatgtgccaccatagcccggcttatttttttattttatatgtgtatacgcagctgtcttcagacacagcagaagaaggcattgggttccattacagatggttgtgagccaccatgtagttgctgggaattgaaatcagaacctctggaagagcagtcaatactcttaaccattgagccatctctccagcccccccaaaaaaatcttttttggttttttgagacagggtttctctgtgtagccctggctatcctggaactcactttgtagaccaggctggcctcaaactcagaaatctgcctgcctatggctcctaagtgctgggattaaaggcctatgccaccacgcccagctcaaaaaatctttttttttaaagatttatttatttattatatgtaagtagcagtcctcaaatactccagaagagggcatcagatttcgttacggatggttgtgagccaccatgtggttgctgggatttgaacttgggaccttcggaagagcagtcggtgctcttaaccactgagccatctcaccagcccctcaaaaaatctttttaaaattatatttacttattttgatatggggcaggtgtgtactgtgtcttacatgtggagatcataggacaacagaggatctttacatagcccaggctgtcttcaaactcacaaactccatctgcctctaactcttgagtgctggatttaaaggtgtgcaccattagatccagctcaatttttttttttaaagcagagttttactgtagctttattttatcctggctagagtcatctcaaaggaggaagccccagttgaaaaaatgcctccattagatcaggctgcaggcagccctgtagggcattttctttttctttttctctctctctctctttttttttttttttttttttttttggtttttttgagacagggtttctctgaatagtcctggctgtcctggaactcagtctgtagaccaggctggcctcaaactcagaaatcctcctacctctgcctctgcctcccaaatgctgggattaaagatgtgcaccactatgcctggcaggcattttctttttttttttggtttttcgagacagggtttctctgtatagccctggctgtcctggaactcactttgtagaccgagtgctgggattaaaggcgtgcaccaccacgcccggtggtcggcaggcattttcttaattagtatagatgtgggaaggtccagcccattgtgggtggtaccatccctgggctggtggtcctgtgttctataagaagcagtctgagcaaaccatggggagcaagccagaaagtagcaccctccatgacctctgcatcagctcctgcctctgggtttctatcctgcttgagttcctgtcctgacttccttcagtgatggactatggaaatgtaggcaaatgaaccctgtcctccccaccttgcttttagtaatgctgtttcagtgcagcaatagaaactgataggttatttctctgccagtgatgggagccaattcaagccagattagattatattaaaggcaggtttattggaaagctgctcttgggcgagttcactggccccaagaattggagtcaccatgggtggtgggtcaagaaaaaaggagacgtggtggcgcacacctttaatcccaggcagaggcaggcggatttctgagttcaaggccagcatagtctacaaagtgagttccaggacagccagggctacacagagaaaccctgtctcaaccccccccccccaaaaaaaaaagaaaagaaaagaaaagaaagggagccggaagacaaggcacaagccagggttggggggtgggggagggggatgtctggattatatagggaagagcctctagggcaagggcagcccagcctctggtctagaaagttcagggttaagggcaagatatgccaggtagggactgagggatgctgggggaacctggaagccaggtctgctttgatatgtgaaatatgtacctcagtcccttgtcacagggcctaaaaccaaacaaaccctaactaagacactggtatagaatttaatttgtggtccacacttgcctgggatgttcaggaacctccaagctactgcttgctgagtgagaaattaagcatgacaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaaagaaaagaaagaaaaaaaaaagagttctttatttgtcagtggctgagagcagactcaaaccagaaagaaccctctgccagaattgaagtagggtgggttgctaaagtccagatcgcaattatatcacatcagccgggtgtggaggcgcatgtctttaatcccagcatttgggagtcagaggcaggtaaatttcttgagttccaggacagccaaggctacacagagaaaccctgtctcgaaaaaccagaggcatggggtaggggtgggggtcagtttgttaaaacaatttgttttatgttggaaacaatggacctccggaagctgtatgagaatgttctgctcagcaggatgtggtagggtgtgtgctggagagcagttggatagaattccataagctagaacaaaatggaagtactttgggcagttcgggtaaagatattaatatgtgggctatagagatggctcagtggttcagagcactggttctggcaggtgacccaggttcacaaccatttgtgactctagttccaggagactcaacttctgacctccttaggcaccaggcacacacagtggtgcatgtacatatacacaggcaaaatgcttgtataaaataaataaaaattaaaaataaaatattagtaaagctatcagaatatgctgagcacagagtgagagttgaataattagcctttatattttttctcatgccctaattatctcataaataatgctaagtttttgccagataacaagttatctcttcttctctatgggttaggagtttggggttggtttagcttgtctttggacaaggaggcattgctgtagtcattggaaggtttgattgaagttgccatttagatgttggcttactcactggcctgatggcaaggccttgctcctgacagctatggtcaggagccccctgtgagctctccatctctcctgggctgcaggatcatgctagcttccttcaaagtaagtaccccagtaaagagaatccaaaaatgtttgactcagtggtttacattggttgctcttccaggagagctgggttccatccccagtacccacatagcagttacaactttctgtaattccaattctctagtatctgatgccccataggcatgcatatgatacagacatacatacaggcactcatctgtattcattaagataagaaagaggggaaggtgggaaaggagagagcattgaacagtcccagcatttggagacaagcagctgtgtatcttatgaggctagcctgagctacataaggaagctccaggatagcaaaactatataatagaaagttcttttcttaaaaagagatggagaagagaattcaatgccgttttaaagatttattttatgtatatgagtacactgtagctgtcttcagacacaccagaagagggcatcagatcccattacagatggttgtgagccaccatgtggttgctaggaattgaactcaggacctctggaagagtagtcagtgctcttaaccactgaacccatctctccagcccaaaataaataattcttttttttttttcttttttaaagaggggaacaagtcactaaatttggctcatgggaagaagaaaggacttgagttccagtccttatcagtccatggtacatctctaaccctagcactcaagagttcaaggccagaatgagcacgtgtaataagactctatttcaaaaagaacaaacaaaatcccagaactgtggataaataaaaattgaccagcactttttttttttttcagacaaccttatgtagcttaggtgatctcagactttctctcttgcctctgctttctctgtgtcgagattataggtggttcccgccattcccagctcctggggcatttctttcctttttagttgtttaggggttttgtttgttgtgtttgttaatttgttttttgtttgtttgtttgtttgagacaagatctctagacctgggtgtcattgaactcacagatatccccctgcctactgcctttcaagtgctgagattaaaggcttgtagcactcattgggctttttttgtttgtttgactgtttgtttgtttttaagtctgccctggaaggttagttcctggagctttgtaggatcagaatccttaggttctccaggtccttgtgcacagagtattcgcataaatacacatccttctatacacttgaaatcatttctagtttgtgttacctaagacaggataatctctaatgtaaatagttgtcatacattggactgttctgggaataatgacgggaaaatccatgcatttttagcacagccatgtttttttccctgaatattttcagtccatggtttgttaaatttgcagctgctgtgctggtttgaatgctgtaatggtacttttaactaatgggatctgcatatgcagaactcataaatatgtagggccaactgtaagtttagactaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgatggcctgtgagaaaccaggaaagaagtctgttgaatcctgtcacaacgttggactactggcgcatgatggacaggtcaatgaggatggccagcctgacctggggaaggccagggactactacagcagggcctgtgatggtggctatgcagccagctgcttcaacctcagtgccatgtttctacagggtgcccctggctttcctaaggacatgggtctggcgtgtaaatattcaatgaaggcctgtgacctgggccatgtctgggcctgcgccaatgccagccgcatgtacaagctgggagatggtgttgataaggacgaggccaaggctgaagtgctgaaaaacagggcccggcagctgcacaaagaacagcagaaaaacgtccaacctctaacatttgggtagtgcgttgcccagccccctttccagcaacagacgattcaccctggcagctcctctcccacccgagaggagcccttggaggtcactcagtgccatctgctccagcttgtcacctgctgggagtggctagagtgttttagtaaatgatcctttgtgtgtactctgtgaagacacctacgtttatgggggtgtgtcttaatttctaaactggacctgtgagaggagtaaacggcagagccgtagacttttgggggctggggagacaaagagaagttgggaaacttagcagcctgggcctgaaagaatcagccatcgttatcattttagttggaagagcttgaaaattagaaagtatcctaatttgcataacagaggtcttagaacatggaggcagtcacgactgccgccctctgccttacgtaacccagccgtggtgtgtggtgtgggctccttgtcgatgcagtcagacctttccgcagacttagagggatcaggggcctcgtgctgaagaaggctgaggtggttacattagccttgcttcccctcctctcgacaaatctctgcagttcaaaattagcctctcgactggctctgctcctccagggaagacagatgactctggaagcagctccagctaggaatttgggacatgatgacaggaagctgtccactgagcctctcctcttcttctcccctcccctcccctccccttttcttttctttctttttcaaacagacccttgtgctgccttctgctggccttgccctagccctgccccagccccactggtgctggggttacaggcacgcaccactgtgccaggcaggactgagtctgttaaacaggcgaatgcagtgtttcaggtgcttttccatctgctgtgctgctgttctccagatcctggcaggatgcagtgtgttcatcatggtgtgtatgtgtgtgtgcccttttaagaattttttcccttctgttgtaactctacttgtcaccagggggcgagcttgtcctttttctctgataattctaccgttgtctgtcactaccctggtccccctatgtggcagtgtggcagctagcttcccaagaagacaggcttgcctttgaaggttgagagcacagccccctgccttccgaagtccattcaggagagagtttttcctgagtgcagaaacagcttttaaaagacatcaagtttgttttcagaatgtcttgaaaatagtatttggtgtgattgaacaccataggccaatgagcattggaaaggtgctaatcatgcctgggcaactacataaaaaccacaggaacacttctgcagtgcctgatgacccacgtttagtccctgagagcgagcgcacagtggaagtagacagctgattcctgcacattgccctctaacccacaaaggagtgcacacacaatcaatgaatacatgtaataaaacacgtgaaacaagacaaatgatttttaaaaagccatgtgtggtggtgcactttggaggcagagacagcctggtgcacataggaagttccaggggtacatagtgagaccctgtctaaagaagaaaaaaaaaaaaagaaagaaatggcaaatgtatgtgtgagatgccctctgcagcatgacaggaggggtgcagactgcactgcacacactgctgtgactagaggggccacacaccaacgcaggaggaatgcagagtggcagggacgtgcatcacgaactgggacacagtggcacagccacttgcagagacagtatttaaaggaaacgtacagcatcttttggtaatcttgtccctttataattccccaggggaattagaaatatgctcgtaccaaaatgcatgtgcattttcttaggagcctgtttataattgccaaaacttggaagcagtgacggtgtccttcagtaaacacaaggataaatggtacattcagtgatggaatatttacttcagaaaagaatcacaaaagacagagagggccctattgaatgaaaggccaaccaatccattctggattacaactggaggatactggtatcctcaaaaagtggacccatacttttggtcttagatttggagacagagacgggtgatctcttgagttggaggccatttagggttagatataacaactttgtcatgaaaaaccaaaagaaagaaggaaggaaagaaacagtacgttagagcttggcagtgtgtctcagtggtagagtactgtgttccagcactgcagttaaatctgaggtggccgactgcagagctggctcagcagacaggagcactcgctgctcttactgaggacctgagtttggttctatcacccacatgtcggctcagaaacttctccgtctagtcccgggggatctgataacctcttctggcctctgtaggcgaatatggaacaccgatatatatgcaagcaaaagtcttatacacaacataaagttctaaaaagttcacgtgacaggacaattggaaaacttttttttttttttctgagacagggtttctctgtgtagccctggctgtactggaactcactctgtagaccaggctggcctctgaactcagaaatccgcctgcctctgcctctgagtgctgggattaaaggcttgcgccaccacacctggctgggagaacattttttcaggcacacgagaccactctgttggtactcttgacagtgaatacaggtcatgagccatcttttcacattggtaaaacgtgaagagttaaccatgaagtaagcgagggctttacggatggcgcgtgcgcataagccctctgcggagggtggccaggctgtttcatgtaagggctgattctttatacagaggaaattactatattgtctcaattttgctatgaaccaaagctctaagaaaatgtattcaaaacagaatcacccagatactacctcaacccagtaggaccactactattaaaataaacatcacatataaattggagtcttacatactgttggttggaatttgtcagcttagaaataaatttctgttttatgaaattgcttgcaaatactcgtgagtatcagctttgtagagaaaaagcctggacttcagctcttacagctatttacagttctgggttagtcagaggcaaacttaagcctatatgtttaggcacctgatagtgagaaagataagaaattttaaattagctcctgggagccagtaattccacttgtgtgtacacatctgcaaagctggatctcctgggacatctttgtagcctgtgttcatagtaacatcagccaaaggtccaagcagccctcgtgtcagtgagtgaagagacacggtgccggcacacagcgcaagcatccacaggagaggattctgatgtgataccacatgaataaactgaagaccctgctaagtgaaatgagccagtcacaagaagctaagtgacatatgtactagtatatagccgtgcgtgaagaattactaaatgaacagaggtttcaggtttgtaagacaaaaacaattgctggtgctcggttgcaagcgtgtgtaggtcaccggagctgggtgagcatgcatctagaatctgtgagcagacaggcaatcctgtctaaaaaaggaaacccaacaaagacctatcctgtacatgtaaatatggttaagataataaatagtgtgtgtgtcttagcaccattttaaactatttactttttttaaggctaggtctcactatgtagctctggttggcctggtgccttctgttcagactagatttgtcctgaactcagagatttgcctgcctcctctttctaagcactgggaataaaggtatgtgccaccacatgtggccagtatttttttgtttttgtgttgcttttcaagacatggtttctctgtttatccttggctgctgtcctggaactcacttagtagaccaggctggcctcaaacttacagagatctgcatgcctctgcctcccacgttctgggattaaaggtgtacgccaatatcttttaaatgcagagttaaagatagtataggaactggcaagattccacagcaggtaaagccacttgctgccaagcctgactccagtaggaaacaaaaaatactatttaaaaaaaataaaagtctgggcaggcgtggtggcgtacacctttaatcccagcacttgggaggcagaggcatgcagatctctgtgagtttgagaccagcctggtctactaagtgagttccaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagctacaatgtacttagatataataataaagaaatcttaaaaaaaaaagaaaattagctttctttttttcttaaagacttgtttactatgtatagatgttctgcctgcatgtatgcctgcacaccagaggagggcactgtatctcattatagatggttttgcaccaccatgtggttgctaggaattgaactcagaaccctggaagagcagccagtacactcaaacttctgagccatctctccagctcccaaaattagccctttttaaaattaagaattggtccagcatttgggaggcagagacaggtggatctttgtgagtctggtctacagagtgagttccaggacagtcggggttgttagacaaagaaaccctgtattgaaaaatcaaaacaacaacaaaacagccggaagagggagactgctcagtagttaagagtagttgctgcttttgcagaagacacgggttcccagtacctacgtagtgccttacagctacccctagctccagttccaaaggatccaatgccctcttctgacctcttcaggcaccaggcacacatgagtgtatgcatacacatagacaaaacataaagataataattttttaaacattaaaattattcaaaacacttcataaatacgggcattctctgtcgctaatactttggcctttttctttgcaagaatcatctttgcaaagccaagtgtgagcctggtctacagagtgaggtccaggacagccagggctacacagaaaaaccctgtcttgaaaaacaaaaccaaacaaacaacaaacaaagtcaagtgtgatggctttgaaccgcacagcagaggcaggtagagctctgaattaaagtccagtctggtccacagagggagttcctggactccacagaaaaaccctgtcttgaaaaaccaaacaaagaaaaaagagagagagagaagaatcctgttttcacagtcacacgatggcttctgagattctgaagggacagttcacttggcccttgtgtactcactctcatttatggagtaatttctgcctgggacctgaggtgcctgcctcattaggtcacatcctgagatggacctgggaacaatagagaaggttagctgtcagaatgttacatttcaagccagatgtggtgtgtgcttataatcccggagctccggggatttagaggattgaattccaagccgctcggggctgcataatgaggctctgtttccaaaaaaaaaaaaaaaaaaaaaaaaaaaaattccagcgtgggacatatggatgatatggggcctgagcaaagactgtgaggcaagggagggcggggaagagactgaggcaactggagaacaaaatttaagagtacagtcaagcatgaatttaaagagaaacataaattttagctggggcaattgcaaagatggtgggagtcattcattctgatttgacgcttgtgtgaatgggttgaacaagaaacagctgtttgctgttttttaaaatcgatgtaaatacatctaaaaataagttacttttttttggtttgtttgttttatgaaattgtttgaaaacttttgtgcagagcagcacagggcagagaaagtgccctgatggtgttgtgcagtgtgcaccattcaggattagtgaggtggactcacctgtttagggcatctgacaaggaatgagaaaaactcattaaaaagtaattgttttaggggctcgtaagatgagtcagtgggtaaaagtgcttgccctctccccccccaaaacctgatacttggagttcaatccccagaactctcatataaacaaggtaagtgaatccaggctccctgtatgtctgtagcatgcagatacccacacatactaatgatgaagatactaaaagattaaatacagttttagaaagctttgacttccgagccgctcttgccacacagatcttcacttggaagcctcccttctcatggtttgcagtggttgtgtggacccaggcctcacttcttaggtccgaagggcggatactggtgtccactctttgttctgcacgttattgactctctgatcttggagaagctgcccaaccttctgtgttcaggtagataagaaagtgatcgttccgacaggtccttgggatggttaagcaactgcgaaggcagattctttagttaggtcattgtttcttgccccattgttttgttagcttctgtgggagtctagcctttaaaacccggctgccatcatttaactatctggggagcaaaggaaggggctttctggggaggggggttgatggcatagagcagctgcaagaggtaggcctggggcgggggggggggcttggggcccctcttctttcctctgctgcctgaacacactccctgagaacagcaggcgcccagtggaagctgttcccagctgttgcccctcctctggcctgagaagtgccaattgtattacatacagtttatgtatcagtcctctgtactgtttaaatcggaaagacagccctttccccaacgtgtctcccacccccatgccactgtatttggctccttcttgttccttgggtttctgcatcagggatttgcctgtagtctgtgtgagctaccaccaaaaggtggccagtacacacatgctaactgtgggggtggatgtgtttgataactactaacagacattgtataccttgaatatatacacttccattggtaagtttattaggaatgaaatgagaaagaaacaacagaagtacccaggttgcctatactggattttctcctggaaccccttccgtctctggcctcctggtctggaaggctgcatgttcctccaggctgcagtgatgcagtggcccctgtgtctacacatagccgtcacccatcagaacatccatgacacttgccatcctctgcagaccaggttggcctcaaattctgataagagatctgcctgcctctgcctcccaaattgtaggattaaaggcatgtaccaccaccacctgtctgataaaacatctttaataaggcaatataaaagaaagcatttggttgggacccagttcctggtaacacaccttctccaatagggctacaccttttacttcttcccaaatagccaactggagaccaagatttagctatatgaacctattggggcctcttcattcaaacatccacagctgtcggctcagcttgctacattgccaaggctagccctgaattagtggaatccttacagtactaggattacacaccaccagctatgtaacaagatccttgagaactaccaagggcaccaggaagcggttacccatgcctttaatcccagcggatctctgtgagtctgaagccagcctggtctacagagacggttcaggacagacagggctacacacagaatccctgttttgaaaaaccaaaagagaaagaaaggaaggactgagctgggcaatgtggcacgtgcctttaatcccagcactcgggaggcagaggcaggcagatttctgagttcgaggccagcctggtctacaaagtgagttccaggacagccagggctatacagagaaaccctgtctcgaaaaaccaaaaccaaaaccaaaaaaaaaaaaaaaggaagaactgccaagagggagtgaacctagaaggatgactcacgggtaaagcgcttattgtgcaaacatgtggaacagaggtcagatcctcagaaccaagaaagccaggtgggtgtggtcatcgtcctacaatcccacaactggggtgatggaggcaagggatccccagaacaggcagaactagttagactggtccacatcagccatctctggatacaggtgagagaccctgcccaataagtaaggtggagagtggtcaagggagatacttgctgtcagactctgggctccacttgcatgcacgggtaaacatgaaggcccacggatacctgtctcacaaacatatcaacatgcaaaagacttacctcatccccgactccacaatgacctaaaactctcccttaagggccctcctcccagaggttctgccacctccccacagcagggctctgggaacaaagcttgtccatccgtgaagggacaggtgagcctcaggcaagcacagccttgccctccgctcctccttactccctcagccagcactgcggctggatgctggggacacagagcccctgacagcatttgtcacttaggagctcatggtccccatcatgactgaccactgtctgagtacaaactgttctagtcctctccacaaccctacaagggaaacgtttattctctccatttttcagacagagagaccaagtctcggccaatgtagctagtaggaacacaacagaccctgtggacagcaactgggattaagacttggtcctgagccgggcgtggtggcgcacgcctttaatcccagcactagggaggcagaggcaggcagatttctgagttcgaggccagcctggtctataaagtgagttccaggacagccagggctatacagagaaaccctgtctcgaaaaaaaaaaaaaagacttggttctgcctgcagccttccattcagatgctggaaaccaagcagcacacatacggtatcttgaggcttgagtagattctggggaacaggagttagaagctaaggccagctgcagtgggacatggtgtccccacagctccctctgtgctccagagtcctcttggcttggctacacggatggcccaggagaacatgcctaagctggctattctgctcacctttagcaaactgcccctgggccagggttccctgagggaacctgaaccaagctgggttccattactccaggaatagcagctgacactgctccccacccaccgatggcttctgaccaggttccccgaggccccagcagtctccagaagccagtggcagcaagctgtgatcaggaagctgctgtggggtaggtaggaatagtgaccttaattgccttctgtgtacaggggcctcctggaagagagtgcctgggaggaaggctggggcctgttttgcagatgaggaaatgggatgggggtggggactcagatatagtttgcccaaggtcacggtgagtgcgtggtaggcctggagttgagcttagactggccctgctgtgaccctgattctgtgagaaggaaggagtactcttaggacctcagaagggtcctggcatggcagacaatttcccaggcctcagagttggtgcctcaggggaatgtggcccagaatcctataaacagcagggatgagggactgcgtatttataaccctagccctccagttgctacagattcaaggcctatagaatgagttccaggccatctggggctacaaacttaagaccctgtttcagaataacaaaagaaaagaagaagatcagactgactctcaagttaaggcccagcagctacatgtaggtgttatgcagcagtagagcccagctggcctttagctctctt

SEQ ID NO: 746 - DNA, 884 bp, Mus musculus
agcgatttgtgggagtcggaatcatggcgggcttggttgacttccaggacgaggagcaggtgaagtccttcctggagaacatggaggtggagtgtcactaccaatgctaccgcgagaaggacccggagggttgctatcggctggtggactatctggaaggaatccaaaagaattttgatgaagccgcaaaggtgctgaagttcaactgtgagaaatacgggcatggtgacagctgttacaagctgggggcttattacgtgactggcaaaggaaagaagtctgttgaatcctgtcacaacgttggactactggcgcatgatggacaggtcaatgaggatggccagcctgacctggggaaggccagggactactacagcagggcctgtgatggtggctatgcagccagctgcttcaacctcagtgccatgtttctacagggtgcccctggctttcctaaggacatgggtctggcgtgtaaatattcaatgaaggcctgtgacctgggccatgtctgggcctgcgccaatgccagccgcatgtacaagctgggagatggtgttgataaggacgaggccaaggctgaagtgctgaaaaacagggcccggcagctgcacaaagaacagcagaaaaacgtccaacctctaacatttgggtagtgcgttgcccagccccctttccagcaacagacgattcaccctggcagctcctctcccacccgagaggagcccttggaggtcactcagtgccatctgctccagcttgtcacctgctgggagtggctagagtgttttagtaaatgatcctttgtgtgtactctgtgaagacacctacgtttatgggggtgtgtcttaatttctaaactggacctgtgagaggagtaaacg

SEQ ID NO: 747 - protein, 217 aa, Mus musculus
RFVGVGIMAGLVDFQDEEQVKSFLENMEVECHYQCYREKDPEGCYRLVDYLEGIQKNFDEAAKVLKFNCEKYGHGDSCYKLGAYYVTGKGKKSVESCHNVGLLAHDGQVNEDGQPDLGKARDYYSRACDGGYAASCFNLSAMFLQGAPGFPKDMGLACKYSMKACDLGHVWACANASRMYKLGDGVDKDEAKAEVLKNRARQLHKEQQKNVQPLTFG

SEQ ID NO: 748 - DNA, 31397 bp, Homo sapiens
  misc_feature (1)...(31397): n = A,T,C or G
gccctcaaggtactcaagtctagtaggaagggaaggaagacaacagaaaaagaacatggtaagtactcttataaaaagaagcatgtttgtgtgtggtggctcatgcctgtagtttcagttactcaggaagccgaggcgggaggatagactgagtccaggagtttgaggctgcagtgcactatggtcatgcctgtaaaatagccactgcactctagcctgggcaacgtagtgaaaccctgtctcaaaaaagaaaaaaaaaaaaaaggaagcagagcacttgctaaagcacagaggcaaccagcctggtggtgggggcagtcagtggtcagagcaggcttcctgaaacaggcactacttgacctgggttgttgttgttgttgttgtttggtttttttttttttttgagacggagtttcgctcttgttgcccaggctggagtgcaatggcacaatctcagctcaccacaacctccgccttctgggttcaagcgattgtcctgcctcagcctcccaagtagctgggattatgggcatgtgccaccatgccctgctaattttgtatttttagtagagacaaggtttctccatgttggtcaggctggtctcgaactcccaacctcaggtgacctgcccgcttcggcctcccaaagtgctgggattacaggcgtgcgccaccgtgcctggccttgacctgggttttgaaggaaaaataattaccttaattaacggagagggaagagcattctaggcatagggaatcacatgtgtgaaggcactggaacgtgaaagcaggtgatgtttatagggtcaacaaataatttgggatgaggttcaaagagtgtgtatgggagggaagagaacaagctggaaaggcaggctggggcggatagcaaggtttgtggccaaaggttaggggcgtagactttaatgccatgtgacatttagttccagttctctactggcacaactgcttttttctgacagtcagtatttggttacatttagaagtccagattagttttttcactcaacaacatgggctgagcacctcactgtgtcagtttttatgtgcaggcaggagggctcaggaatagacttttggggtcacagcctgaaatcttgtgagctttttttagaaggcagtaaatctcacccctgacttgagatgatttgtcctaaaacctgatcccttccttgtccttggtgttgcaacccttcttcctcatttggatttccatgagcatgctgcagtgagctgggtccacacacacattatgggaatggctataatcagaagccgagccagccagcttaggtggtgaacacatgcccgttgtgctctggcacgtgagtctcatgaatgagatggagcaggcagagaatatcaggtccctactctttgggatttcatagtcttaaaagcagaaagttggccgggcgcgggggctcatgcctgtaatcccagcactttgggaggctgatgcaggtggatcgtgaggtcaggagttcaagaccagcctggccaagatggtgaaacccccctctctactaaaaaaaaatacaaaaaaattagccgggcgtggtggtgggtgtctgtaatcccagctactcaggaggctgaggtagagaactgcttgaacccaggaggtggaggttgcagtgagccgagatcgcgccactgcactccaggctgggggccagaatgagactccatctcaaaaaaaaagaaaaaaaaaattagatctggaggcattgttataagttattaaccacatagcataaacggagcacttacaaagtgcttcactctgtgttgggacctggaaggcaaataaagaaatcatatttggttcctatccttaaggtgctcccagtctggtaaaacaggcgatgaccacagtgcttcaggaagtggaggagccctcagctggctaaccacagcccactgtcaaccagtaggggttaggaaggcatcctagacaaggactggtggtcgggcaacatagtttgaactgacactggagagaggtggaaagagcagcccacacagacaaaacagcctgaggagttcagagaagaggagtgggtcagagggattggtttgtctagtataggtggggaagtagcaagtggagtggttggcgggggccagatgggagggcctggaatgctgagctaaggatgcgggcattgtggagcctttggtttccaaatgggggtgacacagctcttttagaaagacaagtccctttcattcctgggctcagtgcgctcacctgtaaaatgagggagttgaagattattttcaaaatcattccagtgcatgtatcctgtgatttacagcattgcttcttaaagtttattgtgtatctgtgtcacctggggatctcagtaaaatgcatattctggccaggcagtgtggctcacacctgtagtcccagctatttgggaagctgaggtgggaggattgcttgagcccagcctgggcaacataatgagaccccagtctctaaaaataataataattttaggccgggtgcggtggcttatacctgtaatcccagcagtttgggagcccaaggcaagtggatcacctgagatcaggagtttgagaccaccctggccaacatggtgaaactctgtccctactaaaaatacaaaaattagctgggcgtggtggcacatgcctgtaatcccagctactcaggaggctgaggcaggagaatcacttgaacctgggaggcggaggttgcagtaagccaagattgtgccattgcactccagcctaggtgagaagagcaaaactccatctcaagaaaataataataacttttaaaatgcatattttggttcagtaggtgtggtgggggtcccaaggttctccatgtctactaggatctcaaatgatatggatgctgctgttcctcaagccacactttgagtagcaaggatttagttcttgggtactcaaagtgtagtctgaggtccagcctttgtaagtcatacaatgttctataagttatctcattagggccaggcgcggtggctcacacctgcaatctcagcactttgggaggccaaggcgggtggatcacctgaggtcaggagtttgagaccagcctgaccaacatagagaaaccctgtctctactaaaaatacaaaattagccggtgtggtggcgcatgcctgtaatcccagctactcaggaggctgaggcaggagaatcacttgaacccaggaggcagaggttgcagtgtgccaagatcgcgccattgcactccagcctgggcaacaagagcaaaactccgcccccccccccgaaaaaaagttatctcattagaaatagtgtgctacctaatttttacagtgttttaaggtttgcaaagagatatacaaaccttatttccttcactgctttcagcagttcttcttgagaggtaattttttttttttctgagacagggtctcactctgtcatcccacctggagtgcagtggcaaaatcatggctcactgaagtctcaaattcctgggcacaatcagtccttccgcctcagcctcccaagtagctgagactacaagcacatgctgccacacctggctaatgtttttattttttgtagagacggggtctctttatgttacccaggctggtcttaaactcctaggctcaagggatcctctcaccttgtcctcccaaagtgctgaaattacaggcatgagccacagcacctggccaagacaacattttcatggttatgtaaaacaccctttaaacttcggtattgaggttggtttgtcttttcccagcatcaaggtggggtagagattgggagtcccattttacagatgagaagactgaggatataaaaagagaataaaagagaatggatttagccaaagctgaacaaacactatggaagtggcagaacagtaattagtattgaaacctctattccagtgcttatttccagcaaatgtctttttttatttttattttttattttttgagatggagtctcactctgtcgcccaggctggagtgcagtggcacgatcttggctcactgcaacctctgcctcccggtttcaagtgattctctgcctcagcctcccaagtagctgggattacaggcacatgccaccacgcccagcaaatttttttgtatttttagtagagacggggtttcaccatcttggccaggctgatctttaactcctgacctcatgatccacctgcctcggcctcccaaagtgctgggattacaggcatgagccattatgcccggcctttttaaaatttaatttaattttattctttgtcttttttgagatggagtttcattcttgttgcccaggctggagtgcaatggcacgatctcaactcactgcaacctctgcctccccagttcaagtgattctcctgcctcagcctctcacgtagctgggattacatgcacccgccaccatgcccagctaatttttgtatttttggtagagacagggtttcaccatgttggccaggctggtctcgaactcctgacctcaggtgatctatccacctcagcttcccaaagtgctgggattataggtgtgagctaccacaccggcctcctggcccttttttttgagagagaatctcactctgtcacccaggctggagtgcagtggtgtgatctcttcttactgcaacctctgcctcttggggtcaagcaattctcctgcctcagcctcgcaagtagctgggactacaggtgcctgcccagagggaagagtatgacgctgtcactaacttgctgcgtatcctgggacaagcccctttcctctccggaccttggtccttttccctgtaaagcaggtgcctgtccagcttaaagcacagcccgggagcctcagagacaggcaggaagtcaaggttgcaataattcgggtttccgaaagctttgcgcttgccctaggcccgacaggtcacgtggggactacgtgatgtgcaatcgccgctgttgaaacaagagcatgtgcagggctggcagctgtcacggcctttctatatcttggggggatggggagtgatgaggtgaggaagggctgcaggctctacgggcacgggcttgagggggttgactggccaaagcaggaagggcagggcgtctccacggctaacccacaaaatgctgagagtcccgaggggatctgcagaggacggcgagctgggcagcccccgagcaagccacctggaacctccctcagctgcaccagccactcagaaagatcgggtccgtttagacacgagcaccaatctcaggcctccaaagtgacctcacagcaaacgtgattggtccggtctctctcacggggcggctcctttaccaacgtgtaaccctttgggagaggtttagcgggctgtgtgacctggtggaaatcactttacttatctggacctcctttataaaaaggaggtattaagacctatcccgaggcctggagcggtggctcacgcctgtaatcccaacgcgttgggaggccgagaatggataatctttctaacaaatggtgctagagtaattataaacccacatgcaataaagtgaacctcaactgttatctcatacctcatacaaaaattaatctgaaatggatcataggctttctaaatataagatttaaaccataaaatttctacaagaaaatataggataaaatcttagtgactttgggtttggcaaagacttcttgaatacgaaagaaaaagcacaaactattaacaagaggaaaaaaatcaataaactagacacaccattaaaatgaaaaacttttggttttgaaagacactgttataaaaacaaaaaaggcaggccaaactgggagaaaatatatgcaaaacttctgataacggacttgaatatataaataactcttagaatgcaataataaaaaacaatccaataaaaagggggcgaaagattttaacaaacatgtcatcaaagatacacagatggcagataagcacatgaaaagatgccaacattattggtcactcaaaaaaatacaaactaaacctatgataagatactgttatattcactataatggctaaaattttaaaagactgaccacacatcaaattatggtgaggatgtagggcaactagaactgtcaaacactgctggtaagaatgtaatggtagaatcactttagaaaacagtttgggtgtttcttaaagttagatatatacctaccatatgatctagccattccactcctaggtatgaaccccaaaaatggaaatgaatgcccatacaaagacacgtacacaaatattcacagcagctttatttgtaagccaaaaactggaaacccaaatggataaacaaattgtgatatatctacatcatgaaatgtcattcactaagaaaaagaatgaactattaatacgtgtggtaacatggatgaatctcaaaataattatgctgaatcgaagaaactatacaaaaagaaacagtacttactgtatcattctatttagataatatcctacaaaatgcaacccatcttcagtgacagaaagcagattaatggttgctggggagggaatgaagtacaaagtcacatgaggaaattttgaggtgatgaatatgctcattatcttgattgtgataatggtttacaggtgtatacatatgtagaaactcataattgttactttaaagttatgtgcagtttcctgtatgtcaattagaccttcatttaatgtttcttatagctttaagaaaaacctgggtcaaaagagcaagagtcagtgatattctaagttccattaatgaaaaccaaattatttggaatgataatccctcttcttaattcagtcaacaatacttgggcacctaatattgctgggcacaatcaagacactgttattataacaagaatgagctaagaccacatggacgatgtcaaattgaagcagagaacttaagaaggcaagccaaaaaaaaaaaaaaaaatacaggggaaaagcactctagggcagaggcaacagttagttcaaacggatcacgaggtcaggagttcgagaccagcctggccgatatggtgaaaccccatctctactaaaaatacaaaaattaggcgggcattgtggtgggcgcctgtaatcccagctattcaggaggctgaggcaggagaattgcttgaaaccgtaaggcggaggttgcggtgagccaaaatcacgccactgcactctagcctggatgaaagagcaaaacaaaaaaaagtgacctcttacttggttgagcctctcatcaccaactaactctcttgtgccctctaccgctcaggtgatctcatttcaatgcagttcaactcagaaaataaagggaaacattcccagattttagtaatcgacatcaccctgctctattctatcatcaagccctattctattcttggccctgtgaccagcatacaggacacagaggtcacagtctggtggggaacacagactttcatgccattattggcatgacaagaaacattcctggaacaggaatgactttgagccaggcgctctgccaagcacattgcatacatgaacttgtagtccttctgacagccattacaaatggatctgcatttacagaagaggattcagactcacaaacatgattggtttaaggttacaatttaataaacatggaacatggattctgaactaagatctgtccccactccaaagccagttctttctttcctactacactataccagaataaaccaagtggtgtggaacaccaaaatgggagcatctaaatctaatttgaatgtgtgtaattgttgtgtctgggaagactttacataggagagtatttccgatttgtgtcaaaaagggtggtccaggcatcaagagcagaggtaaacagggacacaaacttgggatctattcagagaacagaaggttggtgggatgtgggggaagagaggcagaaaataaggctagaatcagattgcacagggtcttgaaggccatcctaaagaagatgacctcaaaccaaagttcaaggattcccatcctgggccatgtgtactgaggagtcccctaaggtgatcagggtataagaaaccacaggtaaatgtggtatattgcctggaatgtcaattttactcaaaggcttgggggagaaaaggcaatcttctgttatcctatgaaagatgtattatggggaaatgaatgtaaaatcctatgaatttaaaaaataaaactgggatttcagacattattggctgccttccaataaataagtggttggaaatagtccattctttgctgccattggggatagcttaataatggagccatttggaaagcattgttataggcgatgggaagccatggatttagctccattgagaattcaaaagtagggctggatggaattcaaagatgaatgggaagtcagccgggtgtggtggctcacgcctgtaatcccagcactttgggaggccgaggccagcggaccacctgaggtcaggagttcaagaccagcctggccaatatagtgaaaccctgtctctactaaaaatacaaaaaaaattagccgggcgtggtggtgggcacctgtaagcccagctactcgggaggctgaggcaagagaatcgcttgaacctgggaggcggaggttgcagtaagctgagaccgcgctattgcacttcagcctgggcaacaagaacgaaactccgtctcaaaaaaaaaaaaaaaaaagatgaataggaagtggctgtcttaggagaactttccatctaagctttatggaactgatgattcttagcaggaacaggagcaggaaaacaaagcaaaagtannnnnnnnnnnnnnnnnnnntctacctcattcattctttttcgctcttgtcgcccaggctggaatgcaatggcacaatttcggctcactgcaacctccacctcccaggttaaagcaattctcctgcctgagcctcccaaagagctaggattacaggtgtgctccctgtaattttgtatttttagtagagacccctgctaattttgtattgttagtagagacagagtttcaccaggttggccaggctggtctcgaactcttgacctcaggtgatccacccacctcggcctcccaaagtgctgggattacaggcgtgaaccaccgcgcccggcctcattcattcttttatttttttaaaaaaaattattattgcataccaactccctcacttactgtgtgaccttggacaaactacttaatttctctgtactttagttttcttatctgtagaatggggataataataatacctacccacagtgtcactgtgagtgtttttacagtgacatgatatataatgagaattaaatgagttaattcatataaagcatttagagcctggaacaaagttcagcactgtttgagtactaggtgttataacagtgacgttgctacacccttcactgctactgtgttccagtcaacatctcccatagccattcattgcttaggtaattcatgttggtggccaagacaggtctgggaagaagacagatgaatcagactgctcactgcactttgtccagctacacctggcacatatagaagctcctctaaatgcttgctgaatggataagcgaatgtcttcctattgaactccaagttctttgaaggcagggaccatattcctagctgtcatatccctagaacaatgcactggtgaggcacacagtaggcgcttagggattatacatagataaatgactgcaggtggaaaatcactaaggctacaaagcgagcatagataaggtgctgcagagagacagcccccagtttcaggaaggcggtagccctggaagcgtggctgccagcgcccttaacggcgcgatggctgctgggaagcacaggctcgcttggctcgccccgggatcccgggagagcgccgcggttggcgtcggcgtcagccccacgccccgccccgccccctccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggtgagcggctccagcgcagcccggcgacgcgtcggggagggacgtgcccggagaggtctggtctgcgacctctgagaggctggagaaggaatcacgtggcgggcgggggacggggtctgtggatcgcggtgaccgcgtgtgttgggaagggcgatgtgtcccgggaagaccgagccaggaggccggggcgggtaggaagagacgtgctggggcttttgggttagggactggggatccatcggtgaacagatgaaactccctgccctcgtggagcttccaagctagtgcggggagtcgggcaataagcctcaggtaattcatgaaatcgtgttcgaaagtagtaagtaccggccgggagccgtggctcacgcctataatcccagcactttgggaggctgaggcgggtggatcacgaggtcaggagatcgaaaccatcctggctaacacggtgaaaccctgtctctactaaaaatacaaaaaattagccgggcgtggtggcaggcgcctgtattcccagctactcgggaggctgaggcaggagagtggtgtgaacccgggaggcggagcttgcagtgagcagagatcgcgccactgcactccagcctgggcgacagagcgagactccgtctcaaaaaaaataaataaaaagaaagtagtaagtgccgtggaaaaaagactgggtgaagggtgtcaggagggcaggagggcagttttaaattgagtgatcagggaagatcactgagaaagtggcaattgaataaagccttgaagaaggtaagggagtgaaccatgcagttcttaccataggtaacagctggcgaagacgccctgaatcacaaatgtgtcctgtgtgttgtgtgaacattgaattgacttaagagtataggtggatggtggtgaccagaggggtccacccagagcagctaatacctttgggtggttttcttcttcttgctttatttttattttttgtattttctttcttttttgagatagtatgtcactacgttgtccaggctggtcgcaactcctgggctcaagtgatcctcccgcctttgattacaggcatgaaccactgcacactgcctactttttaatttttttgtttttttgagactgagtctcactctgtcacccaggctggagtacaatggctcgatctcagctcactgcaacctttgcctcctgggttaaagcaattctcctgcctcagcctcccgagtagctgggattacaggcacccaccaccaggcctggctaatttttgtattttcgtagagacagggtttcaccatgttggccaggctggttttgcactcctgacctcaagcaatccatctgccttggcctcccaaagtgctgggattacaggtgtgagccaccgtgcccagccttttttttttttttctttcaaataaaggactggtgtggtggcacaagcctgtaatcctagctctttgggaggctgaggtgaggtgggaggatcacttgaggccaggagttcaagaccagcctgggcaatatgatgaaaccctgtcactactaaaaaaaaaaagaaaagaaaaaaagtggcactggccctaccttctaatagcttgcagtttagtcagtttagtttgcagaaatgacatagctattccttgaggctaatccgtaacatagaccataacacaaccatatacatatcataacatagtcatgacacagagttgctctgcagtatgatggcttgaaaagaacctggggttgggccgggcacagtggctcacgcctgtaatcccagcactttgggaggctgaggtgggcagatcacctgaggacaggagttcaagaccagcctgaccaatatgattaaactgtctctactaaaaatacaaaaattagccggacgtggtggcatgcgcctgtaatcccagctactcgggaggctgagacaggagaatggcttgaacctgggaggcggaggttgcagtgagctgagatcgcgccatcacactccagcctgggcaacaagagtgaaacaacgtctcaaaaaaaagaacctggggttgttctttgagagctggtccatgtcctaagtatagaaagaacttagaggaattggggtcactaaggaacagggtggttagggaagactttgaggggaggtctggagggctgggcaagtgttgattaaatggaggagagggtgggagaagaaagtgctatcttttggaaggttgaagtcaggatttagtacgtttgaagcgggagtctggcccacagtatgtcagggcttgaatgccagggtaaggaatatagactttgctctgtaggcaatggagagcaaaacatgtctgagaagcaagttcttggaattgggaagggtggatatatcaaaaggactggctgcagcactttacgagacctgagaagaggctatagttaccgtagcgactggtgtagtagttccttgcatgtcccactttcttacctggataactgaagtcgccttctaacctgtccctctctttgcactttactcccttaaaatccatttctactcgcagataaactgatattttaatttcaattttgttatgttaaatattagattttaaaataacctatttgttatcaatgcccaattatataccctcacataattaaattcctccatactcaggcatatatgaacatatataccagagtaacgtttttgttggggggtggggttgtttgtttggttttggtggctttttggttgtttgttttctgagacagggtattactctgtcgcccaggctggagtgcagtggtgcaatctcagctcactgcaacctctgcctcccaggttcaagtacttctcctgccccagcctcccaggtagctgggattacaggcgtgttccaccacgcctggcttttttttttttttttttttttccctgaggctgagtcttgctctgttgcccaggcttgagtacagtggcacgatatcagctcactgcaacctctgcctcccaggttcaagtgattctcctgcctcagcctcccaagtagctggaattacaagcgtgcgccaccaagcctggctaatttttgtatttttagtagagacgggatttcaccatgttagccaggctggtctagaactcctgacctcgagtgatctacccgccttggcctcccaaagtgctgggattacaggcatgagccaccacacctggcctgaatcatattacttattttcttgaaaccctccagtggtttactgtttcagttggaaaaaatcataactccatcctatgtttcacgaggcctatggtctggtccctaccttccttcttcatttcctgaccctcctccttggttcagccatgttgtaccttattcgtgccaaacttattctttcaggtctttgtatttactgttccttgtgccaggactttgtgcccctgcccattttattgtcttttaatttcattttttattttttatttttaaattttttccaaatccctgccccactcccatttcattgtctttaaatagctagtgctttcttgttattgaggtcacagtccttggtgagcccctccccagtggctcagtctttgttagccattcacccaaagttgacagcaaacagttatcctgttttacttcagtcatagcatttatgtatttatttgtataaatttaaggggtacaagtgcagttttgttacatggatatattgcctggttgtgaagtctgggctttttttttttttttttttccgagatggagttttgctcttgttgcccaggctggagcgcaatggcgctatctcggctcaccgcagtctccgcctcccgagttgaagtgattctctgcctcagcctcccgagtagctgggattataggcatgcgccaccatgcccggctaatattttcgtatttttagtagagacgaggtttctcaatgttggtcaggctggtctagaactcccgacctcaggtgatctgcctgcctcggcctcccaaattgctggggaagtctgggcttttaatgtaaccaaccatcacccaaataatgcacttgtacccgttaggtaattttttattcctcaccatcctcccacccttcccaatctccagtgtctattattccacactccctgtgtccatgtgtacacagtatttagctcccacttataagtgaggacatgcagtatttcacttcctgtttctgagttgttataacatttattactgtttgaataaattttgttcatttatttatttattgtatttcctcccctagaatgtaaattttaggagggcaaatgagtatattctcagcatctagaaccatgtctggtacatagatgcatagagatgctcaaatatttgttgaacgaaaatgaatgagagatatatgttgtcactgggggtaaagaagaggggagagagattaaggaaagaggtttactgggactgggagactgccaaggaagtagagcctattttcattagaagctgccgcctctactctttctctttggctttcatgttcctaccctggctgaggagtaagctatagtcattacagcacccttttctttttctttctttctttttttttttttttttaagacagagtctcgttctgtcacccaggctggagtgcagtggcgtgatctcggcccgccgcaacctccgccccctgggttcaagcgattctcctgccttagcctcccaggtagctgggattacaggtgtgcgccaccacacctggctaatttttttatatttttccactcctggctaatttttttgcatttttagtagagacagggttttaccctgtccaggctggtctcgaactccagacctcaagtgatcctcctgcctcagcctccccaagtgctgggattacaggcatgagctaccgagcctggcccagcacccttttcttgctgctacaaagactagcctatgagccttttaggttttcactgtttttaccatttaacttcatgagagattccaaaactagcaaagtttcaatcatggaagtcagtggatacttgggcgtggctgacagggagcagaagggctggtgagtggtagagccaatgcaggggctgaggtctccccaagccatgcattgctcagtccatggctgtggggagacaatgccatttgtaggaatggctaaacaccacctacattctttgtggtaaggccaacttgccacacatcaggaggacaggggctgtcttaaaagacatcacctggcctgccacacctgggcaccccctacccccaagtccccactgcgagcagcagccccagacatgaagaacaacccttgccctcttctcgcaggttgctatcggctggtggactatttggaagggatccggaagaattttgatgaggctgccaaggtgttgaagtttaactgtgaagagaaccagcacagtgatagctgctacaaactgggggcctactatgtgactggaaaaggtaaggagggcctgccttttgggtccttgtcattgatagcagtgctggcctcacacctgagccccatgataagctcttgcagaagggtctcgcaggcattgggaaagtgcattgtaggaagatggagaggtaggagttcagcagagtgatggggggaagaacacagcctttcaagttaggtaaaccttagggaatgctattggcaagtagtgggaccttgagccaatcacttcgactctgtgcctcagttacatcacctgtaaattggagggaaatagtacttgctttgtagggtggtgaggattaagtaggacagcataggaaaaggcatcagcatgtgcttggcacagagtaaggggtcagtaattattgtcttccttctgtcttttctccttgtactctaattgtagttatcactggcatagtgtttacattatctatggctaaataacaaaatagttatttttgttcacctcaatagtttctgtgggtcaagaatttgggagtggtttagtgggggtacctcagggtatctcatgaggttatagtcaagacattggccagggagccagggctggagacattggaaggcttgactgaagttggagtttccaattctaagatgactcactctgatggctggtagcagaggcctctagttccttaccagctgttattgggagagctcagatcgtcatgacatggttcgctccatgggctgcttgagtgtcctcatgacatggcgtctgggttcccccagagtgagtaatttaaaggagacaacaagatagaatccacagtgtcttctatgacctatctttggaagtcacacacttttcatttctatcacatatttattagatgtagcctacactaaggggaaggacttaaattccacttcttgaagaggaaggaatattaaagaacttatggacatatttaaaaccaccacaggccaggcacggtggctcatgcctgtaatcccagcactttgggaggccaaggcgggtggatcatgaggtcaggagttcaagaccagcctgaccaacatggtgaaaccccatctctactaaaaatacaaaaaaaaattagctgggcgtggtggcgcgcacctgtaatcccagctactcaggaggctgaggcaggagaatcacttgaaccctggaggcagaggttgcagtgagctgagatcgcgccactgcactccagcctgggcaacagagcaagactctgtctcacaaaaaaaaaaaaaaaaacacacacacacataaataagtaataggacctttgacaggcagcttttttttttttttgtgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctttttttttttttgagacagagttatgctctgtcatctaggctggagtgcaatggcgcgatctctgctcactgcaagctccacttctggggttcatgccattcttctgcctcagcttcctgagtggctggcattacaggcccctgccaccatgcccagctcattttttttgtatttttagtagagatggggtttcaccatgttggccaggctggtctcgaactcctgacctcgtgatccacccgcctcagcctcccaaagtgctgggattacaggcgtaagccaccgcgcccagcctaatttttgtatttttgtagaaatggggttttaccatgttggccaggctggtcttgagcctcctgatctcaggtgatccgcccacctcggcctcccaaagtgctgggattacaggcgtgagtcaccacgcctggcctcctgtgtattttaaatcaattacttagaacaggggtattcaatctttttgcttccctggaccacattggaagaagaattgtcttgggccatatataaaatacagtaatgatagctgatgagcttaaaaaaaaaatcacaaaaaaaatctcataggccaggtgaagtggctcacgcctgtaatcccagcattttgggaggctgaggcgggcggatcatgaggtcaggagttcaagactagcctgaccaacgtggtgaaaccccgtctctactgaaaacacaaaaattagcctggcatggtggcatgcacctgtaatcccagcattttgggaggctgaggcaggagaatcgcttgaaccctggaggcagaggtagcagtgagccaagatcacgccactgcactccagcctgggcgacacagcaagactccatctcaaaaaaaaaaaaataataataataataatttcataatgttttaagaaagtttatgaatttgtgttaagccgctttcaaagccatcccaggcccatgggttggacaatcttgacttagactatctaatacaatgtaaatactgagtaaataattgttctattttatatattttgtattttttaattgtattgttattttttccctaatatttttgatgtgtggttggttgaacccatggatatggagggcccactgtatgtttaaattaataaacaattaagtgcttgtcatatgccatgttctcactgtaaccccatgaggtagatattattatcattcccaattttcacctcctttacctgtttgagtttcctcataaggtatcatctgaataaaagattctacggctgagaaagctaggaggtctgtgcactatgccaggctacctttcatgctgcctgagctcatagtatggacatttttttttctttttgaggtaaagtcttgctctgtcacccaggttgatctcgaattcctggcctcaagcaatcatcctgcacaaagtgctaggattacaggtgtgagccactgtgctcagccttaaactttattcaggaattgttgttggccaggtgtggtggctcacgcctgtaattccagcactttgggaggccaaggtgggaggatcgcttgagtcccagagtttaagactagccttggcaacatagtgagatcctttctctacaaaaaaatttaaaaattagccaggcatagtggttggtgtgtgcctgtagtcccagctacttggggaggctgagatgggaagattgctttagccggaggttgaggctgcagtgagccgtgatcatgccagtgcactccagcctggttaacaaagcaagaccctttctccaaaaaaaaaaaaaaaattcactgactttggcctgagacatttaggttgtgccctggcttgggtttattttttcctactttccttcctctcaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagcctttttaactgtccctgtgaatgaacaattttgagtgacctacggtttgtgttaattagtgttctttccagattccaggtaccgtagagagtatgttctttgtggtggttgtgccttttaagaacatttgtggccgggcacggtggctcacgcctgtaaccccagcactttgggtggccaaggcgggtggatcacgagatcaggagatcatgaccatcctggctaacacggggaaaccccatctctactaaaaaatacaaaaaattagccgggcgtggtggcaggcgcctgtagtcccagctactggggaggctgaggcaggagaattgcttgaacccgggaggcggagcttgcagtgagctgagattgcgccactgccctccagcctgggcgatagagtgagactccgtctcaaaaaaaaaaaaaaatttgctttttctgttgtctccccagcttgtcaccagggggcgagcttgccatttccctgctggtaacaataccattctgtcaccatctactgttttaggcttccgttttgcagccgtcctgaaaggaaggcttgctgtgtaaatgaaggcttgtgagcacagcagccagcctctcaagttgatagaggacagggacttccccaagtgcacagaggagatttcaaaagacatcaaattcactttttaaaaatgtaaagtagcttttggtgtgcttaaactaggtcaggccaggcgtggtggctcatgcctgtaatcctagcattttgggaggccaaggcaggtggatcacttgaggtcaggagttcgagatcagcctggccaacatgacgaaacccctttctctactaaaaatataaaaattagctgggcgtggtgatgcatacctgtaatcccagctacttcggaggctgaggcaggagaatcacttgaacctgggaggcagaggttgcagtaaactgagactgtgccactgcactccagcctgggcaacacagcaagactctgtctcaaaaacaaaaacaaaactaggccaggtgcagtggctcacgcttgcaatcccagcactttgggaggccgaggcaggcggatcacgaggtcaggatttcgagaacagcctggccaacatagtgaaacctcgtatctactaaaaatacaaaaattatctgggtgtggtggtgggcacctgttgtcccagctattcaggaggctgaggcaggagaatcgcttgaacccaggaggtggaggttgcagtgagccaagaccatgccattgcactccagccaggtaacagagtgagactctgtctcaaaaaaacacacacacacacacacacaaaactgtaggtcaaaaaacatgaaaatatgttcaacatcactaattagggaaatgtaaatcaaaaaccacaatgaactcttaaaattcaacagtaagaaaacaacctgattaaaaacaggccaaaacccttaacatatctcagcaaagaagatagacaggtggcaaataagcatatgaaaagatgttccatataacatgtcatcaggaaaatgcaagttagaacaacagaccactatacaactattagaatggccaaaatccaaagcaccgacagcatgaaatgctgggaaagttggagcaaccagaactcttattccttgctggtgggaacgcaagatggcacagccactttggaagacagttaagcagtttcttacaaaaactaggtaagctcttaccatgtgatccagcaatcttgctctttagtatttacctgaaggaactgaaaacatgtccacacaaaaaccagcacatggatgtttatagcagctttatctataattgccaaaactcaacccaaaatgtctttcagtaggtaaatgggtaaataaattgtggtgcatgtagtcattattcagtgcttaaatcaagctatgacaaattatgagttatcaagctataagaagtcacagaggaacttaaatgaatgctactaaatgaagccagtctgaaaaggcttcatattaaatgatgccaactatatgacactgggatgtattctggaaaaggcaaaactatggagacagtaaaaagcagtgggtgggggaggggagggaggaataattggagcacagaagatttttagggcagcgaaactactctgtatgatactataattataaatacctgtcattgtacatatgtccaaccccctaaaatgtacaacaccaagagtgaaccctaatgtaaactgtggactttgagtgataatgatgtgtcagtgtaggttcatcaattactgcaaatgtacctctttggtgggagatgttgaaaatggtggagactatgcatgtgtggggacaacaactatatgggaaatctctgtaccctctcaattttgctgtaaacctaaaattgctctaaaatataaagtctattaaaaccacaatgatattgcctcatatcccattaggatggctactattaaacaccaaaacaaagtaagtgttgtcaaggatacagagaaattagaaccctgtgaactggtgcagctcccccaaaatgaaaaacagaattgccgtttgatccagccattccacttctgggtacatatctgtgttaggccattcttgcattgctataaagaaatacctgagactgggtaatttataaagaaaagtttaattggctcaggaagcatggtgctgtgcatcctattggcttctggtgaggcctcagaagcttacagtcatggtggaaggcacagggggagtcagtgtatcacatggtgagaaggcaagagcaggagcaagagagtgagcaaggggagataccacacacaaatctcctgaggacagcaccaaggggagggtcctaaaccattcatgagaaatcctccccatgatccaatcacctcccaccaagctccacctccaacattggggattaaatttcaacgtgagatttgggggacaagtatccaaactattaatatccaaaagaattgaaagcagggtctccaagaggtatctatacccatattcttagcagcactattcatagtaaccaaagggtagaaggaacccaaatgcccatcagcagatgaatgaatacacaaaaggcgagatgtacatgcaatggaatattattcagccttgaaaaggaaggaaattctgacacatgccacaaaacatggctgaatcttgaggacatcgtgctaagagagtcacaaaaagacatgctgtataagccagtcacaaaaagacatgctgtatatgaggcatctaaacttgggtatgagttgtatataaactcagaaacagaaagtaaaatggtggctgccaggggctggggtgaggaggaaatgagttttttgtttttgtttttgttttgagataggctcttgctctgtcgcctaggctggagtgcagtggcactatcatagctcactgcagcctctaactcctgggctcaggtcatccttccacctcagcttcccaagtagctgggactacaggtacacaccaccacgcccagctagtttttgtattttttgtagagacgaggttttgccatattgcccaggctggtcttaaactcctgagctcaagtgatctttccgcctcggcctcccaaagttctgggattataggtgtgagccaccatgcctggccaaaatgggttgtttaataggtaaagagtttcaaatttgtaagatgaaaaaataatggagattgttacacatcaaatgtgaatatacttaacactactgaactatatgtttaaaaatggttaacccagcctggcttacatggtgaaaccctctctctactaaagatacaaaaattagctgggcgtggtggcatgcgcctgtagtcccaacgactcaggaggctgaggcacgagaatcacttgaacctgggaggtggaggttgcagtgagctgagattgcaccacttcactccagcctaggcaacagagtgagactccatctcaaaaaaaaaaaaaaaaaaaaaaaaaaaagaggttaacatggtaaattttatgttttaccacaatttaaaaaaaaaacatattgactttttaaaaatgcaaggtttgaagtttttttattataaaattagtatgttctcataaaatgcaatttgaaacagaagaaaccatcacccctcactattcttttatcacctatgggcattctttggcacaatagcgttctcactatttaaccatttttttaaagaatcatatctttttttttttttttttttttttgagatggtgtcacccaggctggagtgcagtgacgtgatctcagctcactgcaacctccacctcccaggttcaagtgattccccagcctcagcctcttgagtagctgggactacaggcgagcgccaccacagccggctattttttgtatttttagtagaaatggggtttcaccatgttgatcaggctggtctctaactcctgacctcagctgatccacccaccttggcctcccaaagtgctaggattacaggcatgagccactgtgccctgccaagaatcatatcttttcaactaacaggttttgtaatttttttttttctttttgagatagggtctctctgtgtcacctaggctggagtgcagtggtgcaatcatagctcactgcagcctcaacctcctgggctcaggtgatcctcctacctcagtctcccaagtagctagggactacatgtgcgtgacaccatgcccagttagttttcatgttttttgtagatatggggtctcgctgtgttgcccaggctggtctcaaactcctgggctcaagcgatcctcctgcctcagcctcccaacatgctaggattacagacatgagccacttgccccactgggttttgtaattttgaagaactaagtttgatttttgggtggcagatgtactggattttttttttgagatggaacttcactcttgttgcccaggctggagtgcaatggcatgatctcagctcaccgcaacctccgcctcccgggtgcaagcaattctcctgcctcagcctcctgagtagctgggattacaggcatgtgctaccacacccggctaattttgtatttttagtagagacagggtttctccatgttggccaggctggtctcgaactcccgacctcagatgatccacctgtctcggcctcccaaagtgctgggattacaggcgtgagccactacacccagccttttttttttttttatggacgagttcctacctgggacttctggtacttgccttcctgagtcacatacttagtggggcagggaacaatagagtgagcattaactgtgtcaaaatgttatatttccctaaagttattaaaatgcaaagaataataatttactgttcagaatggtccaaggccatttcatacccaggctgctgtgggaagcagtaggttggtaagagccagcatggataagtttctcactttaatgcagcctttgaggcaaggtttgaaaatcgcttttcagactctggtcacagcaagcagtatcattactgtgtcttctagccagcaggcattggatcatcattaacaactatttcctacgtttttcctccatgctaggcttgggctggatacaggacattcagagctggcctgatggtctgtctaatgggaaagacggttcataattgactctggcggtttgtgttctcactaaaatctttttttttttttttgagacacagtctcactctgttgcccaggctggagtgcagtggtgcgatcttggctcactgcaacctctgcctcccgggtttgagagattctcctgcctcaggctcctgagtagctgggattacaggccaccacgcccagctaatttttgtattttttagtagagatgggtttcaccatttcactatgttggccaggctggtcttgaacttccaacctcagatgatctgcctgcctctccctcccaaagtgctgggattacaggcgtgaaccgctctgcccggccaatgctctcactaaaatctgacagtatggtgctcagtactgtgaggaaggaaaggaagagtcccagagagggaagggaaaacctgagggtatagagatttggcttttatcttgtgggtaatgcagagtcacgaaagggttttgatcaggtttggaaattagaaagatcatccccagtgcagaaaatgaatcacgggggaaagactggaggcaggaagaccaatgaggagatggctgcagatgtcaaggtgagacatggtggggcctgagctaaggcctgtcaagcaaggaagggagcacaggtgagaggccagacagctgaataagcaaaattgagccatgcgggggtgggaagaaggtggggttgagcatgaggttgaaaaatataaaccaaaacaggtttagcttgggcatctaggtggacagtggagctattcatattgatttggagcctgtggtgtggggatggggacaagaactctgaactgttgggtgattttttaagttttataaataaatagcatttttatttgttttatgaagttgcttgaaaaattgtatgaagggcagcgtggcagagggaaaatgcctagacttcagatcctacagatgtggacaattctggattagtcaaaggcagaatacgcatgtatatttaggacacctaacaaagaatgagaaatatatacatttaaaaatagtaatgttatattcctttttttttttttttttgagacagagtctcgctctgtcacccaggctggagtgcagtggctcgatcttggctcactgcaagctgcaagctccgcctcccattctcctgcctcagcctcccgagtagctgggactacaggctcccgctaccatgcctggctaattttttgtatttttttttagtggagatggggtttcaccgtgttagccaggatggtctcgatctcctgacctcgtgatctgcctgcctcagcctcccaaagtgctgggattacaggcgtgagccaccgctcttggcctacatttcttttaaagcatcaagtaatcactttgtggggggaatgaagacttttttgggttctttatgttcattttgcagtttagatctcttttattgtgaattctatattagggttggtgggggcggggtgtaccagactattttcagttcttaggtctaaaggtcttagcctgggttctgacctgagttttgctttttattggctgtgtgaccttagacaagttactctaccctcttttcggattttgtcacctctcaggtggggataacaatgtcttctagtagggttgttaggaggagtaaatagtaactcttatcgtagaatgataaatgctgatttaaaaagacttttgtggaatgaaatcttacaattagataattgtcttttttctgagtggtattgttaccttgtgagggagtctagcttttaaaacagcctgcctttgctgccattctttgaatatccagggagctgacggtgaggctctccaggggtactgatggcacaaaacagctgcacggggcatgcctggggcaggggaaaagtagggggctgcccctactttttcccttctccactgcctgagcacagagtcactgagaagacttgcacctgctgggggcccagagtggaaactattcccagctggtgcccctccccaggcttgaggaatggtgattgtattacagtttataaatcaggcctccccactgtctaaaggggaaaggccaaaattctttgcccaatgtgtctccccactcccatgagatgatccctgcctccatatttagccccatcttattcctaactcaggcatctttgcatcagggaactgcttgtggtctctgcaccacctgccccacccccaaaatatccctatctctctctctctctctctctctctctctcacacacacacacagagaaattaagtggtgatggatgcgttcattaatttgactatagtaatcagtacacaatgtatatcaaatcatcacactgtataccttgaatatatacactttttgtttatccattaaatattttaaaagaaaaagtaacaacaaaatacccaggctgtttcttacagccaagcttttgctgatgtctgggtccaccaagacctacggaatgaaaatctggattttaaataagaaaaccacgggaaattcttattcatactaaaatgggcagcccactcaagtggtgtaaagccgcagctccttagcttgtcactacaacccctctgcagtctggtctccacaccttcagctctttacaattcctaatagtcctttaaaacttagcccacatgtcacctcctccaggaagtcatcctggaccctcaagttccgtggtcttctgatagtccttgtgcttctctcagttctttctttccttttttaaaatttagtgggtttttttgtttttgttttttttttgagacagagtctcactctgttgcccaggctagagtgcaatggcatgatctcggctcactgcaacctctgcctctcaagttcaagcgattctcctgcctcagccccccaagtaggtgggattacaggcacctggcatcctgcctaatttttgtatttttagtagagatgggcttttgccatgttggcctgttggccaggctggtctcgaactcctggcctcaagtgatccatctgccttggccccccaaagtgctgggattacaggcgtgagccacttcgtccaggcttaatttgattttttaaaaacagagacaagttctcactatgttgcccaggttggtctcaaacttctgaactcaagcgatccacctgcctcagcctcccaaaatgatggcactactatgcccagcctgtctctgtccttttcacatggtttgggacaggctgttaagtgcctgtcccaatagattatgtcctaatagattatgtctcatttctattccctgtgcctagctcaggatctggtacagatgagatacataataaatctttattgaaggaaagggaagggaagggaaactctcagagacaaatgctatcttccagtagatcaactgagcattgaaaaggtagcgttttggaaaagaatctggatttaaataatttctctgcaaatgtgttatgtttcctctatgagcctcattttcctcatctctagagtaaggataatgtttacttttcagggttagtgtaagggttaaagggtttaatgagataaagtaagtgcagtgcctggctcgatgcctggcacattctaaattgtgtaatagctcactggagggctatctttcggaagcagaactaggcttgttctgtacagctccagagagcagaactaggcccaatggatggaagctgctaggagacagaactcagttcatcgacatctgagtggaagaaagcattttctacttggcagaatgagaagctctgggaggaggtgaacttcctattacagggatatgcaagaagagaggagatgctcgcctgtcagggctgatgcagaggggactaactctatatgagatttgggtggagtgagtatgcaaaacctgaaagatgggagccagataaggcatttccattcagtgccctccataattcattattcatatggtcaacactgagggcttcctctaggctgggtggccctaggttgggcgctggggatgcagggctggatttgacagagtctttatcatttaggaaattacagtctaaattttgatcatttattgagcaactactttgtaccagatgctctaatcatctcaggaaactttcattctcactgtttttcaaataaactgaggctcagccaaagtggcttacagaaagactcacagaccaatgagtattgcagccgggattagaacttagtcctgcttgtctcctaaaccctcttcatatgactcaaggctgcctcacatcctgatgttggaaacactttgcagtctcagggagaccctcaaacagcacccgaggaccttttgggtaccaagtagatgctgatgaacaggagct

SEQ ID NO: 749 - DNA, 1614 bp, Homo sapiens
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagcctttttaactgtccctgtgaatgaacaattttgagtg

SEQ ID NO: 750 - protein, 231 aa, Homo sapiens
MAGMVDFQDEEQVKSFLENMEVECNYHCYHEKDPDGCYRLVDYLEGIRKNFDEAAKVLKFNCEENQHSDSCYKLGAYYVTGKGGLTQDLKAAARCFLMACEKPGKKSIAACHNVGLLAHDGQVNEDGQPDLGKARDYYTRACDGGYTSSCFNLSAMFLQGAPGFPKDMDLACKYSMKACDLGHIWACANASRMYKLGDGVDKDEAKAEVLKNRAQQLHKEQQKGVQPLTFG

SEQ ID NO: 751 - DNA, 113575 bp, Mus musculus
  misc_feature (1)...(113575): n = A,T,C or G
ctcacctttacagagtgactttagtggcctgagacctgtacgatcatcctcataggtgtcctgtctgtcttcctgggacattttcgttcatattactaagaaacaacctcagccaccaaaccaagacaaaaggaaaccagggacttctaaggcccagtgcagcgtaggttacaggcaggcattcagctgtttcctgtcctccctgtggctctctggcctggagctggtcctgaagctgctacaagggacaagaatcagttatgcttcacactggagaattggaaactggacaggggacagcttttttccaccctccatgaccagaacaccaaacaaatttggcacatcttttattttttatatgctattaacaagtgattgatgaactataaactcatggttttgttttgagatagtctcgtggagttcatgctggcctctgcatcactgtataccaaggatggcccctcctctggcttttaccttctgagttctgggtttacaggtgtacgtcaccatatcctgttaatgtagtactgggggtggaatccagggctttgtgcatgctaggcaagtgctcttcccatgaagccacacccccaacactcagctgtaaacactttgaagagtgaaagttacaaggtggatgcctgtatctgtgccagctgcttcagcaggctctcattttagggccttcccttttggtcccgcccacccaaacccttggctgaactgactggcatgttgagaactccccaaactgacccagggaatccttcttgatgtgtacacacaaaggtgtgtggcctcatcctacccattcctccccacctcctaccccccaccccaagcccggacatgattggggtggtcctggcacgctgggtatctagacagcttttcatcggttgctcatcagcatgctaattgtcatataactaattatgccctgaattccagttgattttcttaatgagacagctgggttaattatgtaatcgtatgattacattagcccagagtgtcccggcaaagagtagtgttggcttgcatgtgatgtcatccctgggatggtgctcacaaggaacacattcatcctggagctagtggcaggggacagccctgtgttgcctgcaaagctctgtgcaaacatgggcccagggtttactaagatggggtttctaagccctcacaatatggagtgggtccatttgccacaagccctactgccatccccaagtcatccctgacataaatggtcctagccaggtctgaagctggcttgccatcctatagcttcggtgcagcccagcagtgtgccttcagtaactctgcgacctctatttgacactgcttccctttattgggcatgccagctgcctggatagtggacagagacatccaaataaatgtttatattaaagtgctgctagagggccaagtgagagtctgtaagtggccccagactggcccaaatattttcttcttttgtgctctatccccacagaagcagactttcctgagaggggactacacctgttgagtcaccactctatctggtcacactctcctcctggcttcttcctctgccaggactttctcctcagcttccttgtcagtgtagacacgttgtcctaggtgacttctgaaacttctcaggagcataagaccacacacacacacacatacacacacacacacgccccaactaccctccaagacagtaagtggtgtcaccataatgaatacgcattggtctccatgcaggtgtcatcagagatttctgttctgttctcattcttaataattgcacctccagaagctggcctacatttaagcccctcttaccacacctgccactacctcactcatccacattcccataattccttgctccctgggctcacccttcctactgcatactactagtcactcttggcccagtagccaaatccatcaatccagagcactcgccagacatctttatgtatattcaggctagcctcagacccgctttatagctgaggatgaccttaactttccgatcttcctgctacctcctgagtacaggtgtgtggcgccaagcctgttttatgtggaactagggctcaaactcagaacctcatgtgtgccatgcaagtactctgccaactgagatattgccatttatctcaagaaaaaaattgggattcacagccccaagatattcttattttaagtatattatatgcatagacaattatagtagtgtattttgaaaaacctctatatatcacattctaaaaataagaagctacagcaaggcatagtagttcataactacaattccagttctttggaggcaaagtgagttcaagtacagcctgggcaacctgatgagaccctgtgtcaaaatggaaagtaaagagaatctgaggccgtagctccgcggcggtgtgcttgcctagcatgatttaatccccagtgccacaacacacaaggcagtggtgcaaagcaaagggaattaaaatactttattaaaacattcaaaagttgttcttgaaaattacttaagtgtatagacatatatatagtttactactggtgttaggcattgacctcggggccttgcacacacaaggtgctagccctgagctctatcccattgcactgaagttccatttgagtgtgtgtacataggtacatatgtgtgtgcatacagagatcagagatcaaccctggctgttattcctcaggtgatgcccaccttgggattttgttagtggtggtggtcttgcttgcttgcttgcttgcttgcttgcttgctgtttaaggcagtctctcactgacagctaaggcttgccaattaggctagagtagctggccagcaagccccagagacttaaaagcctcctgtctctaggcttagaagtgcccaccacctgccccccccccaacacacacacacaccagcttttttacatgtgttttggtgattaaatgcaggtccttatgcatacaaggcaagttcggtagtagagtacttagctaacatgtgcaaagcccagggcttactccccaccactacctgacatagggttcaatcccagcactactgaatgagcaaatacaattgaaagaaaaaaaaaagagcaaacaaaattggctggatcaattcattaacagtttactaaagatttttgtctttaaatttgtaaggagtatagaatacagacttttgtgtttattaaccagaagacaaggctctaagctcacgtcatgagctgggaagtgttcccccttcaaagccactattatatctttttttacattcctgtagttaaactctgaagacatttaggcctgggactttctttcttttaccttttataaacttggtcctttttacacatacccttaccctctcttagctcctctcaattttcctcccttcctcccaccaagttcccctcattttcaacttttttttttttctggttctgtaacccactgagtttaattaaggttgcttacatgcctatgagtggagacatactggaactttgggcaaatgacaagcagttacaccactgaagaaaactgctcctccaatcccttggcaaccattaatactaataaatagctcctgtggtggagtgatgataatgggcctggtattgctggttctcatttcaaattgaacttcattaacagatatagtactgggctggagagatggctcagcggttgagagcacctattgctcttccagaggtcctgagttcaattcccagcagccacatggtggctcacagccatctgtaatgggatttggtgccctcttctggtggagcacagttacagagcacacataaatacaataaacaaatctttaaaaaaaagatatagtactataaacagtttttaattcctttctgagtcagattgaatcatctccaattgtatttttgcttttgtttatatatgtatatgcacaggggagtgtatgtaggtcagaggtcaatctagtgtattattcatccggagctatctttttttttttttttttttttttttttaaggcagagtctttcactgggacttgggactctccaagtaggctaaggtgactagccagcaagccccaggtctgcttgtgtctccactgggtacctgtcctggcattttaggtggattctgggaatcagaactcagctactcctgctggcatgctaggtgctttacccactgagttatctttttgggctgaaatattttttagacattttgtcaccgtatcaactagtctgacctggaacttaaatagatctgcctctcttctgtgtcttccagactcctggaattacaggcatgcaccaccatacctggctttgggcatgatgttaatcatagtatatatcatctttttttttttttaagatagaatctcactatatagccttgagtgacctagaactcaatatatgaactaggttagcctcaaactcatttacagagatccacctgtttccacctttgccatgttgtgccaattgtggtagtgcatccctctaatcccagcagtccaagaggcgcaagcaggcagatctctatgattttgaggtcagcctggattgcatacagatttccatgccatctagcactatgtaatgagaccctgtctcaaaaaagaaaaagaaaaagaaaagaaaagaaaagaaacagaattaaaggatgtgtagtcatatccattctggcatttcctgatcttgggatttgtaaattctatgtttttttctagatcagactggctaggagctaatcaatttcaatgatttttttttttttttccttaagaacctgcttttgtttgcattgatttttttttttctctttgccttttcagttttattgctccccaatctcctttgctcacttctgcttactttgcgtttgatttgctccttttttatgttcttaagaggtccagtgcatgttttactccattgtggccagagaatgtgcttcggatgatatttgttcttttgaatttatcaagacttgtttgcacctctgcttgctgttagatattccccatgcatactaaaggaacacttgtgcagctgtgtggggccaccgaggtggttggttggtagtgttcttcaggcttttgcatccatactgacattttgctaggttttttggtagaagagcatctgcctcaaatctctgcagtgaggggctggggccatggctctgtggtagagcccctgcctagaatcccccagtgagggctgggggtgtggctcagtagtagagcccctgcctagaatcccccagtgaggggctgggggcgtggctcagtggccttgcattctcatgactgagtttcttccccagcaccataggaagaaatgattttacatctctgtgattaacagatgtgaatggagttttgaaatttgtacctattatgatggacgggtcttttctcctgtcctttcagtttttggttagtatattggggtatttaccttggcaagcctttcagagcaaggtgttagtcttgcttatcaagtattcctttagcatcataaaattaacattatcagttattcttagtggtgatagatggttctgatcctgcctggcactgtactcctgattgtccctgtgtcactattaaggcaactactcaagtatctctgtctcctcttactgaaaaaaaattttttttcctctttgcccatttatatgggatctattctccactcatgtgatctttaatgtggctgttttttgctttcccattgatatttgatgttacctgggctacctctctagggaagctggctcctgttgacttggctcagtgtcccttgcagtgcccaaccctggcctttcccagatcatgtagccacttaggaaacccttgttaaattagtgcatgaagagacagtataattgaggtagctgctgtctcaggaagtagcattcataattagcattttgcatacctgttggcctggccagctttccttcccatccctgtccctgggggagatgccagcgcctgacacatctcagcatgccttcccccagcttctgcagggatgactagaattaatgagctaatgttacctcgcttagcaaaatgtgctgaataaatccaggtgatagggttgtttgttatataattatgctgtttaaggtcctgagttgcataatgaactgcacactacctccaagcctgcttcaggaattaacttatcagatgatcgtaaaatgttttttgagtttgtcatggtgggtggatgtggatagtggcaaagcatgttgggttggaggctgggcaggtggcttacagaactccgcatgctattctgtctatgggtgttttctgtctcctccctcagacaattctgtaattgaactgctgagttgagaggcttctgacgtacagcctgatacctaacaatgcttgtatggagtttaaatggcattggaaatcgttaacgagacagaaagctatgatttccccagcttaacatgcaggtccgggtttggcgtgctgaagttcattgttttggtctccagctcaaacatgctaggactattataccatcatgtggtaattagccgttcctttaatacacataataaaaattaagcctaagagctactttaccaatggcttttacatatcccaaaacaatattccaatgctgtaggcctttagtcatacaatgtaccatcgtaaagttgagtctaatgcaccaaactatttgaacattcagttccttttctattctgtggccagttttgctactttgacattaactttagtactgttaaattaaatatagatgctataatgaataattacaagagttccagaacttccatttacagtggggcgtgctgagaatttgtcttaaggcgtagttggttactatttgctcatagcatgtgtgttctcttcatatgttactggattcctgctgaatggcaagatggaagctattttttcatcagaagcagacacactgggtcctggcctttaaatagggatggcctggaggggcctggggagatggcccagccagttacgtgtttggcaagcatgagaatccacattccatctccagtacccatgtaaaaagctcctgtgagttcctaacccctggagctggggaggtaaaactggtggattcctggcctagccaggcagcctagcctactgagtgagttccaggccaaatgaaagacactgtctcagcaaggtggagaaagattgtggaagacacccatcatcaacacctttccacacacacacacacacatgcatgtgtacagaatgcaaccttagctcctgaaaagtcaaattggcgctggcagctcctagactgttctgcgagcatagctccttctcctccttatccctgacctggatcaagctcagattgtccttctgtataaaggatgttgtgggcatagtgctcatttctctcaatccatttccctagcctgaagacatggagggcagagagagattcaggtttcctgggaagacagtgcaattaaaagggggaaaaaagtacctgggatgttctgagaatttcatttttcttgttattgccactcctgcttggaagaactatgttcccaaaatagctctagcaatctagcataacataaatattttaatgctgattaaaataataatgaaaagtcatgaatgagaaagggactgtgtatagaggccgcataagtgcccaccaagcctgagagtcacatgatggacagtgttggtgttaagccccagtgctgggctccctcagggctgcagactctagctccacacgtcctggtgacgcatggagtgaatgctgtgaacacactgacatcccagagaattccaggccagcccttgcttccaggaaccagaggtggtctgaaaaattaatgactctggcatggaaagttaagtgagttcttgaatatataccctcactgatctgccatgtgtgatgtttagcattccttgagaggagactaaatctccacagccatccctaggcgaggctggcgcccctgccacaaatagattcagtaatctttctaagccctgtgacttggatattcttctattctcagaattccaaagggtgtgttcccctggggcccagcaggtgggttataattacctcctaaagagaaggaaaaaggaagatcatattgactgagagcatttactgccggcctgcctgcctgcctgcctgtctgtctgtctgtctgtctaccttctactgagaattcttgggaaagccagaggccaaaacccagtcctataaattgcctgtgtgttttttccaactgtagactaaaatctaaccctgagtaaatctgatggcagacatcatttctttgggggaggagggccagtctgtgtaagtataaaggaacatagatgtggaagccagagtcagcttcatgtattgttcctcgggagccatcaactctgtcttttgagagagcatctctcactggcctagaactcacaaactgcaaggctagctggcactgagctagagaattccacctgtctccactgcactactgggattaccaatgcccacacttggctgcttatgtgggtgctggggactcagaaccatctcccagccccaaaatcattttctttgtccacaaggcctcccaagacttgtccagatgttcttttgctctctgtattctaatggggaacttggtgcctttcctagctggctggccacaggcctgctatgggggtgatactgtgcttttataggtgcccctacttcttagaactagcagctagcttcatgcctctgattgttcttagcacccagcattagtaaaggaccatcatgctacagatagagttggggatagaccttccacagacttcaacaagcacaaagcgctgatgcacacggctctggatttaatacacaacagcacatgatctaaatgtggtgttacctctagtcctagcacctgagaaatgaaggcaggcggatcagaaattcaaggccagcatggtttacatgagcctctgcctcaaaaagtaaagtaaaataaagaaaagacaagggcatggacttacagagccctagggcactttcctttctccaagagtttccatgtatatatagaatggtgatcacctggagtcagcaggcttagttcagctttctaccagtcaaccaggtaaacccaggctagctcttccttctcccttaactttagtgcctcttctgtagttagtgccattgtgagacttctaagaaagtgctgtccatacaagtgttctgtggcctgagcaactcactcagttccaggtcctggacttcctggactcatttaatgtagatgcaccttttcatggaccagaatcccccagagaagtctctgtaaataagataggctgctctgaggcctccttccttccactcagtacgcctgtgttgctatttctgaccagtaaatgaaaatccttaaagaatcccaaccaccagagttggcaaatcccagtgagttctgttgtcattccatttccacacgttaaggatcttggactgagtggccagtggccatagaggctatgaaaggggaatctaggccctaagagaatctccaggagatgacttctgtatactggtctagaattgccagtaagggactggatgtggctcagaggtacaacacctacttggactcccctggttatgaactggggttgtggctcagcagaagagggcttgcctagaattcaccagtgaggggctaagagcatagcttgatggtagagtgtttcccagatgaggatctgggtgaatatgctgacctgtgttctcccattgtgtagatccggtaccagccctggacgtcgggcaacagctggaaataaaagtgcagcgtctacacgacattgaaacagagaaccagaaacttagggaaacactagaagagtacaacaaggagtttgctgaagtgaaaaatcaaggttagtggcaaatggctggcctgcctagctgtgctttctgcccgctccccacccccctttgccttctttatagtgttgggactggctgtaattgttaccctcctcatgaagccagggtggggcaagcagccgaatctcttaaacaaagataatgacactgcctagctttgccacagctaaacttttcctcccgcgataactacataggattttattgcccttggtctgggccgaatcgggattctttgaaaatttctcctgtatcatcttgtgataggatctgtcttttcaaagactgatgtgtcgcctctgggcgacacctgtcagacagccagctcctgatcaaagggtcacacacagtaagtcatttagtaattgctactgatccattaaggctccagacaagactcattcttgcaagccatgtgcttacacaccattcctcccttattgacctcatctactcattatgaattgagagagagagagaggagagagtgagaactcgagcaggactaccttgcatcacaaggcgtggaaggcaaaggcttttcctgccagggacaaacataaggaaatttgtcctatacttgaaagccatgtgtgttcaaaaccctcgaacctggcctggtgtaaacagcaatcctagctactccagaggccaaggtaggaggattcaaagttcaagacctgcctaggttacaggctgcattcaaggctactctgagcaatttggttagagcttgtttcacaaaataaaaagcagaaagagggctaaggatatataatagctcagcggttggacatctttcagtgagggactgggggagtggctcagtgcttgaatgtctgcccagccttgaatcatcaaggccttaggttcaagtctccattaataaaaaataaaaacaaactgcagaaagccccggagccttctggcttccttgtattgaagaaaaagcccaattcaacaacagtcacaaggtttataaagcaactcccaaattttctatgtgtccgtgtgtctatggttttgttctggagacacaggtgaggacttaggtaggagggaggggtatcggcctggccggctcctctgcacgccctgctggttagtgagctttcagaaaatgaatcaaaagctaaatgactaggattgtgaagaacagccttttcgcatttaagactgttggagacagactcgggaggggcactgtctgtgggaagatccaggaagaggctggaatgatgtaagaaaagctaggacagacaggcctggagtgtgagggtagaaggctccgtggctgccgtcaggtctatgatcatacactgactggagattggttccacggcaaatattttagtggtcagattctacttcggtctggttctgctaggccctgttgtccctatggcctttgggaccacagggacaaaactgcctcacttaaaagggagctgctgggcttatgaattgggatccttcaagacttttctctcccacagcaaccatcggcagcaataggacttgtttctttcagaattcccagtgcctgaatgacagctctgtgtgtgtgtgtgtgtgtgtgtgtgtgtgtgtgtgtgtgtgtgtgtgtctggttcattatacagacctaaagaaaatctcctagtacttttagctccagtgacatgccctttttgccccctctgggacaggggttttgtccagcccaggttgacttcaaagttgccatgtagctcaggttgacctcaaactcagtatatcatactcgctgtatataggcttggctaacctcagactcattctgtaactcaggctgccttcaaattcaaactcactatgtagttgagtctatcctcaaacttattacgtagttcagagtagcctccaattaataattctcttaccccagcctcctcacagaagctagcattacaggcatgtgccaccattctagtcctaatttgttctccgtgaatgttcatggaaacacacaacatacctgttgtctgacagatggcactatggaatactagggcttcaagtcctgtatagcctgccagtttctgcttttccattctctatcttaactgtgccagatactgggaatgaaaaaaaaaaaaaaaccctcaagtaggaggccttgtaagagatggctccactgtttgtggaggcattataatgcacagagtcccgcaagggtgactattagaatagagggctgagtggcaagatcctgtcctaggatcacactgagttgggaccctgcaccattcccttttttgtttttttttgtttttttgtttttttttttttgcttggatgtgttcagctcaagcaactaaagggacggctattagtgtgccatgggtgggaaatcacttctgggagcggcatggaccctgcttatacactccagctagacagctagacctgcaggtggcccctcctcaggcactctttcccacaggtaaagagccccaggcccctcccacaccccacagtatcagatctacatatggagccctcatccactaaagcaggtggtcaggacagagtgtgcaccagcacctaaactcgacggtcgtttcccctgggtcagcaagtgtccctcggccacagcccttttccgctccctaagaaacaaagctgccttggtggctgatgaggtctgtatctgacttgacttccaaaacgtttgcaccctttccatgtagtagagttatcagtctgccctctgtagagaaccaacttaagatgcatcagaaagacaatattacattttaccattgattttcccccttttctaagtgtgctggagggaccaccacaatccttcctggcaaaacccattgatcctccccaacttgaatactacaagttcaatttcacattgagggagtaaaaggtccccaaagggactcataaccattgattttgtgtcggcctggacaagctcaggtttaaaatacagcgatcccggcaggttacgaaagcatggttcacccagctacaaggaaccgcttcccttactgttggtttttctgtctttcattctgcagaggttacgataaaagcacttaaggagaaaatccgagaatacgagcagaccctgaagagtcaggccgagaccattgctctggagaaagagcagaagctacaaaatgattttgcagagaaggagaggtaagtatagcctccccgtgccatcacgctcccagcgcggggaaacactgaccgccaaccctgtcgtcacatgatagtttgaaaaactgtacatgtgaaatcagcccagtcttgttgacaaagaccccaagtgctcctactgtaaagttttacttacagggctcagatacagctcagcgtagagcaactgtcaataccgtccccgagagtgaggcgtgggggtccttaacactgccagaaaaatgtgttcaaaaatgacagtgatccttgtcccttccttgtacagtaccctgagtgcagcatgtccctgttctcctggtgtcaggggtgaggtgacaggcagccagaggcttctgtgcgttgaacacatgctgacaaatggcagctgtacttgagctgaggcagcaatgggcaggtcccccaagatgcaccgctgctgaaaagcctggaactccatttatggttactgaatttgatgtttatgtgtcacataaaaagtaaatattgaaaaagttaggcatgcccagggctgaggtaactcaggatgcatgttcgcatgtgcagggtgtggtttgcatcccagcaccaaaagtaacaaagagttcaggctttttacagcactctaagcatggcactttcacccagtgccatctgcatagatattccagaagtcaagatatctaaatgtcgggcacagttgtggtctgggtgcttggggtgagggaccctccatctcatcagtaaaacgcaccgaagctgcgcccgctgagcgccagttacggctttctaatggcttactttattccagactttctccataaaggagtagttttccactaatagagcaatttaatgaaaatcagatttcttgtaaaagctgtggggactcctaagcttgctacttctaactatgttggtcagatttttaaaaactctttagttaaattaagatgttaaattttagcactagcatgaggaaatacacatacattttaacaggaggcacttacaagatttatagtttcaaggaaggggttaggtttgctcataagggtgttcgtgtgcatgtgtgtgtgtgtgtgtgtgtgtgtgtgtgtgtgtgtgtgtgtgtgtgtgtgtaggccaaaggtcagtgtgaggtgtggtgtgttcctctatcactctccaccttattctttgagacagggtctcttactaaacctagagctttccagttcagctaaaccaattggtcaggtcctccgcttgggtgacaacttactcacttagccatctcccagtcctggcgtggggttttgttgtactattggccattgatttcatagatcatcagagttctaagggtggcttcaaaaagatgccaggagccaggtacactggcacacacttaggatcccagtattcctgagtctccattccttttatgaatcatgagttccatttatgtttttgttttgaggcaaggtctcactatataaccttggctagtctggaactcgatatataaaccagaatggcctaaaactcaaagaaatctgcctgccagcaagtactagaattaaaggcatacaccatcacacctaggagatcatgagttctaatccagcataggatatagagcaagacctttcctacaaaagataaacaaacaaaaataaaagatgccaaagctaaggtaaggctccctcatacatgttatacttaattgcatgatgcccagttcagtctctaccatcagtattaaaaacaaacaacaacaacaagtctacctacttttttattgctataataaaatattatacccaaaaaaagcttgagaaaaagtttcttttgtcttttaggtcacaattcatcattgtgtgatgtcagggcaaaaacctggtgcagaaacaatagaggagcactacttccttatccatcctgtatggtgcaacccagagtgcactgggctctctcgcatcaattaataattaaggcactccccacccctaacatgcctgccagccaatctgatctaggcaatttctcaatcaagactctcctctcagatgactctaggctgtgtcaagttgacaattacatctaactaggacgcctcctgtgtctcacaaaagctccagggatgctgtgctgctgacttcattggctcagtttagaaagaggaaaagctaggtgttctgctgatgatgcctttaatcccaggccccgggaagcagagccattcagatcttagacctctgtgagtttggggccagcttggtctatgtggccagttccagatcagtgagagctatacatagatcccagttcaaacaaaaacgagtaaaaataaactaataaatatgaggaaaatagggtcaggcatggtggcacatgctctcaggaggcaggagtaggcagatttatgtgagtttgaggccagcctagtctacataatgagttccagaccagccaggactacatagtgagaccctgtctcgaagaacaaaatccggaaaatgaatgaatgtacttgctgcacaaacctggtgagctgagtttggtcagcagaactctcatgaaatggaaagagaaccacttccacagatttgtcctctgacttccccaaatgcaaaacacacacacacaaataattaaaatcatttttttaaagaaggaaaatggctagtatgatgatgtacacttataatcctagcaatgtggaggtggaaacagaatcactcataacatggaagctgacctgggctatatataacatgatttccaagtgtggtctcaaaaagggatacgaaaagcaagcagtttcttgctgtgttgctggttgtggcagaaaaatacatcagtctaacctcccaccatgaaaactggatacagagatataggccatgtataaccataactctttctgttcgtggaaattatgatttagtaaattcacaacagcctggccaaacaatcactatgataagagtgaaaactggaatgtgaagttcaatacatgtgttggcagaatgttccagattctatcccagcacaggggaggtacaagatcaggaatttagctccatagcaagtttgaggcagcctgggctacatgagacccagtctcaaaaaaaaaaaaaaaaaaaaaagagactgggtgtggcccacgcctttaattgcagcactcgggagtgagagacagatcccaatgaggtcaaggaaaaccttgtctacataatgagttccaggatacatagtgagacctgaggggcgtttggggagagagacagaacttgagaacttcttgtctgggctatggtggtgcacactttaatcccagcactcagaaggcagaggcaggtggatctctaaattggaacagattgagttccagaacaaccaggactacacaaagaaaccttgtctcaaacaacaatgacaaaaacccaaaacctgatttaaagactgagatatctcagtctatccatgggctatacaagtgtaaggaacagtattgggacctccagagcagtgctgcaagcttagcagcgatttagaatcctgggatagattagccagaattggtgagctctggtttcagttagagactttacctcaataaataaggtggagagtgaccaaaggagatacccaacccaactttaacttttggccttcacacacacaccaatttaaaaaaaaaaaaaaaaaaaactaagctggaatttgaataataatcaattcttctatactgaaagaaaagtttgatagaaaaatctttctagttgtatctgaaaaattatgtcaacatgaccatccaaattttaaaacaaaaattttttaaaaccagtaataataatgtttttaaaatatcaacaaacagggggatgactgactgctcttccagaggtcctgagttcaatttccagcaatcacatggtagctcacaaccatctgtaatgggatccgatgtaatgggattctggtgtgtctggagacagcaatagtgtactcatataaatgaaataaaaaatcttttaaaaaaacaaagatatcaacaaatgaaaaaaattatacatatacgataaaattgtgtgatttttttttttatttttaataatgtgtacctttctgcgtgtgaattggcacacacgagtacacgggctgaagagtccagaatgctgtgctagagcccctgaagctggagttacatgccgtgaagctgcccggtaggggcgttagggaccaaactcaggtcctctggaagagcaatctgtgctctttatcactgagtcattttccatgcccaaatatatataattttttctttcatttgtgtgggtgcctgtatgagcttatgtgtaccatatgcatgcctgtgggtgtcagaagagggcatcagatcccttggaattagagttatacacagttatgagctggttactgtgagtgctgggaaccaaacccaggtctttttaagagtagcaagtgcccttagccaccaacccaagctcttatccctaagggttaatcatctatatacgcacaaagcttttacaaattaattaaaaggaaagatcagttttacttgccaggcatggtagtgcatgccaatagtcccatcacttaggacgtgtgggcagcaagatgtgtaattcgtgaccagccttggctacgtgagaccctgtcccaacaaacaaacaaacaaacaaatagcaaaacctctgaaagttgacagattccaaaaattgagcatgcaaagaaacagcaataaatattgaatttgattttatccagtgctggcagggtttacacaaacacatactggcaggagtttaaattagaggatttttaattgggaaggttcctaatatctagctctctcccccacacccacacacaaaaattgcatatagcttgtgaccacggaatttggtctgttagcagggcttcatggcccgtgacccgtcacatctgtgacagaggcagaaggatctacagttggaagctagccttggctacagggaacccttgtctcaaccctcccctccacaaaagggaagaaaagaaattattttgcatcatagcatgttatatttaatttatacatactgttacatgttatgttactttgcactgttaacattactgtatacatgtatggtacatattgcttgatagcacaatatttgtcagtctggtgtgtattacattatttgcctgccttgtgtggcacatagtaggtccctgtgccttgtagtcacttaggtcactatgtgcattgcagaacagtacagaggagcgctgagaagtggagaaagtaaaaggactgtctttctttcctctcttaagtttggttttaaaaaccatggggagccacctttaatcccagcacttgagaagcacaggcacgtgagtgagttaacatagggagtttcaggacagcagggctatttaaagagactctgtctcaaaaacaaaacaaacaaaacaaaacaaacaaaaaaacttttggggactaaagaggtggctcggttggtaacatgtttgctatacaagctggattgcccctgtaaaaaagagctacacatctataattccagacctggggcgtggaaacaggtggattagttgctaagacactctcccgcaccaatctagccaaatcagtgagctcagggtccagtgagggatgctgtctcaaaaaaatcagggaagagacaattgaggaacacatagatagatattggcctccagtttctactccagtgcacctgtacctcacgcacatgcgcacacagacacccactgtaatactacatctaaagtggggctttcttaaaatttgttgttcattttaattatgcatatgaatgtgtttgtgtgggtatgccacgtgtgcacaggggtacctgtggaggccagcagagggttctgaatacctgaagctttttgcacctgatgtaggtactagaaaatgaactctggtcctctgcaacagcaagcagtgctcttgacccctgagccatctctccagccccagcacacatcccattttataacagacaggcaggaaaatattagcaaagtttttctataggtgacagaaagttggctgttattatttttaagctgtcatttttccctttttgtacccccaggtttattgggttgagcatatgttatattcatataatataaaatgatgaacttaattttagattcctgttttttctgcagacacagaggaaagcatgtcatttcttggctgggaactacatttagagaccatggggatagtaaactgcttgcagatattcaggtcctccctcccccacccaccgtagtagcatttgcgttccactttagaggaaaggacagctgtcacatctgtttaggacatcctttatgccaacagattccttttctgtgtcagcagaatgtaaatgtatcattcttctccccaacctcagaaaacaatgagcgtatgatgatgctggttcatttctttttaatatccaccatctcggaacaagtcccatacaggaggaccttccacaccaattgccacacatgtcagaccccagggggttcacattccacgtcgtttaatctgcattcacaacattgaggtgcagagagtcaagctgcactgtaaggctgcctccagctgggccttccggagaacagaagcatgttcatcagtggggctcgggcacacagcctatctcagtagtcaaaacatgatgaccaatttggattcattgtctccttttttttttttaattctttccagaaagctgcaagagacacagatgtccaccacctcaaaactggaggaagctgagcacaaactccagactctgcaaacaggtttgatgttcgccaccctatttgaagccacatgggaagtgggtgaacacgggtggtctcgtggccagcccctctactacctgttgctactagggatcctgcagttaggagccttgagcccacacaattgaagcttgtgtcccaggctgctctacctggctgcattagtcactgcactgattgctaaatgtagatgtgggtggctctcctgccttctccctccctgccccagctatccttcctgttctttccaacaaacacttctaaatcaccaactgtcaagagctaacaactcatttggaacaataatggaggtggggagacttagttctacccaaaatgaagttcagaacggcagtaacagaacctttaaattctaaaagataccaaaaaaggttataccaaagtttgcctttctttttttgtttccttttctgaaaaggaagcagcacagtatctttaaatgtgggaagaaaaaggagacgacatcatgatccaacttagaacacaaatgttagagggacaaaaaatagtcacaggcagtttaacagtcaaatgagtaaatgtccaaaactgcaaccaccaagctatgtagctcagccatgaggcgtctgcctagagtcccccagggaggggctggggcgtggctcagtgggagggcacctgcctagcatgggcaaaaccttttatcctgtcttcacattacatattcatgtgtgtatacccatatgtctacacactgctcactatataaatatagaacttaaaaattccagaaaatgaagaagcagtccagtagaagagtaaaggaagctggagagatggctcagtggttaagagcaccgactgctcttcaaaaggtcctgagttcaaatcccagcaaccacatggtggctccaaccacccgtaataagatctgaagacagctacagtatacttacatataataaataaataaaatctctaaaaaaaaaaaaaaaaaaagaataaaggaaggagcaggcagcttgcagacgcaatgtacgtcatataggggaagtgctaatggtttttaacagtcagacatttgcagataaactatcagtaaaagatggttttgcctatcactgtcagctctttaaaaacagggcatgccactcattgctgagagtctaggaacatgatcacaggcactatgcacatgaatgggaatgcctctcaaggctggctgggtggtgcgtagggacaggcatgttcagttctttatccagaagcttcccttctgagtatcttaaaagtgagttccaggacagccagggctatacagagaaaccctgtcttggaaaaaaaagaaaaagaaaaaaagaagaaagaaagaaaaaattcttatcatgacttggggatgaatggatagataagatttattctgagaaatctcatgagacagttttgccatggtgatgtgaacatgagaatgctgacaaggactggggctgaccagccactcaatgagaagtgatctcaccttgttacccaagtggccaggaacgcatcctcctgcttcagccttctcagtgccgagatgacagacatgcaccactctgcctggctcttcagttcagccagtaaatcaagttgacagtccatacatgaggggtttgctcctaccacagagcatactattttaaaataaacttttgggtttttggtgtgagtgtgtgtgtgtgtgtacatgagtacagatggctgcagaagcatccctaaccctaaccctaaccctttagagtggagttataggcagttgtgaattgctcagcacaagtactgggagccaaacttgggtcctctgcaagagcttaacctctgaaccatctctccagaccacagtaaacttttttctaatgagtgcaagaatttgtttgtttgttttgtttttccagacagggtttctatgtgtagccctggctgtcctggaactcactctgtagaccaggctggtctcgaactcagaaatccgcctgcctctgcctcccaagtgctgggattaaaggcattcaccaccatgcccagcttgagtgcaagaattttaaaataatgactgaaagtgttcttgtagctgaggaggtcactcagttccacagcatacacctataagggtctgaaagcagtctccagatcccatgtggaaagccatgcatggtggagcatgtttatcatcccagcccggtgagatggagacaggaggctccctggagctcacctgtctgccagcctgtcccatttggtgagttcctggctaatgggaaaccctgcttcaacaaaaaacaaggtggtcagcatctgaagaacacactcaagtttgtcttttggattctgcacacacagatgcgagcatatctgcacacaaccttttgaagtactatgtagaaatgcataaactagtagcagagttatttatagctgtggtcaattaccataggcttgcaagtcataaggcagccatattgcccccagggagtaggaatttttcagctccattgtaatcatatgagccctcccccatacacttggtctgtgattaatggagacatgaagtatgcaactgtatctgcaattgtatatagaaatggcttttgatggtaaaagacatttaaaagctggaagtctatgcagcaaaccatggacagtcattctctggagaaggaggcacttcagagagatgaggcagagactaagggacattttcttctccattctttgtgtgtttcccatctttgtggacttttctccttttactttgagcaattgctatcctgattgggtctgatagcacacacctgtaatcctattccggggaattgtacccagggagatcaagaattcacgccagcttgaggtacacgaaaccccatctttgaaaaagcaacctaaagagatggggatatagctcaatcagaagagcacttatccaacactcaaaaccccctggatctgagccctagcatctcacaaagcaggtgttgggggttggcacacacctgtaatctgagcactgagaggtagaggcagacaggtccgaagttcagtgtcatctttggctatctaatgagttcaaggctagcctggggtacatagaccctgtctttaaaaaacaaaaaacaagattggtgtcttatatcatggtttctgtccttgccttttagccctggaaaaaactcgaacagaattatttgacctgaaaaccaaatatgatgaagaaactactgcaaagtaagtgtctgtgtgaagtcatcctctggttttcttttttttggtttggtttggtttagtttgggtttttttttgtttgtttgtttgtttgtttgtttgtttttgcatttggtcaagatgaccctgttgctactaagccacagaagatggcttatgagatgctcaacctcctgtcatgctgccaagatacagtgtcagcacaataagtcccttgcatccatcctatccttcccactgaaaattctcttcctcattacagagaagtcctctctctctctctctctctctctctctctctctctctccacagtatacatggagaaatcagaggatacctttggggagtcagtccttggtgaggcagggtttctcttcttgtttctaacctgctgtatactctaggctagatggtctgtaaacctctaggtgatgcttctgtctccacctcttgtctcactatagaagtgcatggattacagatgtgaccacatctggctttttgttttatattattttattttatgggtttaagagttttcaatgtgcatgtacatatgagcatatgcatgtatgtgggtacgtgtgctcatgtgtgcacctgggtgtggaagtcagaggctgatgtcagatgttttcctcaatggttagtcaccctgatgttgagtcaggggctctcacttgaacccagaactcactgacacagccacttgctttggggatatcctgtctttgcctcctactgctgggctcaggcagcctactatgctggtccaggattcaggtggctactagggctccgaatcacagtcctcttccctgcatggcaagtgcttcacccactgagctacattcccagtcctcctctctgtgctgttttgagcaggggtttcactgtgctacttaggtttgtctcaaactcctgcattcaagcatctgcttctgaagtagctggggctgtagctgtactaccatacctggtgaggctatgggactagatgaatctgtctagatgtaaggggtctgtgaaagaaccaagccacatcagcctcttggaagacctgccatgattctgaaagttgtgcccacggatatagtgggctgatggaaagtttgaacttcagttagcctagactaaatttttatttctctgattagaaaggagtgagtagggctaggaagacagctcagacaggggagtgcttgcttgcaagcatgaagacgtgcataaaagctgggcttgctaactgggaaggtagagtcaggcacatatgtggcctccatactcatgtgcacatgcacagacaccacacaccagagagagagagagagagagagagagagagagagagagagagagagagagagagagagagaaagaacacaccagaggagagagactgggagtgtaggtcagttgagaaactgcttccctcatatccatggcacctggattcatctgtatcatcacagaaaaccaggaaagagggagcagaaggacttttgttatccctgactacagagggtgtctgagctacataatagcatagcctatctaaaaacaccaccagcaaaaacaagtgtgatgggcacattcctgtaaactgttttggggagctggagcaaaaggactgattgcaagttctagaccaatctaagctattaagcaagaccctctctcaagctaaatacaataactagctgcttcctctgcgttctcctcctctcagttttgaaaggactgtcacctcactctctgcttcagctgcaacttccttgtatgtttttggaacagacatatttttattcctatgctggggagaaatcagttctgggataatcttaaacatctctaagaacctctgtagaatgcttcaacatggctgacagagaccctgggaagagagtgggagacagagaagcatgtaggcttgggagaaaaggctgctgggagagcgagccctctgttccctatccacactgtgacctccagggcctctcttgtacagggggcataaggacagctgcattactgagaggctgtggagaggttggagtgagtgtggagaaccgtccctgcaagggctgggaacactcagcagaaccccgtgtacatttcctgaacagcgttggtctgaagttttgtcaatttataggatacacactgcttgtcagtcattcagaccgccgaccatccgcatttaaaaagaagccacacggactgggggatataactcagctgatagggtgcttgcccaggatccacaaggccctgagcttgatcttcaatactacaagaaacaggtgtggcggcacatgcctctaatcccagcacttgggcggtggaggctaggcagaggaggagctaaaggtcattttcagctgtatccttagaggccaatctgggctccccaagacccttgcaggggatgggggtacaggtcaaaggcaacaaggccacttggagccctccacccccatccctaactgctgcttttgcagtcatttcagctgtgcgtcagctgggactgcttggctggctgtgatagggacagtggcagtaaagttttccatgtgtaggcttgaagcaaaatgtaattagcctttatgcacagaacaaggccccattgatgagtacagctggtctttgtttggtcccatcactgagagtgggaggtaaagtgttcttcttcatgtttattaatgcaagattccgtagacaaatggcaagcacagtttaatatttgttggaacacaggggggcttgccaaacagttgttgtgtgagcggattgcaggccctcacattataaccattgctgggttaaataaatgcattatttctgcctttttttttttaatgtatctccttctcaaagggtcaccttgaagtttcattctccctgtgtcccatggcaaatgcacatgtagcaccttaaggaccttaaagtgacatcttaggaagtctgtcagcatgtattttactgttctcacggttccctggggctgtcttcagcaggcaatggccatcaccctgagaggggcctggtggctcacactgccacccacttctctccacctctgttgcatagttgcacgcttcttaaaaaccgtgtgtgtgtgtgtgtgtgtgtgtgtgtgtgtgtgtgtgtttgtacactatattgtggtgcacacataaaggtcagaggacaaccacttctctccttctaccatgtggagcccagggatggatctcaggtcaccaggcttggcagaaaagcacttttatccaccaagctttctacccagccctaggctttttatttccgttttccctccacagtggacccagggtggaggaggagggccacggaacactttgcagaccaccagggcagattcagtgcaaagcaagtttaaattgtgatgaaatgctctatcccttctagctaagccaccttagctagaagggtgtggcttggttgctggagtccttgcctacctagttcgcaagtgtgaaggaagccctggatttaatcactatcactcaggaggttaaggctgggagagatcacaggttaaaaacaaagtagtccgaactacaaagcaactttgaggccagcctgggctatgtaaagtcctatctcagaaaactaaaacaaaatcaatctcgtaagaaagatgattatagcataatagagtgtatgcccgatgtattcaaggcgctcggttcagggaaagaagagagagaagactgaatcctaaggcaaacataatctttctatatctaaggttactctaagttactcccaaactttcctaccagaaaatgtcgtatttcttaatacttctgcatgttgtattcttcacctctgcttgtctttaagaaaagacattatgtatgcaaatgctcccataatacattacaaaagcaacattgatgaagaaatgctgtgttgtttgtacagtttatgacaagcgtgtatcacaccctgcagcaggctctgaaaaagacaagacttcctgttagtagctgattgctcagagaactccaactctgatttgcaggcctggggacctctgtgctccagcagaggacaggaggcaggaattgaaagaggaagccagaggctcctggcataactgtcccatgggaagtatgagtggcatgctggtgaacagaggaggcagcagcctgtgtatagatgtgtctgaactattacatggtggattttcaaatgtcaccacacttgctgtttgtggcagtccttgagaaagcctgtactatgttaactgcatgaatgaggtgtggacaggcagcacccaagcaggctgctgcctcctcctctcagcttgaagtaaagtactgttgcatgcttagtgcccaaggagtccagtgcggagcatcaaatcctccgcagctagagacacagatgggtgtttgctgccatgtatctactgggaactgagcctgggtcctctgaagagtgaccgatactcttaactgctgagccatctctccagctgccacaccttttgtttgcttgcttgttggtttatcagtggtattttgagacaggtctcactgagtagccttggccagcctggaactcactgtgtaaaccgggtcttagactcgtgaagatccacctaactttgcctctgcctcctgaatgctgggattaaaaacataaacatacactgcacatccagcctttgccacgtgggaaggcacctcattctgtagctcagactggccctgaactttacgtagccaaggctggctgtgatactccttatacatatacctcagtaaatttgggaagaccaaagggaggtcctgaaacctcagcagcactctctccctgtcactttaagaaggtaattgttttccatctttctcatgagtcatcagtttccaatgtgagttgctgtaattatcttggttggattaatttccctaaaaacagagaagcaaattctgtctaatttttgaggatttgggcctgaataagagttcagtgggaacaatcttatttccagaggcgttagtgcacttggtagggttccatccttgcttcacatctaaaactcagtgttggagcgtcgccaggggctttcctgttccagtctcctgggggggggactagaaagaagaggctggctttgtgtgtccaaacgcagtagacacttgattattactctgtgcatgcgtgtgtgtgtgtgtttgaatacaagcctgtgcctttgtataaagatgcacatgtgtaggtacatatagaggttagaaaacaacctctctgtctttcctcaggtgaccaccacatacacacacacacacacacaccttttttttttttttttttcaaacaaagccctttaataccctggaactcaccaagggagctagactatctggactacagggcgagtctctgtctgcttcccagagctaggaattcaagtgcacaccactgggctcaaccttttcttatcataggttctgggtgttttacttggtcctcatattggaacagcaagatgtttaccaactgaagcatcttcccagcttgaactctgtctacattttgaaatttgaattagttgccttttaggtgctggtactatggggaccaaaagtttcatggtcaaactattccacagctgttaacaccttaataaacatgtcccttgaagtttactttggaagccaggctgtgaacacctttaatcttagcactccagagacagaggctaatgggactctgagttcaaggtcaacttggtctacataggaattccatgatggtgttacccctgtgcaggtagttgtataagaaagcaggctaagcaagccagtaagcagtattcctcagtggttcctgccttgaggtcctgccctgactacccttcagaatgtactataagctgtgaaatgaaataaatcctgtcctagccaagttgttcttggtcacagtaacagagaagcaaactaacatagtcagtaatcccacagtcactataatttagtgtagatatgccatatttgtgcaggccccatgtgttaaagtgtgaacaattcattcagtgtatgagccactcctagctcactgtgactgattctgtgggggcaggacgatgtgcagaagacccagtatttggtgtccaggtgagctccaaatgcaaatgtcttggagaattcaggtcttctgggctggttacattctttatttaaagagagatactggacacttagatacccaccaaggacaaaaagggtcctcattctaagatagcatgtaagaaactttgtaggcacatgcatgtgtatttgtgcatgcttgtggaggcagaggacactacctcagttgctcagaaatcatccacactggtttttgagacagggtctctcagaggtctggagctctgtcagcaagcccttggaatccaccgtctacatctcccccgcacttgagaaacttttaggaagcagaatgaaatgtttcctataggaaagccagtgtagagccagataattgagctcattgttttccttcacggcttgtttgccctttcattctcttcctaaggtgctagatgttgaggaatgtctccatttgccagaaagacagtggggtgtctcatatttccccgccagaccgccagttctgaagcgagcctgcagaatgaatttttaatgctgaatgttatggcatcgctcctgcaaccagccgcattgctctcctgagcctacagatttactgctcggatgagcagagtgaggacttgggggcactcaacacagtgaggattaaccccctaataaccacactggtgccctcctagcttcagaaagataaccctaaggagtcaggagggaaaattaaaactccgtagtgttctgaatgttctccaaacagcctggagcacgaagcagggcatagtctccgaattttatcagacagtgtgtatttttaccttttcactgttttagctgtgactgttcttacttggatgtatttctgtgatctttccacccttaaaaaagctttacaatttgcaaggtttacagaatatacagaagactggagactctccagttcctatgaaaagcccaaatgaaatcagaagtccagaattggtcgctaacaatgggaaggggtctgttcgtattcactggctaattctggtttaggccatatggttaattgttattttcccctcaggagctttctatatttttgaagttttcaaaattaagaacaagttatatataaaaattgttcaagcctaaataagttggagaaaggtagaatcttcaacaagcagtagaacaaatggctgagaatatacataataagctaaggctgcgctctgtgccaattaaagcctggatgtcttaaatataaatgtaaaagaaatcatgaaaacacgaagatggattttaggtggggatttatataataagtgggtggaagagcctttttaagcatgatgccaaaagtagagaacctatgggatattcaaagctttgtggaggtggagggtggacaggatataagagtgatatgaggatggagaaaacatttatggtgtgtaagtaggaaatggccaatatataacttcttgccatgacaaaacattagaggtcagcagagtggatggatggatggaggggagggagggagggaggatgatggacaaacagtaaggccagtgcagagagtgggtggatgcctgagatgaatgggtggatagacatggatgaactatttacaatttattagacagatacaaggttaatatgtatttcttataaagcagtaacaaaagcctataggcggataaattggacagatgaatgaggtgatggatggatggaaatgggatgaatgaggggtgggtgagtgggtggatggtagaaagggtgaatggagggcatctcaaactgccttccagagcttctctcttccctccaggcggctttccttctgtttgtggtttctgtcccctcccactagagatgtattatttcccctcgttccagaaaccaagggtccaccttgactctgctaccttgctgtctaatccatcccagtctctctcccatgactgtcttcattcctcattcttagctccactaccaccactataacctgggctttttttctccctcagcaccactttttgccatatctacttgtctatcactgccagtttctccgagtgaatccaaggatctgataaaagtgttcaaaatgcaataatcctgttccgagctgctctgcttgagatcctccccttgcttttctcgtccccctaggaaaagtcccagatggtagtcctgtgctcaggcacttcacagtacagttcatcccatgccaaagccagtccccacagagtccctgccgttccacaccagtgtgctccaaagcccagatgaggagatgctcagggttgcccccttcttgcctacttagcatggagagatccaattctggacccagaagttggtctttatgaccgttactgttctagtgtggtgtagcggtttccccgttgtgaaggccgtcagcctccagggcagtttctggtgtgaagcctcatctgtcagcactgttactgtctcccatgacattcagtcacatcccacagctctgccgctcagcactccagtgatcggccaccagtgttatttgcttcccactaaaggacacctcttgcacagatttgaatttcttttaatatgcattaatacctgccttgtaaggagcccttggttcagctcctagtattgtataaattacaagtgtattgtgtttgtaattctggcagtcaagagtcaaggtcatccttgcctacagagcaggtgaacctagcctacatgagctgtaaattcatattttcagaatcatgtttgagtgagatgtggcattgcacacctataatcccaggtctgggaggctgagacaggaggattgtgagctcaaggcctgtggttacaggtaggcagcaccacacccaactcagtcttcatattagatcccaatttgcctaatatttttatggaacaggtcagacataaggaattacacatccctgacttttttctgcctgtaatttcacttcatctgcctaaatctttattgtgataagctgtcgtcagtctttaatttctgtgtctgtgtactgtctgactgcttctgttgtgagttttttttttttttttttttaagatttatttatttattatatgtaagtacactgtagctgtcttcagacactccagaagagggagtcagatcttgttacagatggttgtgagccaccatgtggttgctgggatttgaactccagaccttcggaagagcagtcgggtgctcttacccactgagccatctcaccagcccgtgagtttttttaatgcctttacttacctaatttctacagtgtgtgcctcttgtcactatatcaagttttgtttgtttggttggttggttttggtttttcgagacagggtttctctgtgaagccctggctgtcctggaactcactttgtagaccaggctggtcttgaactcagaaatctgcctgcctctgcttcccaagcgctgggattaaaggcatgtgccaccacgcccagctactttatcaagttttataaattagctcaggcagtatatttatccttatttatatttaatgcacctccaaatatagactgtcatcattagctttctctcttctggcattttgaaatttgattttctgtaaatagaacatatacctcattgttttaattccccaagggttgtttgtttgtttgttgtttgggggggttgttttgttttgttttaagatttttatttattttatgtatatgagtacactgtagctgtcctagacacaccagaagagggcatccgattctgttacagatggttgtgagccaccatgtggttgctgggaattgaactcaggatctctggaagagcaatcagtgctcttaactgctgagccatctctctagccctgtccatatttaataattatatcccaattgtatatcatttattttattttccagatatttacaattggcatatgggaatttgttttcttgtctttatcaaaaacaaacaaacaaacaaaaataacaaaccatgaagctttgctgacctcatctctaaccacctacttactaaaatgaattgcttagcaaccgtatgatccataggtagtgactttctcaaacattttatgacaataggaacagaagttgttttgttttgaaacaggttctcacgttccctgtctggactctaacttgctgtgtagctgagaatcacctaggtttccagcccctgataacctcctggtgtgtttcagacagagttctgagttcactcaccatctgaatgtccaggtcctttcaggctgacattcacactcttacggagtgagcccttacagtgctgcaatcacatgccctgtccaaatagcagcaaattatgctaccttaccttaaccctccctctgcaatgagacccatcttttctagaacatttattctgaacctgtggattcctatcagtgaattcttacaagttatttagacttgactttccagggttttttatttatttatttatttattttggttttgtttttaaaataaaagggtgttgtgttgtctaggctatatagcggatattggccttgaacacaggccagggtctcagccctgcaagcctgatgatctgagcttgttcccctggaccataaaggtggaaggaaagagtcaattgcctgggattttcgtctaacctccacatgcatgtcttggcatgggcacactgcagtctcacacgtaaacacaaaataataataatacacaatatcataatagtaacaacaacaacaatagttggaattgttaaaaattaaaagttaaaaaaaataacaatgaaaacatagcctaatacaggccaatggtttgacatcgctcctgacctaatggagagattatatcaaccaaagttatccagccataaaggaaatcaggaaagtatgacttaccagttaagacttccttccaaggctgagcatgatagcacatacctttaatctcagcactcaggaggcagaggcaggcagatcgctgagtttgaggccagcctggtctacagatcaagttctaggacagtcagggctacacagagaaacccatatatatacatatacatatatatgccactcaccctgttcctaactgttcctacatgcacacacacacatacatatgctgaaatgctgaaaatatgatggtcggatggctcagtaattaaaacacttgccacacttgcctggccacctgcattcagtcccagaacccaggagggaaagaactgactcctgaaagttaattttcttttgacatgaatggtgcggcatacatattctctctctctctctctctctctctctctctctctctctcatgaatggcaaagctttaaaaaagggataaggatatagacatataagtacatatgtatgtatctttcattttatacacacacacacacatcccttctaagattaatcttgtatagccaaaccaggaggctgtgtagtcttacctactgttctcatcgtatctacctgcacagagtatttagagtagctgtaagaaaaaaaccctgaaactataaggctcttagagtggaatctgggagttaaagggggaaggtgactttttaagactcagatttttacaaaaagctctatcgtttcacagcctaggtgccaagccatttccctccacatgacactttattgtttgggtgtattttaagagcatggaattgctacaatgccctgatttactgtttatttgactccaagggaaaactttatattgcaattaacctttctatttttttccttccatcggagtattgtggacttcctctgtggtattttagtgattagacaggatggagggcatccttacagacatgagatcagattcgatgagatcagagtgaggggaagggatgggatgtgtggggccagtgagtctgccccagcctaactgtctgacacttcccaagtagaataggaacttctgaataattcattttcaggttatcctaaaaagccacttatgtgataccccagtgcagactttcggtgccagctagaggaagaagaagactctgtcttttcctacaagtgctctgcagccttccagaccatttgtgcaatttcacttccagcccttcaccatcttagaacctcagggcagggcccttgaagggattgtgggagcctcacgtgaacagggtgtacagttctttagactcatgtgaaaggctgggagaagggccaggaagtggtcttggacttgggctgaagtatggggtcaggccagggtggcaggggctaatactgatagccagtattccgctgtaaggttgggttttgttgttgttttggtttggggtttttgtttgtttttgtttattcttagcttctgccacccaccctgttcctcacagttcccatgccagcatagtacttaggggagaaggtggtaattagaggcccttgcatcctgaagttcatcatagacccatggcttcctgcgcccttgaatgggtcatcaactgctctgccctgggcctgtctcctcacctctttatagactaaggtagaggcctcctctgcggtacagaaaacactcaggaaggaggtaccagggcaacagcctcaggaattctcatgagcatggcctgcacctgctcacccacaggtcagggcccccattaaggaaggacatgtcaaggagagtacttcctgagcagctacagtgggagtgcttggactgagtgagcaacgactcctctgccaggatgctaggaaaacttaccaaaacttaccagcatgtctactgcatgctgaaggaatctgttcaagttctgattgtacacatgtaggtatggtggtatatgcctgtaatcccaggagggtgcagacaagaggatcaggattcaaggtcaagtttaaggccagtctgtgctacatgagactctgtggtctaaagagaaaaagtaaataaaaactgttgggaaagtaaaaaccaatgttggaaaagaaacccatgcttcctgagggatcctgtaaccgttcatccagacctactgccgagtccaggcctctcagacatcggactccagagcacgaaaatcactggtcacctgtgtcatatacagttgacagcggctggtaggctgaaaggaactgcaattcaaggggacataatgttgagggaatagaaaaggcccacaaacttgagagactgccagggtgccaggccataggcaagagcataagtaggcacgtgtggatggggtgttgtagccacatgcctgttatctgatctgtgtgactgccccttcagagaggaggaagggcttcagcaatgattctggcaacacagcgaggtagcgcggcatctgccgagcctgatggcctgttcaatctcccaggactacatgacagggagaaccaactcccacagtggtgctcttgcatgtacatgaatagtcaatctgataaaaaatttgtttacatttttgtttatttcatgtctgtcctatacacgttaaagtgtgtatgaggaagtccgaggacagcatttgagaattggttccctctttccttttatggatcctgaagatggaactcaggttgtcaaagttagcagcaggtactgaatcagctctccagccctaagaaaatgtttttataacctcatccactcaagattacaaaagaaaccagacgccacacccatatataaatatttatatagaaatactaaataaagtattagcaaccagacctgagagctcactaaacacctgatacaccacagccatatgggaacaagtggagttagtataatctatcatattagcaggtcagaggagaaaaatccatttcattagctacataaatgcttaagatgtacttaaagaaatcaatactcatcttttattaaaaagtcataataaagtaggagatggctattttattaacaaaatctaaatgtatacatttaaagccaaaaacaaaaaacagcaatatggtgacttgtgaaatagtgagttgccacttaaaatccacaacaagcaaggaccctcactgttgtcttagttcctgccgttgtcttagttcgagttagttcctgccgttgtcttagttcgagttagttcctgccattgtcttagttagagttggttcctgccgttgtcttagagttggttcctgccgttgtcttagttcgagttagttcctgccgttgtcttagttagagttggttcctgctgctgagatcaagcaccatgttcaaaagcagcgtggggaggaaagggtttatttggtttatttatatatcctcagtcacagtcaatagaaggaagccaaggtgggactgacacagagcccatggaggagctcttcttactgcctgatcctcatggtgttctcagctggctgtcttgttatcctaggaccaccagcccaggggtggcaccaccacaatgggttgggcccttcctacccacgttgactatagttaaaatagaactagccagcatccagtatggaatgttaaagaaatatatgccagtatggttccacctccccctcttcatatgtgtgtgtgtgtattatcacacacatgtgaatgtttatgtagagaccagactccaaccacctttggttttgttttttgttttttgggtttttttttttttttttttgcggtggggggggggtggggggggtgtttgtttgggtttttgtttttgagaccatctttcccttttttctggagctttccagttcagctaaacaagatgtacagtaagtcccaggatgtgcctgtctctgccactccatcactgggattccaagtgcctgctgctgtgtccagcctttgttatgtgggttctgaggattcaactcaggtcctcatgcatgagaggcaagcactttaccaaccaagccactgtcccagccaatgagtttccttaggtaaagaagcaagaagcattctggggataccagcaggttctttgctctcctcagatgcagataagggcttaagatactgtgaaagtaggggttaggactgattgttctcccagaggtcctgagttcaattctgacatggtggctcacatctgtaatgggatctgatgccctctaatggtgtgtctaaagagagtgactcacatacataaaataaattaaaaatatatatataaactgtgaaaggcctcaggaaccatagaaaggctgtcactaaactgacctgcacagctgactccttgtggctcaaacctacccctccctctgaccgacatctgacttccacatcctatgcagcttattaattttcttttgtgacaaaatatgtgaaggaagccacttacagaggaagggttgccctggcagcaccccccccccaagagtctcctccagactcctcctacctcagttaacatacttgcctcagtccctcacagaaatgccagaggcttttctcggaagtgcttccagaccttgtcaactgacagtaaaaactgtcacaggcagcttttcaactacagattgtccctgctcttgccccaaatccttctctttgtgccaggctgggagaggggaacctacatcctttagagagatgacagtcccatcacagagcacccttcctcagagccagactccatccactgctgaccaacctgttctttctaagcttggacttaggccctgtcctaagtgtctgaaaagtttttttggatgacaaaatgatagtaagaataattaggggctggtgggctgactcagcaggtaaagtgcttgttgccaagcataatgaactgagttggatccctgaacctcacacagtaagaaagaacagactctggcaatttccctctgactttcatacatacttgtatattgatatacatatatataataattaactaaagtaaaattctgtagcatttgcatagatcattctccaaatcaccatatggaacttttaatagataatctgatacatgctctataagtagttttacactatattgcttgttaaatgaggtgcagactgaggtccacatgaggttcatacacacatggaatctgcataagtgggacatgaggacatggaggactaagcacactgtttttcctggcgtcactggcggacggacggctaagatgatgagctatgcggcagcctggcgctgggccggatggtgctagcactcaggaggtttgtgcgaaaggaaatacatggtgtctggcctgggtataatttcctttccatcaaccttgaccgtgtcctttgaagttcgtcataaaaatggtatgttagcccagagaataccctgaaatgatgcgcggggaaacaactgaatgcactatatatattctaggccctgatgaaatgaccctgtacttgaaatcagggaagagcataaaacagtgcaggttaatagtcagcagatgccatattgtcagctcacaaaaaggtagcggctgaggttcttataacaaattgtgctgagcgagcagtttgtgcagtgttacagactttgaaatagacaagattttagacaagtgtcaatctcacaatcttcaggaaatggaaagagtggccacgtataggcacacacctataatcccagcactcaggaggcagactcaggaggattacaatttgagaacagctggggccacatgagaccatgttccaaaacaaattaaaggagaacccttcacagctagatatggtgaatgcacacttgtaatcccagaagctgaggcagaaggattcttataaacctgggactacataatgagaacaagcccaggaagggctatattgtaatactctagtctcaaaaacaagggaggggaggggagaagaggaaggaatgaaaacaaagcctctcaagagttactgtcatgctatgaaactatattatgggcagtccatccctgtcctggtaaagtagcagatgtggctccccaccccccagacatttccagtgtacttactaaggtcaggtgattgggtaggcttcgttctgttggccaatgaggtgcagcagtacatttgagagggtgtgtcctagtttgcttctctagagctgtcaggaaacactacccaaaggctacttgaaatcagggaagagcataaaacaggaaagggtctgtttggcttacacttccaggatcacctttagaggagagggcaccagcagagggctgagccctcccacatcagtcattactgaagaaaatggcccttcaatgaaggcagttcttcaggtgaggtttccttttcccaggagactctggtttgtgtctagttgacaagaactaaccaccacaggtgggctcatcaagatctagtggagcagtgactcagggtagaatccacacagactcgggctatgctccacacagagctcaggaatgcactatagttcccagctagcagcacacagcatggtgtagcatactggctggttttgtgtcaacttgacacaagctggagttatcacagagaaaggagcttcagttgaggaaatgcctccatgagatccacctgtaaggcattttctcaattagtgatcaagggggaaaggccccttgtgggtgggaccatctctgggctggtagtcttgggttctataagagagcaggctgagcaagccaggggaggcaagccagtaagtaacatccctccatggcctctgcatcagctcctgtttcctgacctgtttgagttccagtcccgacttcctttggtgatgaacagcaacatggaagtctaagctgaataaaccctttcctccccaacttgcttcttggtcatgatgtttgtgcaggaatagaaatcctgactaaaacaggatatatccaagcaggagaccctgccgaaaataattgagttgtaactagttgtgttctctttgtcctagagaaagggggtggagagtttttcttctaaaaactaaaagcagacttaaagtgattctctatggagatgggctgggttagacattgtagctcacttggcacacttgcccagcatctactgaccgctgggctccatccccgccaatacataaactggacattatggcacacacttgtgctcagcactcaggagatagaggcaggaggagtagacattcaaagttgatttcaactacatagtgaggccagactgggatgtatcacagcctgtaacagaaatttaacattaataataataatgtcaactttggggcaagccttgctccctcattgctgcctattgtctctgggaatgatagcctctctaggtctgggtatcaccaccacaggcttaaggtttgaatcactcttcctatccacagcagagcagtgttgtcaagctcctctgagtccaggaaagccatgagtgtcctcactgtgaaatacacagttactgttatcacattcagtattttgctcagttctgtggttgcttagcaaccaaagttagactgaccacaccaatggaaaacttggcttcacttttagggattgcttcaaacacagagagcatcttcctgtgttagtgggacaaggtggcattttattttgtttttcaaaattgcttttttcaaaatttgttttttaatttattactctgtgtgtgtgtgtgtgtgtgtgtgtgtgtgtgcgtgcgtgcgtgcgtgcgtgcgcgtacacgtacgtgtgtactgttgctgtgggcctatgtggaggtcagaggacaacttgtctcttctcctatgtggtttactaagtatcactgaaccatctctagtcccaactcaggtctaggcttccataaagagtttgaaatattttgttgcatttcctagatattaggaatctttagggctcagcagttgagaacacttgctgctcttgcagaggacccacgttcaattcccagcatccacttggcagcttataattacctataaccccagttccataggatccaattcttcggcttccttaggcaccaagtgtgtgtgtgtgtgtgtgtgtgtgtgtgtgtgtgtgtgtgtgtacgcttgtgtgtatgtatttaaagaataagggacaggcagtatggctcatataaaggtgcttgccaataaacctgagaacctaagttcagtgtctgggtcccacgtgctgaaaggaaagtattggttccttaaaaatatcctctctcctccataaatacaacatgctcccacccaacatacacaaaataattaatataatttttatttttaaatgagatttaaaaaagaaaaggagcaaagaaacagctggatgatgtggaagacagaagttggtatgccagccttgtccagtcagatagatgaaatggcatgaagattggttagcagaactaaagaaagatggcaccactcttgaagagccatcctagaatacaaggagctgtcctacctgaacacatgcagggtctgcctacctccagttgtgtcaggagcccacagtagaagaaaatcaactcctgaaagttgtcctcagcaccaaggcagagttatacacacaataagtagtgaataaaataagtacatgtgcctatgacatatacttgtcccattggccactgtaatcccttacaggtttgtctggtgctctccttgtgtggatatggtcattctgcttcagtctgagccagagggccttcgatgcaccaactcagtgatgactaacctctatccctcttctttccaagggccgatgagatcgagatgatcatgaccgaccttgaacgagccaaccaggtaggctgttagaaccttcaccatgaaacaccaaagctcacccagtcagttctcttgggagacacctctctccaagatggggttatcgtggatccattttaacatcctcgaaggaagtctggataggaacacaagcaggacaggaatctagaggcagggacttatttatgcaaaggccatggagaaatgctgcttactgacttgctctcttatagaacccaggagcagcccaggtcctgccatgagaagttagaaatccatccactgcagtgtcatgagggtattcattcttctgatcctgtagctccaatgcatcagtctcaggagagcctaagccatggcctgtaggccacattcatctcagaatagccatgggtgaggcctaacacaaaacagtaaactgcttgagacattgaaattggctgattgattgattgattgattgatttgcagttgtgcagttcccaagtgtgaacattgaggttgacactgttttccctgagtcagaaggttgagcatgtctaacaccttgtcaccaggtgtccattgcactacagaattcattattatcttcttctagtgggttccaactgcttgctctcatggagctcccagagggtagttatctcagccaatatccagttatcatatatacagtgccaggcacacagtagtcagtcacataatgtcatgtggttccaagcactcagctacccataagcactttcttcataggccttatagggcaggaaaacatttttgctttcatatctagtgcttctggctccaactagctatggaggtgataatgaccctgaacgactttatgtatgtgagtacactatagctgtacagatggttgtaagccttcatgtggttgttaggaattgaattttaggacctctgctcactagtcagccctaatcactacggctcaaagatttatttattattatacataagtacactgtagctgactttagtcataccataagagggcatcagatctcattacaggtgtatgtgagccaccatgtggttgctgggatttgaactcaggaccttacccactcttacccactaagccatctctccagccccaaccctgaacttctgattctcatgcttctaccttcatgaaaccctgggtctcatgaatgctaggcaggcacttggccaaccagctaagctgcattcccagccagtctccatagattcttcacttaggggagaaacagctaaagcagaaattagtttctcagctcagaaggacatggcctgtggcctctgcccactcaattttatagccaggtagccataggcactagaaagttttgaattttgcattgggtcaccccactgagttcaaggctctctgtgaaaatgaaaagccttccagactccctgtaaaacctgccctctgccccctggggttcatgggacacctgcctttcatagtgctggtcactcagacttgcaccagcacccaggggaaagtgttgtccatttcttccctgatgaaattcacgtgaagcctaagcaagaaaagcagggcaggaggaaagaatgcaatgtgtggctctgttactcccttagaaagggtcagggcagcagctggtgcttagacctttcctaaggtcctgggcctggcctgtaagggctttctgtggagagtgtggcactggtcatatgaggtctcctaagtagtcttagccaccctagtactaatcagaatagtcatccattcttgaatgctccattcccagttaatctaagcacactgtcagaatgatatcacttcatctgccaagcctccacactgagatcaacatggtcagggttcttataaatagagaaactgagtcagtgcctggtccatcactgagctgggacaagaaatgcagaagtctatcttaaggttgtcttggcacactgtggggtggtttgtttcttgtttggttgtttgttttggaggtattgttttgtttgtaacttgattgcagagttggctcatgtgaactttgtacttgacaacattgtgttacaatgttaaaagggcaagtgccttggtacagcatctgagaaggaagtaaggaagccccagaggctgcctgcctggctgttgtggggacagagaagtctgagggcagacactggtgttggctttataggaaagctaggctgtgtctgggtagcagaatggcctgatgggaaagagcccagctggttagggggagaggggcttcatcttgagaacagtgggtatactgggagggtggagatcctggatttgtattcaattaaaaggagacttggggctggagagagagtgcagcctttaaaagcacatactgctcatgcagaggaccacgctgagcagtccccatgcctgaccagatacccacttctgaactctcagggctcctgaactcacactcatatacccacacacaggcacacaattaaaaataaaataaaccttcaaatttttcatttaaaagaaacacaggaatcgctgtagataaagctacgataaggaagccagggaagcagcaagcagctctgctgacaggacaggagaagcctgtggagctggacaggagatggtgcccagggaaacaaggcagaggtaggctgagcaggagcactgcgggctgcacacagccacaggctgctataggtgccacagacttgggaccatgggacctgtctgggaggaacaatttgctatttcattggtgtttagtgttggttttgccttgggcttatctcagacattctactgacacccatagtgctatctcattgctcagagattatgtctctaccccaggaaaccagaaaaacaggcagaagctactagtggagcagggatgtctccttggcacatgttcgatcaacacttgcacttccagcacttgaagaaatagtcattgcaccataatagttaactgaaggttctgggctccgggatttcttgataagtaaaccttagcttgacaaagcaaagagcacagacaagccaagtctttgcttccctttgtgggctagctgccagctcaacctctcccttccagagcagagccacaggagtgaagcctggaggaagttatttaaaacagtcgctctcctcccattgacctggctgatgattatggaacaaggcagttatgaaagaccccgtgtgctggggttagggcttgcttgcttgcttgcttgcttggcttgcttggtttgaggagcctcatagcccaagttagtcaaattcactctgcatctgaggataatctcctacctccacctacagagtgctggaattacaggcatggactacagctcatgctgtgctggggatcaagcccagttattattctgccaagggttttatgtgctaatgggtcaggacacttggctttggaatcaggacacccaagtcacaattctagatttggcattcttttgtacacacacacaccttgtcttagtgtgttctctgttgctgaggtgaacaccataagccaaaagcagcttgagaaagtttatttcatgtcacagtccctcagggccaagaactcctggcaggaacctgaaggcaggaactgaagcagatgctcagggagcactgcatactagcttactccccagagcttgctcagctgctttcttgcagctcccaggaccacctgcccagaggtagcaccacccacatcaatcattattcaagaaaatgccccacaggattgcctacagtgtgatggaggggttttctcagctacttcccagataagcttaagtcaggtagacaaaaaaacctaaccaaaacaccagtcctccagtaccgtcttgtgtccatgcatggaatgagagctgatttcactctgtgctcccagtcattcaattgacccttgtaccctgctcttagctggcctgggtgcggatggggatgtcttgctggcttcatgagtggagtgcagacacatgcatgactgggtttggtcctgtcttatattcagtccccaggacacactgggagaatcctgtctggcagtttgctcatcagtctttgctacagtcctgctacccacagatcagcagtgttcacatatgtgacttgtcagcctggtctgcagtagccagcagcaccagtggtgactgaccagggcctcgtgcaaatgccctatctgcctggtacgtgtggtgacaagtttctcatctcctgcccaaggccttcgccaagttcctgcagaaccattgataggggtacctctggcagcctcccatgtctctggttacatgtcagccacccaattcacacactaggtcactttgccgctgcagagaaggcataagcaagcaatctaagaccaaaaggagcagaagattatattaaaagccccaccaccaccacataaaccaagggaagtagccagatgtggttgctcacacctgtaatcccagcacttgggaggtgagtcaggagttgaggacaagcctcagctctctatgtgaaaccctgtctcaaagaaaaaaattggtcaggggctgtagctcagtcaatagagtactcagctattatgcacaaagctttgaattccatccttggaacattaagacagaaggatcagaagttcaaggtcatcttcagctacttagtttgggggaggcctggactacatgagaccctgtctcaaaaaccaaagtcatctgttttaggaaagcatgcattggcctcagaagtggtcttaataatttgactttgtcactgtggtggacaccatcaccattggcatgcagggtagctgatctccatgatggcagccaccaaaggttagcactgtcctaccttctctcctcctctactcctttgtctcagaaattgttgtggcttctcgagaaaaagcttaagccaaccacacgtggtagcaagtgctgtccctgcctgcggttcaaggtcctgtcctgtgttcccctggctctgcctctgcagggtagggcatgtttgggagctcatggacgcatgcattatctcaagccaccatgatgcatgatggggtcagctctgcatccctaccatagtcgtctgagctgtggttttatcaagggtgtaagaggctccaaacagggagtgcctgcccaggcagcacccctccctatctgcctcagctgccaagggaaggctaaagtgagttcttccaacctggaaacaaattcaccccagctcccaactagtgtctgtcaccctgcctctacttcccaaatgctgggattacagacttgtgccactatgcccagtttattcagtgataggattgtacccagagcatgctatacaacaagcactctaccaactgagccacatcctagcctgaagctcactctgtaactacttgtaccaggctagcctcaaactgagattaaaggcttgcaccactatgctcatactagttttgctttgcttttttgaaactacatctctggttatcaaccaggctggcctcaaactcatcaccctctgaatcagcctccccaaagttgaagctacagacattaccctccaagcctcacaccgttgtgaacttggtacaagtatgaacctagaaaaatttcaggggactgactccttggtctgtgatgtgagtacttgaccacctggcatcttcacagtgtttaagactaatgatgagaccagaaccagctgttccaggaaacagccactatggtaatgcagctatcggaacttcttccctaataggtgaagaaatatttttcctcctcaaagagactaaggaatttgtctaactactcattattcctggcagagctgtggggattgtgtgcttgaaggtttacctcactaattatggaggaatgtgtttttcagtcaagtgtcttgactgtcagagaaactggggaaaacagctgttgtcccaacttcttttaaagctgaagcagaaggatgggaagttcaagaccagactatgcaacttagtttgtaagaatctgtctcaaaacaaaaagggaaaagagagactggcgagatggctcagcagttaattgcaccgactgctcttccagaggtcctgagttcaattcccagcaaccacacggtggctcacaaccatctgtaatggggtctgatgctctcttctggtgtgtctgaagacagctacagtgtactcatatacataaaataaataaacttttttttttttggtttttcgagacagggtttctctgtgtagccctggctgccctggaactcactctgtagaccaggctgggctagaactcagaaatccgcctgcctctgcttcccgagtgctgggattaaaggcgtgcgccaccacgcccagctttaatatttttttaataaaaggaagacgaaagcaagagatttgtgtcttagttatgataagtctgttgagaaactactcccacatcagtcacatgtggggagcctctgtaggcatagagccccacccaccacccaagtgtctgagtgggcacaatgttcccactctacagataagtatgtggaggctccgggagcataggtagctgttgttgctacctatattcctagatagcctcttgagtggtaggtactggagtggttttcttctttgtccagtggcaagtctgagtttgcagcagtcatggctttctcatcggggtcctagacacactataaaaggttccagccatttctgttggagctgccaacactaatttaggcccatcactgctggccctgagcagtctgctggctgcagatgcagcattcacaacattcccccatgaagaggttaactgtggaagccagctcatccctcacaaaagcagccacatttccacagtccgctcatggaaacacaggctggaagaaaacaacctcaacattgtgtgtatttgggggggaagagaatggccggagtgtctttaattcagtgtttacccatgagaatgactccccggagtaatcctgtgataaagtctcttcggtccatgagaatagaaagaaattgaatcagaagactctatttccaccgtatttattcagtctgggaaacgcaatgggccggagcattaataccagcaggggattcctcgctcctagcgttaaattactgtcataatcgctcaattatttcttccttgtactgtttaaaataaaaatccatcacattctagggtgtgtgtgtgtgtgtttccctagcatttattaggttgagtgtttaggaaaatcaattacagtcagtcaggcatgaattgatgaatgttcttgtaataattgtcagctgttaaaccaaatgtactctcttctcctcaccccttttcctttccttcagagggcagaggtggcacagagagaagcagagactttaagggaacagctctcatcggccaaccactctctccaactggcctcgcagatccagaaggctccagatgtggtgggtaacccgggctttattaccccaaccccatccctcctcctatgcctgtcactgctgggttcaactcttgcctttggagtaacagttgaagcaagaatgaatgtctggtggtgtactggtgacttttctgataagggattattctggctcgtggttcaagggtacagaccatcatggccaggagggcatggtagcggtgtgcggcagcagctcacatccagtcaggacacagagatcaatgctgctgcttagctgacctccatctttttattaacttcacaacccctgccttaggtgctacccccagagagagtgtctcccatctcaactaacccatacccaaagctccctcacgacattcccagaggccaggtactcaagatcctaatgagctgaaagctttaaccccacacttatcaattattcttagctagcacttgggaaggatgaaggaaaagctctgccaatagtacacgggtgtcctcatggtttatgttgggaccccagtggttatgtacatgtcctatgctagggtggagtgctcgctctctctctctcatacacacacacacacacacacacacacacacacacacacacacatacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggagggagggagggagagagagagagagagagagagagagagagagagagagagagagagagagaagaaaacaaactcagggagctgaggcaaggggattggtagaattggccagactaggctatataacaagaccctgtctcaaaaataataatatagagggccctgagcatttcaaggtgtggtagaaggggtctcatgaaggagactgttagttctttcatacttcagggacacagtaacttattttcctctgaaatgtgtcctttattcttccttactcaaatgtagaagccctggggacagcaccagggcagaggcaagccctggagccagggccagcagcttcccagcttctgtggccgcccttggtcaggaggaagccattcatcctaacgtgtctaacagggcttctaagctaaatgtttggattgcagagaaccctggcaccttgctgggccacagcaaacccaaacattacagaaggaaatgaatgtttttacagatccagtcagttgtggggccaggggtggcttccacacttcatcatgggctgaatgctgcaagtccctggcttcagtctctcagccacagcaagcagggacttccctatctataccttcccatggaggccaccacaggcatagagccagcaggaaaaaatggtctttcatggcagcccatggaactcaactgggaaagagtagaatccataactgtggccaagccagaaccaatgcattgaatgcctcatagaactctgattctagaagactggaggggaggggctcaaatattaagagcttgtcacatgagcatgaggtgcccacatacatgccaagcactcacaggtacctttcgctccacccaccaacctgccactctttcatggacactgagcaagtcaggatgtgctgaagagccctgtgatgtgtctacagacaaatactagttcaaggatcagttacagcacacctggccactctttagcctatcggaactttaatattggggggcaaggccatctgtgaggccagcgtcagagagtctgctggtgcaaggaagaaactaaagggctagcctagacctgccctcttattccctctgcttgtgcatctcctttcccgttgtacctatagctctttcattcttagcctctaaaataacagtctctagtatccttgcccaggctcaaacctttccatccacctcagcccctaacctttctccattctttcattttattgtatcccactatggaaccaagaggagacagatgtgagccaaagaattgtcttgggaatgtgttcatatctcagttgacttttgtaggacagcaatgtttacaggtcagcctagaatgaggaatttgtggttcaagtacccagggttctggtgataaaccctagatccatcaagacctgctctgtgtagatcaactgtttgacctacaatccccaataccttaacctgggcttgatctggcccattgttaggtctaggtcaccttttggctggttttatagactgccaaagaacccttgaaacaatgtttacaattggcatcttccagaatggaatggaacagatccattagaatatatacatgattcatactgcacatgccaagctggcctctgacttccctgaaggcctcttttcttttcttttcttttcttttcttttcttttcttttcttttcttttcttttcttttcttttcttttctttctttctcttttccctctctttccttctttctttctctctctctctccctctctctctctctctctctctctctctctctctctctttctctctttctttctttctttctttctttctttctttctttctttctttctttctttctttctttctgagacatggtctcatatgacagcccagacttagcctccaactcattatatagctaaggatagctttgaactcctaatcttcctgcctccacttccagaattctgagactgtgattgtataccacatacctaatcccaggtcatctgtcttatgtgccccacccccttccctgatccacagctctgcaaatcctattgtgaaacttttatgttttaaagttttcatccagttgtaaactgatactttttaagacagtaagaagccaccaggatgtcagttggttctagagtctcttcctgccattcctgggcttgcctcatagccaccagctcactggagacaggcaccccatgggtatgtgctggataggatagtataggtagactatatccagggacaagccagtgggggatacttaggagctcagcaccaaagagaggaaatagaacatcatacacattaaagaaccagaacaggatctgcttggcacacagatctgcataaacttccatagaaagggcctgaatttccccagacattgttaggaaaagtcacttccctcagtaactggctgtccccacatgtgccatgtgcgctatgacaaacaccttgggcacaactagacaagactaagatgaaggaacatgctttgtcctctacctcttgtgtgtatgggggctggggagcaactggttcatgctatggaagctacacgccagtcctcatccatacagtcatatgcaaatgtctctactctgcagaaaagcttccagaattagtcaggagccataactacttttaaaaacatttttgtttggtgtttgggtacagggatcactatgtatcccaagctggtaaactccatcctcctgcatcagccttccaagggctgaaatcatgtgtgtgcaccaccacacatagacctgactttacaactcaatgaaaacagagtcattgagaagccaagctacagattggactttagctcattttttaatacctttctggcttacgtgttatgtgtttttcacacagcattttagggaatgatgggaggttgtggaggagggttgatttgggttttttatgtatatgggtaccttttctacatgtacacctgtgaagtctgtgagtgtctggtgccattgaaggccggcgaagggcatgggatcccctagaactgtgagccaccatacatcctagaaactgatcctggatcctctggaagagcagccagtgttcgtaaccactgagccacctctcctgcccccttttactattttctgaacattttatattttatttttatgtgtatgggtgttttgcctgcatatgtctatgcaccatgtgcatgcagtgctcatgaaggacagaagagggcactgcgtgccctgggactggacttaaatacagttgagaccttccaagtggttgctggggaaagaacctgggtcctctggcagaatagccaactgcccttaaccattgaagacatctctccatcctctgaagacatttttaacaaatactcaggctgaaacaatggctcaacagataaaggttcttgctgccaagtctgacaatctgagatctaagtcctccaacttgtgcacacgcatgcatgggggggcaggacattaatgagtaaaagaaacagttcatttatcataagcatttctaagcaaaggatccaccaatgtgtatattcctcatctttaaactccatgctagtccagagtgtttttgaacacccataatcttgggaagtgaatacaggatgattaagaattcagagccagcctcccacccttcaggtctctgctcacatgtccctagctcagcgagactctatggaccaatctactttaaagagcctttcaatgtacatccttaatcccagctctcggctggcagagagaggcggcttcccatgagttccagagtagcctaggtttacatgggaagacccaggcactgaataaatagtctttctgactttaactctcatatcctccctgttccagtgttctgtagtccttggcaccacctcacatgtaacaagttggtgtacttcaaaggtgtgtctaacttgcccagccccactagactgagcctgcaaaagacaggcttttcttttttcagttgccacatgcctagtacaagggagagagattctgagaaaatatttgcccaagtaacagatccaggtcacagccatgcaaaggcaggaagtcatgtccacccctgactcctgctgattgtaccctcctatctatgtggcttgtgcttcagttgcaggtggacgggtccccaagctcctccccgagagccagtgctgtctcgtcattgctttgtccttcccaggagcaggccatagaggtgctgacccgatccagcctagaagtagagttggctgccaaagagcgggagatcgcccagctggtggaagatgtgcagcgactccaggccagcctcaccaagctacgtgagaattccgccagccagatctcacagctggagcagcaactgaatgccaagaatagcacactcaaagtaagggcgtggtggggacgagagcatgcgtaaggtggggttagcaagcatggatgagctttcatgaacatactggcccgtgaccataaccttgacaagctccagcccatgtcagttctgagcaaagtcctagattcctgggacagagaaattgagtctgactctcactaccactcctggcattttccttgtaatgcaccactcccccacagcagagagctccctggtacttgacagatgcctgactgctcctgtctgcccattgcactactctaccacttgagacctcccaagactgcacagcacccggcattgctgggcactccttgtggagggctcagcggccagcctcacagtcaaggccatctctgtaggtttgtgtgctttaacagagctgctgggcatcccaactttctcctgtatgagtacccagctcacaaaactacacagaagctacacaaactacacagaagcctggagatccacagaaaacacatttgagcccccatgagttgacagtcacttctttgtcagtatgtactgaaggccagtggcctggaactcgatgttgcctcaacccatagagccatatgccgtcccttctgtcccatggaattctaggcaatcgagcagacactggtttctaagtcttttttttcttttttataagacaatctccctaatgcagagcccaggaccttttatatattctaaataatagtaattacacttcaaagtaccagtcgaatcaagtgcaacttaaagatggttctggaatcctagattgctaggtgttaggccaggagggactcctgggaggtatgtttggcagacaagaaggcgagactagcaccattcagggctctggccaggctggaggacctcctgctcttcctccaagattttcacccaaggctggcctgcccctccaggtatctccttgcccatgcatgagtgagtgaggtcagtaaatgaagcaaatctagctcactgaaaaatggaggaggctaagttgagatggctcaggggtaaagagcacttgttatataaacatgaaacctgagttcaaatccccaacacccatgtaaaaaccctggcatggttctaggcacctgtctataaccttattgctgtggggagtggagacaggaggattgctaagactttttggctttccttcagtgagagacttttctcaggtgaaatggcagagaatgaggaacaagacaatcaatgtccttctctctccatctgtacatgcatgcactcatgcatgcgcgcgcacacacagacacacacacacacacacactcacacacagactaaaatatgagcctgtactactaactactggggaagctgaggtggcagtagtgtcattaagcctagaagttccaagccactcttgtctgttacagtgagactagtctcaaaatggaggagggaaagatggaaggaaaggttttctcttatatgaagtgattctagtatagcatgatggtgcatggctagcaccctagctcttagaagacaagaacaagaaaggagaacctgtgagttctatgccaacctgggctacctagcaaatttcccattgtgttttgaggcaaaggcttttctgaaaccttgggcacaaggagaaggcatagctggctggccagcaaatcccaggtatctgcctgtttctacttcctgcactaggattagaaagtatgccacatgactagcttttctatgtggtttctggggtaggacttgggttttcatgcttaccctacaagcacttcacggacagaagcattttccccacccttttcttttagtgattttttttttcctaatacatgaccaagtttaaccctgaacctcattttgctgtgagtttgtggctgatgccagcagcaccacagctctgccaggctagtttctttctccttggcttctttggcagggatatcttccacttgcccaggtgtccctgaggagaaggccctgggcttgggtaaatggctcatagcccagcatttcctcctatcagcttgccctggctggcgtgagaacgcaggtttgacgtctctgccttggatgacatcatcgttcaactgtttttctgggtctcctctgtcccagtaagggcttgactcaagtgcatcctgcccattgctccctggcagagctgcaggctgtcagccctccagttctcatacagagcaatttcttccaaatcagttagggctctaatgtttgcctttacacacacacacacacaaaatgaaacagagttgcacaaattaatgttcttatcgtgtcttgggggaattctttaatactgcacagttaatgaaacaatccagcaatgcttctttccaaaaatcatcctcccttccttcccttcatctgatctaataatcaaaacatatcctctagaacaagacttctgattttaattatcttaaccccttgttgccaaaagtaaagatggctctgatacatatcaaagccatacacagaaggcctcaggccaccaaatgggcagatcccctgctatatcctatacttccccacaggggtgaggttgactgaatgaggtatcttctcaggatttgtttcttgattttgagcagagcaatgtgagtgtatatttaagacagatttcactctataaccttggctgacctagagtgctcagtacactaggctggccttgaactcacagagagatacctacttctgcctcctgagtgctggggttaggtctctgccactctgctcagccatggcttcttcttcttgttcttttttttttttttaatgtgcataatgtatagtctctgatttaaactaaatgtagacacaatcactagggagatattttatgaataagatgaataggtttgtcaccttctcaacctgtcacctgatacttatagtgaggaactctgaccttccagtcatagctcctgtaacaccacaatgatagcttgtcttatactactgtgcctttcttcttctcttcctcctccttttttagacatggtctcatgtaccaccttggcctggaattcactgtatagccaaggctggccttcagttcctgctccaacctcccaagagctagggctatgggcatgcatcagcacacccatttactatgagatgtttctttctggtttttctttcttcccacgtccccctgctccgctcagctgttttgttgttgctgttagtttgcttttatttatattttcctgcctaaaccatatttttttcagctttgaggggcaagtgattacagaatatgtgctgagggactggaatcagggtgcagcctggaagcagctctgataacagtcactttgagagagcaagtcatacaaagttgatggtttcatggtctaagcagggtccatgtatccaaggctggtctcaaactcattttatacccaattatgaccttgaacatctgccctacctctggaattcgaaaattacaggtgtactgcactatgctctcttatgtgatgctgtggtgctgggggttgaacccagagctccatgcatgctatgcaagctatgcaagcactctaccgactaagctacatccccagcccataggcagaatcttgagtcctaatatgattgctgggttttgttgtgttgtgttgtgttttctaaccaacacattttactggtgttatctgtaattgggtatcccaggcaactcattaattgcttctcgtggtccagcatgttgaaactgccctatcctttctccaccatgaggtctcatatttactagtttctcttggccagtgttctactctttcatgcagacgtcacggttagctcatcaccatccatgtcttctcacctttaaacaggtgtggaaaccagcttgtgagtgagaactgtttcttcctgcccagtctgacaagtgctcagcagcactgtcccatttgtggcagataactctgagttcataattaatgaactgccatgagaggcagctatttttgataactgttccatggctttgtcagagcactcttcatggagaagcaatgtaattagccagtcacctgcgctgtcctcactgtggcatagaaaatgtcactagtaccttcaattaaaatgagtgtttatgggaaaggctagcaagcatggcatggggttccttccccagcactggggtgctgatgcatacctacaatctcagcactccggaggtagaggcaggaggatcagaaattcaaggtcttccttgggcataaagcaagttcaaggccagcctgggctacaaaacaaagagatctgagctaagattaattaggccctcaatttataatgatactatcatgggccagcaaggtggctcagcagacagaggagacctgccaggcagcatgtgtttgatccagtttcatggagcaaccagagccattcctatctgagactgcactgaactctagggtaggaccaggccaacagcctctgaaggtggagacaagctttgctgagtgcccctttgccaagctcctagcactcggtctccccgggatgaaatatgctactgcagtttacaaacgagctggtagggtcagtcttcactgtgaaactgccccgttagaacgtgaaatttcagtggcagctgtttagttcttgctgagcactgccatacctaacacactgccggggtggccgggtgggtaaaggcacttgcatgcaaacctggcaacccaagttcgatcaccagaatccacacaaaggtcaaagaaccaactccacaacaccatagtgtgtgcacctatatccacatatagtaatagtaatagtaaatattttcagtgatgaatatttccaggctgctgagatggctcagcgggtgagggtacttgccacacaaacctggcaacctaagttcaattcccaagacccatggaagaaaggaacagactccacaaacattgtcctttgatcttcacataggcaccatggcacatgggcccatacagatgtcatgtacacaaatacacaaacccaataatagaaaaaaataaataaaacagactctaatcatgacaacctttttttttttggaaacaacatctcgtagcgcatagtagcctcagactagttatgtgactgagcaggcactttagcttgcgccccctctctctgcatcctgggattacacgtgtatacagccatgactagtttgtgtgctgcaggatttggagcccggggcttcaggaatgctaagcaatcactctgccaactgagttatttttccagccctctttttttatcggccccatcacagggtaaagcccagtgtatactcttggcagtagcaagaatctcagacttgggaggcttagtggtgtcttccaccagttcctccctcgtgtgacagctttagccccctgttgcccctgtcatttgatgcagcagaaatatcctaactgccccaaacatgtctggcttctaagaaacaggctggagctcatgctgcttggcctttttaggctgacatactccatctcagcccctccctctgccttcctccctgccttctgccattctctggaggtgacctgacgtgtgttcacatctggcctcatcaaaacactgcagataatacttagcaagggtgggcggtgcttcctgctatgactgtagggaacggaatgaaataatcacttcttcccaaacaccttctgagagtcttttataggaaaatgagtgcctaccaccctccatttgattatccctgagaaaaccattataatttataaagttagcaagagatatttaaaagggaacgtggtggagcaattttatgcagttgaaatacacaagaaatgtgtcagcagaggcaatggaagaaaatgagctgagtggatgagacaaagcaacggtctacttggaactctggataggttctgatacaaaggagtttcgaggctgagggaccaagcaattaagcctctctccccaggttctagaattttctccattggtctcaactagaacctaaagagatacctagaggctccatagatagtaagatgctagctgctgcgactcttaaagttgttcagctcaaccttggaaacatgctgactcaccagattcttgccttgcagactcgcggtttacctggagtggccccgtctccccaaggcctcaaagaaaaaaacaggccttggaagaaaatacctgagacttaccgcccaagcccaggaaaaccatcagtgtaaaaatagccatagagtcatggatgtatcctgcaagcttaaagaatattctggaacacttaagcatattatcaccctagaaatatactgtaatgccacagaagacagtgggaccagtcattatcagccagagtcattcccacaagaatgaagcagctttcagtgagccacacagtggaactggctctactccctaggccctaatgtctaagtctcccagtgaccatgcttgcttcctggtgtttgtttaccctcctttgaatagctgtgggcagcttccaccaaaactgcagttttacctgtactctccaggcagtcaaacacatttgttcaaaaaccacatgatgcctttcaagtgttaggacccaggctgtgcttccatttactggcattttatacacagtgggatttttctacctttgtgaagcttttcccttctactctcactgagttttacactaaaacctctggttgtgtttccatgagcgtgcatgcacacatgtacactctcatcaggtcatagaaacagaaaggaaaagttggcttccacagtgttggctccctgaatacaggattgcttatagggattgtcatcagtgaaatctgacaacttcctttaagatgtggctattaataaaaccttctgtttccagcaactggaagaaaaactcaaaggccaggctgactatgaagaagtgaagaaagagctgaagtgagtatagcgaagcatggggccttctaagactgtctactgatgagtgcaaagtggtacccaaacccagagcaccaggactttgactgttctcactcaagtcacttacagtctcttcttttttttacttggctggctgcttggttcgttgggtgcttggttggttggctggatggctgactggctttgtggtcgggtctcatgtaacctagactggcctgaaactccatatataaccaaggatgatcttgaacttctgatcctcccaaatgctgggatttgagctctgtaccaccacatctggttaaggctgtgctagggctgccattcagccaaagccttatgaataccaagagagcagtctacccactgagtctcattccagccttctttggattttatgagactgtgtgtttaaagtattccagcatgcatggagtcagagcaattgctgctactagggcaattgtacagtctgagcttgtttctcaagtataaatcccccaagcagaaacagagtaaaggaaggaaaccattgaacgctcaggcttcacagcacagggccctgtactcaggaccgaaggccttcttccagataacattccatgccagaagccagccttcctcagtacaaaagcctgcatctgaaagcccttctacttctgactcctccttctgggactgagctctcaaaccctgtcctgtcctcctctttcccttagttcatggaagtcccggatcactggccctatcctgcacccccatgtgcagtgcacagggctccccctttatcactacccagctatctccagctacctcttggctttaccctctagtcttgcaagagaagtcaattttgagagtggcccctgcagttgcctgtctttacactatgatctgtagtcaacatccaaatgccacttagggcccttcttggcctctctcatcccccaccccagctgtaccatgtagatgccttattcctttcatttttacctggaatccctccatattcgttccctttatgggtgctatgagaaaaatccctaactaaagcaactttaggaaggaagagagagaggtttatctggactcattgcttgcaggtacagtgcatcacctcaggaaaggacagtggcagacgcatgacgtgccgacacatggcatcctcagttcggaggcaaagagcaatggatgctggtgctcggctcactgtctccttcttattcagttcaggtcccagccacccatattaatgatggctcttcccacctgagtttagccagtctagaaactccctcatacatggacagaattatgcctcctaggtgattctaaccctatcggggcttgggtcccctcttgtgtatccatccataggaacccctccacccagcctgtgtccctcccttcctgatgcactttcacttttacagataccctcactttcttctgagtcaagccagccccccacagtgtttttttctataaaccccatccttcttttgcctgcttgtgacctccttcagacttatgctgagtctcctacactgctcccctctgcctccatccctaggacatctcgggctctctcttctctccctttccttcccctcccctcctctcgccctcttttcccctcatttctcacccttccttaccctttaaccccttcactatcagctgctccttaaacaaacccctaagcaccccccacatacacacacacacacacacacacacactgccattcctgtcctcataatctctgtattgccaatcccaatttcttagctaagtgacatacattggcttgtctgtccatagcttcctcattcacccttcttttccctcaaaaaccaaagaagggccagtgagatagctcagtctgacaaccgagttccatcaccagaactcactaaagaaggagaaaactatgtgtgcccacactccacatgtacatcaataagtaaatcaataaataggtgagagaatgaatgaatgaggaattagagataagctaggtgcatggtatggtggtgctgatctgtaataccagctctcagaaaccagagacaaaagattttgagtccaaggtcagcatgggctatataagcaagatgctgtttcaacaaaaaaaggacagaagaaactgaaccttttagttttgagccagtgtggagcaagtgcatgttgacatataataccagaactctggcggtagagtcaggaggaccagaagttcaggatcattgagccacatggtcaattcaaggccagctgatggttcaagattttgtcccaacaagcaagacaaaacaaaccactattgtgcaatccttggctctaccccatctctcccacccacttagcccacggccagaccccatctttgagaatctgaactccagcctgtgtgccttcagttgagtgcattacagctgcatgctgaccctcacctcttttcccattgtctatctggccccactcctaagtcatcatgctctgcatctacaggctcccaatgctcatgtttccactgctgctcctcttgggtgacatgtgattcaactcactatttagaccaaactggcctgtaacttagagatccacttgtctctgcctcccaagttctgggattaaaggaatgtgctaccacacccaactggtttttttaaaatactttttattaattattgacaattatttattgtgagcatagctgcacatgtatgaaagtctggacagcttttagtgtttttattatgtgggtcctgagggttgaactatgttataaggcttggcagcaggcgcctttaccccctgagtcatcttaccatccaatcttcatctgcatgacacctgctcagagccccacagactcatttcatcccttttcataaggggactcagggggtggtacttacacaatgccactgtataaacctgagggcctgaaggccatccctggcagccacataaaatactaggcagcgcagtatgtgcctgtctgtaatctgagtactagggaagcagcgtcaggaggatccctgcctcactgaccagccagtctaaaggagacacacgacatcgcccgtgttcacatacatgagcacacagatacagagacagcacaagagatccatgagcctgatatgtttgtagctcctggcttgttcagacagcccagagcccagtgatctggacacagcctacatcacttgctagggagacagcgaaacaatactcttggccctcaccacatctggggctgcacaggtctgcctcctgattctgacctgttcctgtctctttactcattcctaagcaagtgccagttcccagagaacacatgagtagtggccatggtgatgaattcctctccttctgccttcccttcatagaactctccatttctataagctttacaaatccattcagcttgcaacaatgtgatatctgtattacactgtaaaatgagtttgagcagacctggtgtgacttcatatggaatgatttacatgctaggcgaaaagaacttttgctaaccaactgctagttgaagactggttcttcttagaggcattatcaaattcagttcctgccagggaagttgttaaagttgtcagttccccactgcctgcagaacaggattcagagcgttaatgactattgacaggccactagtaaatggagaggttgaaaataaccacatatcttgcctttttcagcaccctgaagtccatggagtttgcaccatcggagggagcagggacacaggtatatcaccagctcactttgccctcagagtagtggcagcagatgttggtcactgctggcctctggggcctgcatctccacattgataagagagggcctcgattacagcctccaagtccttcctcaagagcatgtcactaactgagcctggcagtattcacctgttaagccagcactcgggggggtgaaggcaaagggggcaggagtctgaggctagcttcaatattccatgagaatattttttaaaaatgctaataaaaagaaaaccaagaagggcgaagggatgaattgatccttgctgggccttgaactctgtgcgtaaggtactggcctagtatcatgaagccctggtttcatctccagcactgatagaatatatggggcaaggttgcatggggctatagtcccagggctttgtagagacagatggacaaaagttcaaggtcaaccttggctacttagttcatttgaagctagccttgggtctatgagaccatctttaaaagcaataacaagacttaaccaagtgaaagcaaatcatctcagtaaagacagagactagtgtttgccaagcttctcagttagctctggggacgctgactgaaaacacagataaaaatacatctccagccatgcatggtggcacatacctgtaatactggcactcaggaatagaggctagaagacctggaactcagggccaccctaggttacgtagcaagtccaaggctggcttagactatgtgagaccatgtttcacatatacacaatttgtttatataaatcatgaagccagaagtgatggtgcatctgtaggcctgatactgggagactgcagcaggaagatcacttgagcccagtactctaaggctaacctaggcaacaaagcaaaaccaaagaaaagttttctaaaatgtttaaaagctacatcatgagtgtagtcttgttcccactatctagaaggcaactagcatcatcatggtggacaaaaatcaaacaaagacagattcctcgttgcttttgggcagagtgagcagcttatcctattgccaaaagatattcaggtatcaatagaaaataattgtcacctagaatggtggctcagcaattaaagcacctgtcgtgtccaaggttaggagttcagacccccagaactagtgctaggtatggtgatggcccacctgtaattctagccttggaaggaagagacaggacaaactgtctcttgcccagcaagctgctcgtaatactagccgtatcagccagctccaagtttgattgagagaccctgcctcagtgaataagtaagaggataatggctaagatcaaccctagggtctcaacatgcatgtgaacacacatgcatgtgtatatacacatatagacaccacacatatctacacatacatgaaaaattggggaaagaataatcataagtctaaaatctcagctaagtcgtttttgtaaagaacttgaggtttttttcccttgaggaagtcaagtcaatgacacatgtagcagagtcaggaaagctgagctgaggagcaggtgggttcaaggtggccgcatggtgacccctgctctgccctgtgcaggactctaccaagcccctggaggttttactcctggagaagaaccgctcgctgcagtccgagaatgccacgctgcgcatctccaacagtgacctgagcggtaggtggatgggcgccacacacattgtgcttggttccctttcaggggtcgaggaccaggagggtgaaccttgcgtctgggtttgtgtgtgcatgatgggagcgccgctgggtgaccaaaacttgttgaactaaccctgagtgtttggtgtccccctcccacactgctctgccccaccctgtcctgcagcaaaatgtgtgtgcgcgccacagcaaattggcagaggttggctaggtaccttattgaaaagtcccaaaagggacaacctgaggatgttggctttctgatcttttcctggttgtgctgtgaacaggccagaggtaaaaacaagcatggccttcctctgggactctccagggtatgctttgagaggtcgccggccctccagtggtgcttttctttctccgtacagttttctttgggggcactgtccctctcccatccttagcctctcatttgctcatcctaaaatggtggagtcactgactgcttttggatttagcagctggtcaaagtgtgtaactgttatctcgactccagttcttaaaatgtgtgcgccttcgatcaaggggttttaatgggtacgtctgccttggagcatgtagtgtgagcgaccctgtgggtccccaagtgtcagtgtttgctggtcaggcagggtccttggaggtcactgcgatgctagaagccccaagatctgtcagctctttcccgtgtgtgttaccggaacctttgtcaagggaattctcccggctgcaacgtacaagaaaggtgcaaacacgaatgcatgtggcttgttttggggggccttgtttggctgattcacaaattcaatcgaaaaacaaaccaacacaccactttggcccttgttttaaaaaaaaaaaattgaaaagaaaaatctgcactttttttgtggggcacactttgcattctggtcttggttttttttcccttttgaatcccccataatgcattctgtttgcccttccttgtagggtcagccaggagaaaagggagagaccagcctgagagtcggcgcccgggacccttgccggcctcccctcctcctcagttgccccgcaacacgggggaacaggtttccaatactaacggtacacaccacttctcaccagcggggttaagtcaagactttttcagctcaaacctggccagccccagcctacccctggcttctacaggaaagtttgcactaaactctcttctccagcgacagctaatgcagtccttctactccaaggccatgcaggaagccggaagcacaagcaccattttttcaacaggtccttacagcacaaactccatatcttccccaagtccattacaacaaagcccagatgtaaatggcatggccccatctcccagccaatcagaaagtgctgggagcatctcagagggcgaggaaattgataccgcagagatcgcccggcaggtcaaagagcagctcatcaagcacaacattggccagcgcatcttcggacattacgtcctgggactgtcgcaaggctctgtgagcgagatcctggcccggcccaagccctggaacaagctgactgtccgtggcaaggagccattccacaagatgaagcagttcctgtctgatgagcagaacatcctggcactccgtagcatccaaggcagacagagaggtgagacatgtccatgtgtgcctggcgcagtgctgtgtgcatgtgtgtatttgtgcgtgtgatgagacatttgtacatcacatcaggtaaagtgttcttcagtactaccctacccagagttcaaggatcagccagcggagctagaaaccattagctttgggaactctgaccttggaaagtgtggtcagcaccttgtgctcagtaaactcagtatctcagagctctgtctttagttagagggagttaggtcatgcatgtcgtctgacaggtttagcattcttgggtccacttggcatcaggtgctggcttccttccaagagcagctcctcgggtgccatccaactctgtcccaacagcacagacagctgtaatgcccacaaggcactggctctgtggagggagcctgtctgtccaagctgtcctctgcctccttccccttagacgagaacagatcttgcatcatttatgtccaattagtggggtttttttttatttttatagcaccacaaacaaaacatgcctgccttcaataagtcacatgagtttcatttaatcccccttcccaccacaccctgaatagaaagtcagacactcccacagtgtaaataatttcttccaccttaagaaccaggggtccctgagctgagtgaacagtgacacaagggacactgttttcagtcacaactgaagcaccctaaaatttagactaaaactcagataggagatgaggatcagacagtgagtgtccaccaagagtgtggcacacaccgagagtgtggcacccgctttggtgatgttacctgaaactggatgtctttggatgatcaatgtgagctctagccttgactggcaggcaaacacctctccctcctattgcccttcctagcagtgagtttagttggctctcctcctacagtagacccagtgcctgtaagaaggttctaggagcccccatgttgcacaggaagccttgagccctttctttagaagcaggcggctcagctctcatgtcacacagcccatgttgtcgacgccaccatccccctgattgttttgttcttaccgcacttgtttttcaacagagaatccaggccagagcctgaacagactctttcaggaagtaccgaaacgaagaaatgggtctgaaggtatgtctcaggcaggttttctctttgcagtcagtaacctaggaagcagcatgtccttagctgtgtatttgggttaaaactgtgcattgtaattctggcctggaacctggtgtgaaaaacagctagtaagtataaaacaaagcacgggttcaaaggcgcccagcctctcccctcttgagctgccaaagctagacaagctgtaggtagccaaggttagttcccgaagtatcagtcctaggtcagattccaaggacaccatgcctgttttctcagaagcagctgacagaacagttgtgctctgagaacaatcaggtaaccatgtcaaaccagatattgctgcttcctcatatttttaactctgaaatatctcagaaatctcataatgtggacagattccaaacaaggctggttcttccacaggtattggtaagccgactttaccatgctctttaaagtggttccttcccaaggtatcctcattattaaatgtctactgagaaaggcagagaacaattacaatgtctggatggcctccacaaaaatctgggcccaacccatgagtcctagtaccttaagggcatctgaatccattatctactatgcagagtactgccatgtgaccacaagaatacatttgtgtccttagggtactcaggaactcaacaggttttttttccttattgataaatttaaaaaaaaacacacattatatagtcataaatctagaaaggttgacatttcccctccccctcctctcttttcacctggcatatcccagtgagtgatccaggattgtctcacctagggctaggaatgttagctaagtctcagtggtagatcacttatctaaatggtcctagtgaagggacactgctcagtgggtaaagcacctgcctatgatcccccgtgagaggctagggtatggctcagtggtacaagagtggtactagagtctccaagtaaggaactgtggcatggcttagcaatagagtaattgcctggcatgcctatggccctacattcaattccccccccccccccacatacacacagaggagtcaggctcaacctttcaccgtttgccacctttccatgtttatttttaggaaaaataaatgtacagcacctgaatgtggttccaaaacaaagctttggaatgactaaatgactggttgcccctctgtactaactccatgggcatattttagttcagatggtaagaaagcctattctggccgggcagtggtggcgcacacctttaatcccagcactcgggaggcagaggcaggcagatttctgagtttgaggccagcctgatctacaaagtgagttcccggacagccagggctatacagagaaaccctgtcgggggggggggggggggttaagaaagcctattctgccaacacagtgaccatgactttgatacaggttcagcaagaaaccttccaggcatgtcccacatccataccacatccacaccatgagatcacatttgcagcaattagggatgagtgggagaccatgcccactttcagtcagtcgtcagcctcacccaggggacctgtgtcagaatgtcttggtgcggcgctggttttccacttgagatctggctgtgatgtcatcgctgtgacttctccctacaggtaacatcactacccggatccgagcatctgagactggttctgatgaagccatcaagtccatcctggaacaagccaagagggaactacaagtgcagaaaaccggtagggcttctacttcctaaagaactgccttcagacctaattataaaaatgatcatgagtgttctagtcagcaggaattacattctttttctnnnnnnnnnnnnnnnnnnnnctcccctctcctctcctctccaaagtgaccctgagtatgattccacacattaggggatattgagggaacggctatctagacttgtgcttcctctttcgtggggtcagggcagttgctttagtttttgtacttcagatagagtcttgctatatagcttgaactcatgatcctcctgcttctgcctcctgagcattagaagagactgtctttggtccctcagatacttctggaaatcattaacagaagttatgcttcccaattttggcaaaaccaagagaaggatggatgggtatatggctcatgagaattagtattttagcttaaaattctccaggaaagaagtccaagtggatctagggagatggctcagtgggtcaaatggtttgaagacctgaggttggatcaccagaacctacattaacagcagaaagatctgtaaccctgacccttagggatatggatgggaacagggggacctccagaatctcacaggccagaaagcctagttaattcaacaacaaagagactatcccaaacaacttagaaagacaaggaccaatacccaaagttgtcttctagcctccacaggagctctgtagcacatgtatgtttatatgcatgcatgtatgtgtgcatgcatgtgcacgcacacaaacacaaaagaaagagctacagaaatatggctcagtaagctaaggaaggtccttgccacctcaactgacagcctaagtttgatctctggcacccatatggtagaagagaactgactccagcacagcacacgtgagctcacatattatacacgtaaaattaatagccataattttctttaataaaaaagaaagccagggtaggagcaaggcgtgtccccaccaatcaccctccagaaagccagctgctgtgacaaaggccactgagcagcagtgtcagtcctttgtgttccctgctctaacaaggtggcatgaagcacatagctgccagggccacctatcataactttaccctgtgtgtgttccccacagctgagccagtccagacatcttccacgtccagcagtgggaactctgacgatgccatccgctccatcctacagcaggcccgccgggaaatggaggcccagcaggctgcccttgaccctgccttaaagccagcaccactgtcccagcccgacctcaccatcctcacccccaagcacctgtctgcctcacccatgtctactgtgtccacttacccgcctcttgctatctccctgaagaaaacccctgcagcacctgagaccagtaccgcagccttgcccagtgccccagctctcaaaaaagaggctcaggatgtacccacactggacccaccaggatcagctgatgctgcccagggagtgctgaggccgatgaagagtgagctagtccgtggcagcacctggaaggatccctggtggagccctatacagcctgaaagaagaaacctcacttcttccgaagagaccaaggccgatgaaacaactgcaagcgggaaagaaagggcaggcagcagccagcctcgggctgagcgcagccagcttcagggaccctcagcatccgcagagtactggaaagagtggccaagcgctgagtccccatactcccagagctcagagctgagcctcactggagccagccgcagtgagacaccccagaatagccctctgccctcttccccaattgtgcccatggcgaagccagccaagccttcagtgcccccgctgactcctgagcagtacgaggtctacatgtatcaggaagtggacactatcgagctcactcggcaggtcaaagagaagctggccaagaacggcatttgccagaggatctttggggagaaggtaagagacttcactgttggggacaggcatggcttcccatctattcttgggaatggggaccaagtgtccaccctgtacaatacaaccatcataggaatattaaatgtcaccaactcccaaaattctagaggccactggcaagtgtcctagccccctagctctgtctgctgagtcccattgtgcacagcccagcatgggggcttgtccaccactctgtgctatcctgtgtgtctcagctgccctgtgtggtagctggtaaaatgaacgtttaacacataaggacacgtagatccaggagtgttgactgcgtgtagcaagctggcagggcacatggaacagagagcacctctacaggccattttggccctcaaaggtctgactggatcaggctgcacaggggatggccagccttctgagaaccaaagcgcacatgggagtgaagcactgcacagagcagaactgctccacggtgattctgtttgatttttctgtttgtgtttgtttatttcacttaattattttaggaggggcttgtttttgtttatgttcttattttttgaggcagggtctccctacctatgtagtcctgccgacctgaaactccctgtatagcccaggctggcttcacactagcatgaatcctacctgtgcctcccacatgctatagtcatgggcgtgtgctgctgtttagctcctagtttttcctttctcgaccctgtgaggcccccagagacccgctcacagcttcacatcatctttccctggcttgtgaaagtgtaatcatttatggatgagcttctagacctatctggtggcagattcaggataacaggatttaccatgcctgtaaaatctaaaataaacataataacctatatcattagagattaagccatgaattgctgactataaagaggagcgctcccttcctgagatgacacaggaagtggatgagcagtagctattacctatcctttcccaccagtccttctgactcatcttagttagccttgaactcaatggtctgtttatgacctctttgccccaatttttcaagaagtaatgggggtgagtagacatgaggatgtgaattgaaagtccctggagaatttctagtttagcattgtaaaaataaaatttgtgaacatttaaatagacattttgtgctcccaccttaaatttagcagacttaataacgttgaatttgtttggcccatgagtgctgcttattctggaactggaaagctttgcagagtgatgggatgaggcccctaaatatctctgggctacatctgcgccctggggggtgtttgtgcccatacatatgtatggccatatgtgagaggcagcagcctaagtgtatggatgcaagtggtcggtcgtctgcagcccagtgctgctcccacactgactccctgtcctcaccagctttcttctcctcaacctgtaagcaggctacagtcagagagagtgaccctttgcaaatgcccctttagccctgtgtccgcacaggagcctgctttctgtgcccctccagtatcccaattcctgtgcactctgattccagtatcccagcctcttctgataaccccaagcaaaaaggaagatgctctgcaatgtttgttcctcagttttcaagatgacaaccttgcagcttctgcaggaccaagaccctggagaaagccaacaccttcatacccctttccaataagagctaagactatactttctctcttttgtttttgatcatgctgggaatgaaacccaggtccttgcataggttaggcatatccccagcccctcactgggggattctaggcagggcctctaccactgagccacataccagcccctcactgggggactttaggtagttgctaagccacattcccagtagaagatgtgattataataatttcttttgtccagagccctgtcctaggactttatcctatcagaaatctggaaaagcttatctctgcaaattgtctaggctatggttttgtgctcagaagaaaagaatcctcccatgtgcttcatctcctccattacgcacagggccacacgtacatctctggggcaccatgcagcatcatgctgatttctggaaactgacagctgcctttcttcctttgcttctccaggtactgggcctgtcccagggcagtgtcagcgacatgctttcaaggccaaaaccatggagcaaactgacccagaaaggccgagaacccttcatccggatgcagctctggctgaatggagagctgggccaaggtgttctgccagtgcaagggcaacagcaagggccaggtgaggatagctggccgccctctgcagaggcctggcagggatagctccatccatgagctggcttttggattcagggggaggatggtgttgttattgttgttggtttttattggggtaaggggagtggtaagatagagtctttttatatttctgagactaacctcaaactcactatgtagcccagactagcctcagactcactgtgtagccaaagctgaccttgagcccacaatcctcctgccttagcctcccaagtgatgaaaagacaggcatgtacccccatacctggctcctaagattttaggagtaaagaggatgagcctggctaattttataagcagcagaaaattgggtactgattaagaaaatgctgtttatatataaatatagataaaggtcaagtacttgcactagagaactgagaaggaaatctcgccagagtgacttcagaagaaagtgtcatgggcagaggcttctgctacctcgaatccagggctctgacacattatagatttatttgtgcaaccctcattccaactcagcatcctggccctcagcttgagcacaggcagcctccccccctggactcctgcttattcccttttcttttgtgcagttgggaagctccaagccctgtttcctgagtaacagtgtcttttttttccacagtcctccactccgtggcgtctctgcaggaccccctccagcagggctgtgtgagctcaggtaactagccacttgtgtttattgctagctccactgctctggaaatctggggtctgggagtaagtgtactattcctagccacagcaaacagtggcctctcccactttgccatactgcactctgaggctgttgtgtaagcagaatcagataagaaatggcttttgagaattggcttcttctattaggtagattgtccttgagatccactgaccttatatgtagcaatagtcatttattttcctgcctgggtagtattcctatggtgtggttataccaaagtttgtattgcattgaggctatccctaggttatagccattacacatagagttggcatgacagtaaaaagagaatgagaatagtgtcctgcttgcaaactctgaacttgctttctgatggcagtccaaaggttgacaggagcaatgctgctaaaattcatgcctttactggatcccttcattgttttgtaagtatgaagctctgtgtttgaggctggggtctattggaggcagatttcaggatcagggatcccattttagcagcagagacaaggcactaacatcactgtcccagtagtcatgttaagggacatcactttcatctggtggaagacctgggtaacctttgaataaggggactggggagattggagcaccagaatagagtagccaaaacagagcagtccccagaaaaagctagggtgaaattcaatggatacttagtgagggttttggaggagtgtagatgtggaccaagaagctccagccacttcctactgatctcaaagactggaaatgtctcagaagtatctgacagtccttttctctatgtcctgaggtccctggccacactacctacatgcatgcctgccctgaccacagccattgctccaggctctcagcactgcctccctgcactgagctcacagtcagccccgctttttctcccagctcccaggagcagccagcagcgtgagctgttcctttttcttttctctacttttctaaacatgttgattagtctccgtattccattgattcattgaaaacacaaacaaagctaagtgaggaacgagtgcaaagcctgtcagcttgccagaaggctgaggaggggacacatgtgcttggaggggaacagctgggcagctttagcagtagctgctgctgcaagatcccaaacacactctctccctctccctcctccacccctactcagccagtgtctctcccccccccccctctctctcacacacacacacacacacacacacacacacacacacgcacgcacgcacgcacgcacgcgcgcgcgggtagggggtgggttcgggtacaacagtgacttgaaggccgttgaaatcccctgaggatttcatggatttagtttggtccatattggacaaattcagaggaaattaccagcactctttttcccccagctcacactcaggatttaggaaggaatgtggccaagttggttgtgatgcacttctgtggatgtttatgtagtaaactgtcctggcctcctgcttcactgagaagtcagatcccaagcttgtcatggtagagctttcttgatgaaagcctttcactcctaaatataacactgagtgtccctcagcattgtgtgtgtgtgagtgtgtgtgtgtgtgtgtgtgtgtgtgtgtgtgtgtgtgtgacagcatgtgtgtcaaaatcagaggacaacttgtggaaattgtttctttccacactgtgggtcccagaaattgaactcaagtttaatggaaagcatcttacccactgagccatcttatgaatgccctccttttttcccctccaagacagggtctcatacaaccccagctggcctcaaactcactaggtagccaaagataaccctgaatttctgcccacccctcctgagcgctgggacgacaggtgtgcaccactgcacccagtgcatgtggtactagggattgagcccagggctttatcaactgaggtccatcctcatcccccaaaactgaaacgattctgtaatggtaggatttgtaaatccttgtgataaatgactctagaaaattctagaacctctgacagctttcatcattgttttctctaaagaactctgattcagagagtcccataaaattctgattttgccatagatactatggaactcaccccagaggtccccaactgagaaatattctctgtccctcatggatccctgacagctgtgcctagaggtatgcagcatggcctgctcggctctggacagtggtggacacgctttccttcctaggatgcagaaatgtgaaaggacctgccttccatatctacttggccagttgtaccttcagtaaggtttcctgggtcattgcagagcttaggggcctaaacaggggactctgtgcttggcaaagagcaaagttctggcttgggaacccttctccttgccaaagaatccccacccaggagctggggttgcagtttggttggtagaattcctgcctagtatgcacgtagccctgggtccgtgtccagcaccccacaaatctctcaggaataagagacagtaggaccaggagttctcatccatgctggtccttagtgacagccatataccccagtctctctgatgaggagactcaggttccaactgccttagtggctgtggccctttatatcatcaccagatatcatctgaaccttgaggcacaaaagaaatgtaatgtcattttgaacaaccagtgtcaccctatggtgacatgtgtgtctgtgtgtgtgcgtgctaagatcaaccttggatatcattcttctggagttgtcaaccttttcagacagggtctttcagcaaactctggggctcaccaactgggctagtccagctaaccagacagttccaccttcccaatgctaggattacaacatgcgccgggcggtggtggcgcacgtctttaatcccagcactcgggaggcagaggcaggcggatttctgagtttgaggccagcctggtctacagagtgagttccaggacagccagggctatacagagaaaccctgtctcgaaaaaccaatttaaaaaaaaaaggattacaacatgtaccatggcacccagcctttttttttttttgatgtggattctcagagttaaggaagcacacacactagttatgatctgctaatcctatataatacttcctttttacttcttaaaactaacttctcctgcacagttgcttgagctggtttatttttcagccactagagaaggagagagatgaggggtagctctgaagagacagaagggaccctctcatgatgacattcatcacagaaattgtggcatcctggagggctgcagtgagagctgcctgtgccctcagcttgggaacttgttgatacgggagcctttcatgactgaaactaacaaggtgttctgcctgtgcctttcatgctggcttctggcagatcttgtcagagtatacaagtgaaatgatggcccattttccatagattaggcacagagcactcagctttttcccagcacactgggtggtcaggaagagcggcttccaagtcctgcccacctatgaagaatcacgcagctccatggcgccactgtccatcaacagagtgtcagctgtcccttagaggggacagctgcttcaggctggctctagaatgggtagtcctgcttaccccaccctgctgtgacaaccacagctatgctggtgaggcccttggcagtttctcacagcatggtagccaatgccattatggtgtgcatcgtggcacttgcatgagctgctgggaagccctatcccaggagtttctcgtctccggcccaacagtgggattctgatacagtctgtccttgactaagcagtcagttcttagcatttgactggacaaaagaggtgacagagggtcagtggcagcctcagaaaattgtataaggctgaatagagtaggtaggaccttgtgggtacactagactcaagttacatttttccttctctttgctccaagaatatcatgagagcaactggttctatccccacagaaggaatctggctgcattcattcatgtaactgaggtttgtgtaaaaccagtataatacattgcacataacctcatttaacagatcaaagggaaaaggaaaactccgggttttcagtcagtaaagatcattccatacaaacatgaggaccctagtccaatccccagaatccatgtacaaagccacgtgtgctggtgcatgcttgtaaatcccagtactgggaaggcagagacaacagggtccctgagtgctaggtcaaggaaagattctgtttaaagaaaacaaaaaacaggtgagcatcagtacccatgattgtcctctggctctgcaaatacatgtgacatactcatacacaaagaaaaagacctgaaaatccatgagtgaactgaaaagattccacacatagccactgcctggaatgttagcctgtgggccatcaacttggtggcccattcaggtctctttttctggttggcagcctaccttggatcatttttattttattaaatgtagcatattatagggattctccctccattctgaagccaaagagggaatttctagatttgggctattgtgtggcacatgtgggcaaagatttgccaggttgtctctggtccatgaaaggtgatgggaccctgcaacaaaatgcttcagatagggaggaagcctgaatgcacaagaagcagctagttcagatgcctccttagagcacagagggaaggaaggtggtgaaagcatgctgttctctcttcctgtaggacaccgttgatgctgcctcattaatgttcaaggagcacgtgtgaccagaggacacagctcaccagcttcctcacaggcttccttatttatgtgttgtattagggactgagccacacctcttctccttgctgggggattctaggcgggtgctttaccactgagccatgcccagagcccttgaaagagagtcagattggtttctaaacagtggcttcccttgtactcatggaaagcaaccaggatggtatactgagtttagaaccagtgctgacttatcctgcctcttactgcaggtatagccagtggcaaaacaactctaccttcctctccttctccaggcctacctggactgtagggaagtctgagtctctgagtggtgctagttagccataatgcttctcggatatagaggcaagtaaaatttcgatgtgggctttccgggtaaggagtgtaactcagcaggagcatacgagaagccatagagtccatccccaacacaaggaaatgaatgaatgaatgaatgtatgttttcctttggtcaccattgcaacctcttgagcttcaaaagaatagttagaggtcagcattcagtgttgggagaaggagtctagaaacagtcttgctatcaaaggcaaacagtgacccagccagccaggctcttttgcttctcaggactggcactgcctggcctcacttttcagattcccatctggcccaggcatagcctcagccacctctcctccctcttatgcacacctactttgcaaaacaaaatttacagtatactgggcctttggtacaagagagagaagtaggtcataagagcatatgaggacttgggtctctaatgttccaatgtagggataaaataagaacctgaatgcagaaaactctcaggtaattttagaagtaaagtgggatgaaaacaaggcttacacattacattattctgatgtccttagtaagcagaacttccccttgtgagatttctgcttaatctaccaagtagcagaacttcagaaggccctgatcccagtggctggcactgacactgaggtaggtgtctgcaggagccagccccaggggccaggggatctagtctcctggacaaagctacatagagaaccaaggcaggcttcaaaacatcgtcagtaaaatgcttaccttgcaagaatgaagacctaaattccatccccagaacctataggatggcaggcaggacagggacacaagtatgtgatgtggcatgtgcttgtaatcacagcacttggagaggcagagacaggggctccctagtgttcactgggccagtaagactacatggtagactccaggttaatgagagactctgtctcaacaaagataggtggctcctaagaaatgacactagaggttaacctctgccttccatatatgtacctatgtagacacttgtgtgtgtgtgtgtgtgtgtgtgtgtgagagagagagagagagagagagagagagagagagagacttaaaaatggaaggtctcctatatgtgattgtgcccagactgaaaaaggggacgggactatagtgccaaagacagacaacacgaggctcaagcttacaaagtttacagtgtttagatgtacctaggctaggtggtagagggttatgctcctttgaaaccccttccagtctaaatcctcttgctgagaacagccccattcttaggctgctgtttcttcatccaagtcagaccccctaaccctatttgactagcccacaatgcatgctcagattcccccactggccctctctgggacaggtcaagtcaggaggcaacccagaagtatccatcactggcttcatctcttggattgtttgttcatccctgaaggacggggatcctaaatatagtccatgtctgaactggcagatgtggggttcatcctttacataaggaccaaaattagcctgtcatttggcacctaaataaagcaagcagactgccttcgtaccaactttgcaattaggaaagacgggaacggtagcacattctattggataagaagctcctgtggtgatcagggtaacagacttgaaatctagaagactgaacagcaaagcctcagaggttcccagggtgtcccttagtcatgtcgtctcactctgtttatttgtttgttcgtttgtttagagatagagtctcatttgtcctgagctggcctccaactctgctcagctgaggacagtttttacctcctggtcctcctgcctccatctcccatgcactgctgagattacaggtgtgcaccacctcacctgataggacgtgatgaggatatgtagtcagtccaagtactaaactatagccccagcctaacttgctcattcctgagtgaaggtctgtgttatttcacacgagtgaaaacatttcataaactcagggggaaaaaaaataagatggctcagtaggtaaaggtgcttgccaccaagcctggcaacatgaattcaatctctgtgacccacatagtggaaggagagaactgactcctgcaagttgtcctctgccctccatatgtgcacacacataaatacacaaagtaaatgaaagtgtagtgaattttaaaactaacactagggtagaacagcaacagccagtcagggttttgcaagaaaagaaaaggtccacccagcatgcccggagctgggttagtagagggactccccaggggctgcaggaagatgttataatcaattaccacatcataacactgatgtatgataattactgagtgtttctcctgagatagtacagcatttggcagggatgtggttccttcatggtccactgcctgattaatatgcaaataataggctgattgcatgatgaatgcagaaaatgagcccgctgataacaggcgcactgaagcggggaaatgataaattacttttactgactgtcctacattaagtactctttcccaacaatctcatcacaaattaaggaaagcagtatggcaagattaggaggatgtgtaaaattatgtaccttaatagcttttcaaacaaaggtgtctataaggaaaacgtcacctggttcctcatagagccaaagtagttcacccacctgagtggtcattaaaagacaggaagtagcaagtcacagctatgtgtgctgctggcttcccttagccatggaacagccttgctagctcagcctagactcattacctgcatcctgcctgagtggctttgttattgagtggggacaggctgcttggggcggttgcttcttcctgcacaggtggacacaaagctcattgcccacagagtgccatggggaaggagttttagagttgcagtcccagaaggcctgggaaggaaggacaatttgagactttttaaagatggggcatagtgatgcttacccatatcctacctttaggaggctaaagccagggaatcaaaagttcaaggccagcctagactataataacccttttccaaaaagaccacctttgacctggtctttctggaaaagtttaatttatagaacccacagtttggcaggggaggagcaggcaagtggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctggcctacgagcatgcacacacacacacacacacacacacacacactcgtaattaatctttgattacagcaaaacaatttaactagagagtttgtttgttccctgcagtaacatatatttagactgtttatgtggcatgcattttctcttaacatgaaaggattcactgatacgtgctcatacacacagctggctcagtaataaggttatcagaggtaatttgaaagccttttttctcgatggatatggtctgtagcaaggtgaacccagtgtccctgaagcacagcaaactatgtcacccaatgtcactcccacagttgtagcaagccatggctttccttctagacttgataatctgcagtggttatgacataatgctcccaagctctgattttgataggcttttttgtgacacacaggggctgaagcacagtaggcaaaacacatccaagaacctgtgttccatccccaagaccacagaaaacaggcatggcagtgcacacctatgatcccagcactggggagggtgggtaaataaacaaacaaacaaacaaacaagtaagtaaatagatgccaggtgtggtacatgtcaataatcccagcactcagaagctaaggctaaggtgtgaacctgaggcctgttcaacacaactcctaagaccccatttcctcttcaacaacttacttggtgtaaaaaggtgggcggaaagcatctctggaggagtagggcgccacttttacatggctatatctcaggtaccctatcctctcctaggcttgactgtcaccagcctcagctttaaggtggcaggtgcttccccagatcccccatcttcatcccagagtctttgttggtggaacctactgagtaatgtctctatgcatctggcctcaagctctgtgatttacagggtgctttcttatgcacaccccagcatgcagccccgcccagcactcagggtctccttactcagtgaaagtcaaatggctcaggagtggactaagagggagacatcagcaactcaagttaaataaattgattttattcaacaaccttgatttgttcataaagaatattagcctccctaagagttccttatgcaaatttaggaactcctattttcttaagtcctgtcattacacaaggatagacacagcagcatctactctgcagcagatctttaatgctatcttttaattatatttatattttaattatatatctatgggattatacatgtgcaccaccatgcctgttttctcaaatgtgctctgccatctctgctacatgttccgcctctgtgtatcccagataagcctatcagaagcagagattgggagctaggcagtggtagcacatgcctttaattccagaatttaggaggcagaggcaggtagatctctgagttagaagccaggctggtctacaaagtgagttccaggacagacaggtctacagcttgagaaaccaaaaatggaaaaataaaataaaataaaaagcagacctttggagcattaagccataatgactgctgaagtttagttcaagcctacagactttaaggtctagcacagcatctcatatattccagactttgaactcttgatcctcttgcctccacctcctgcccaacctgagtgctgggattgcaggtgtgcaccactgttgagtgcagtgctgggaatgagcttggcatatgctaggcaagcactctaccagctgagtaataccccagcctagcgctttcctttctgctatttgaaaagaaaggaatcctggtagatttcctgagacttaaggccaataggattggtgtgttaacaaataagcagggagatggagaaggaccagcttgagacccaccacagccatctgtttggctagattttcccagaggaaaggttgtccacccagcgcttgggaactggccagtgatagaagtcaaagcctttttcatgatgggaagtgtgtaggtcacccatgacacaagcttgcttttgttctttggctttgtgtattggttgttggtgaagaagtgtctgtcccaaagcacacggagaagagtaggcatggcaagctgggtcatgcatcagaatagcctgtattttggtcaaaacaacattcatgtcgcaaagaaggcaccttgcatttgtggctgggcttcctgcctctgcttccaagtggtaggattaaagataccttggtgacacatgactttaggaattttgggaaggccccagaatatctgtgagaatctgctgcttcagacaaagcctaggcacagaggcaaggccaccaagcagagctatatctatatctgagctagtcaggactgatattatcacatggtctatgccctgccctgtaacccacagggcccaaggagaatgcgcttctcacactcagtctgattgggagactgggtactctcaggatgtatggagcacccacattttcttggttgtgcatagcacagtttgttcatctgaaccaggttgggaagcaccccagtctggtgtcgctctcttgtgacttccaaagctgttggtggctatggaaaggtcctcagaactagctcttcaggctgccagggtgcatgctacacttagaatgtccgcactgagctccctagaacccagtgactgttgtccacagctactgagatccaggccttgctttggtttagtggcacattctctgagcaccctatctctagcctgaccatacctccctcttctggaacctgctccctgcattctccacctatcttccttagctgtcatgagagtcacttagagttgcctggcctggcacaggctcaaagtctaaactctggacataatgaaaagcagtgcatcagaccagccgccagttaagtaatgtttgggttcttgtcagaatgtcacagagtaccctgtcattttgtttcagcaacttgtccttctgaacgcacagttcgccgtatggcatgccagcagtaaaaatgtcacttgcaataattactttttggaggaaatgcttgctgacttcctaccttcaagctgttttttacacagtggggagataatcaaaaatgacttcatcctgactgctcaaatgaacactaaatggaatttgggttattaccgagatagagaagggctgggcgtggaaattgcagcagcggatcggataaactgcagagcgatttgtcttggaaaattggggcggatgtgtgttttccattggcttctattgaaagcttaaagcagctgttgtttagcctgctgtttggggaatataatatctttcataatccttttatggctcccaaacaccttgtgtatctctgcttgcatcaagccactgtccctgccctttgttcttcatagccaagctcctcctgcaagatccaaggtccacatacagaaaaagtgaatcctcacagatcacttgagtgtctgccttccgttgctgtcagatccccaaagcccaatgccaatgcctctgtgcagacccaggcctgcagcatgctaggccaatgtttaccactgagccatgcccctaacacccactggggttttaagatatgcaaattatccttattaattatcataggcctagggctgcttagactattgaaagcacgggtggttttgttggggaggtctgtctaatttctctccaatgcctagcagagtgattgcttttaaatgtgggtggaggagccatcaagatggctcagcagacaggaacacctgctacctagtctgagaaactgagtttgatccgtagagcccataaagtaggagaaatccaactctaaagttatccccgtatctccacatataccaaaatatgtacagacagacagatctggggggagggagacatgtatgctcacccaaactgatgcagagaaagaacgttttaaaagaaactttaaaaaccaaaaatttttaatatatttaaaatggatggatagaatcaggcaaggtagtacacagctttaatgtcagtgctctggaagcagaagtaaaagaattttgttatgaatttgaggtcaactgctctacttcatgagttctaggccagccaacaacactacgtagcaagaccttctctttaaaaaagcaaagatggatgaaagttagagatggggaatgggtaagtgcatggatgggtgcgtgggtaatagacacatggatagggcagagaggttgtcaggtcagtagtaggcaacattatagatagaagcacccagttttcccatccttctctggcaccatccaaggatatctgaccaggtggagccagctggtttcccagcctagagtgtgggcatgtgtccaagcagggttactaggagattggagcaagacactggccagtgtcctcagcacacagtttcatgcgtatatggttaaaaaataataataataatataattgtgtgtgtatgtatgtatgctttgagcccctttctccatccttgccatggattgacttctagtgactcaacactgtgtttgagatccctgctgctgacacgcgtgtgttgtagaaccactgcccagaaaggcctccagcagacgctcagtgtcacttccatggtggctgttgttacaagtggtcacaaagtagggttgctttttggcttggcttttgttggtttggttgttgacttggtctcgacggtgttttgttgtttgtttgcttctgtgcatatgtatatatggacatcttcatgtgaggttcacatgcacatggtacatgtggaggccagagactgatgacatgtcttctctgtcactctccacccttgtttttgaaacaaggtctctcactgaacctggagcttgtcaattctgctaggctgactagcttaggagccctaggtattgtctgtctccacccccattcagagctgctcttacaagtatcttccactgcattagcctttaggtgtttatgtgaggttgatttcctaattcattttattgcatttctttctttttgtgtatctggtatgtgctgggtacatgtatgtcacagtgttcctgtggaaatcagagagtaatcctcaggtatcagctctctcctccaccatgtgggtcccagggaccagacacaggccatcagactcatcagtcttcacctgctgagccatctcctgcgttctcagagatccaggggaggtcttcatactttcacagcagacactgtgccaactgagccatcttgttttgggcttttaaaaacagtctcactatatagccactgaaggcctaaaattcaagagccttcttgtcagccttcctagtactgagactgcagggtgccactactgcacttaacctcaggggaggcatgtcttccacagcacccctccaacagcacactcctctgaatagttcaccacatatcctgccatgcaagggactccagatatcattcagatcctcctaccacacctctttgaaccctctttgttctctcctaagttgctcttgaacctgcattcccatccaccttctagcctcctgcccagctctcacaaggacacagcaacaccatgtagcaaaagaagccctcagttcggtccccagttctacatacagcaggtgtgttggggcatacctacatatacatatgtatgtacagtatacccagtatgttcaaggccagtctgaactacatgagactctttttttttttttaacaacagcaataaataaaaactggactattcagctttctgtaacctgagactatagcacggtagtgcatgctgtgtgactgtgaagagacactctcaccaagtactagccagcctcagcaacttagaacagtgtgtcacttcttcagtagtggggaatgcaaagggatagtcctcctgcttgctaggtatacacctttatgtctgctgaccttgtgtagcatgcatgcatgcagggagctgttgagtgcaccaacaggagaaggactagcagctgcttggtgagatctcactcccagacagcaggcagccctgtgctgtctgttaggggggcagccatgattttgaccttgttgtgggttaaaggacacaaacctaggagaaatctgtttatcatgcttgggacgcatgctattcttgacagtagtcagtgagtaagatggatgatctgccaaatgggccctcgcatgggtgagtcagggcgagtttacagtacaatcttttgctgcttccacacacaaacaacatttgctaggttttagaccctgttgtctggtgacccaggggtgagtggagaaaagaaatctgatttacaggattcatactgccttaaagatggatacaggccatttctgcccccatacccatctcttttacatgtctcacaaagcagttcagttgttttcttaacctgatttttccaggccgagctttatgagatagtgggactttttaccaatttgagagcattacacaggcttattggattcaattgtggttctgtttcaggttttgttctttctaggtgctcatataaaaaaaaaaaaaaacttgtatttttaatatatgtcctactccctggatacaggagaggttattagcccaaatgtctagaaaatattctatgaggcttggggaagcagcttagtgataaaagcattggctgcctaagtgtgaggacctgagtttaaacccccagcacccacataaaaagccagatgtaactgcatgcctactgtaagccccatgcttggagaggcaaatacaagaggatcagtgggacttccaggcctccagtatagctccaggtacagtgagagaccctgtctcaagagaataagataatgaatgatagagcagggtacctgagcctcctctggcctctgtatgattgtgtatacctgcacatacacacacatacatgtatcatactcattattcatatgtgtatgccataaactggaagtaaagtcttccttcttgctatgttttattcagataacagtgttttcttttttgttgtctggttatttattggtttggcttttcataacaatagatataaaattcagagcactaaacatgctcagcaggtgctctgctactataccacaccctcagccaaggcaacagtattttgggctacctgcaactgtgctgaaagtgttcctgagggacctgttacagcttgagggagcagcaaacaagagacgacacagaaggtcctgcctttggactctagccaacatcaccagtcatctattagccactagaggaaatagctataaataagagcatttcaatacaattatcatcactcaggtatgctgtaaccacaccttgcctggcccctcacacgtggccctctggtgtattagcctcagtggaagaaagggaagagggtgtgccaaacacagaatgagaccacaggctgggtctgtggacaggagtcctcacacttccttctccaggctctctcactgtgtctttggagattaggatatgaccagtctttattctagtgccctcacaccaggctcaaggcagtgtgccaagcttcacaggtgatacttaggtgaagtggggccattgcttgctgtgttagttttgttgttactgtgacaaggtgccggatggaagcgacttaaagaaagtttattctggctcatggatccagaggatactgcccatcatggcagggaggttacggcagcaggagtgtgagctgctcacgtggcatccacagtcaggaagcagagcgaggtgaatgctggcactcagctcaccttctcccttttctgcagtcgggaccccagccggtggaatggaattgtccacatgcagagagcatcttcccacagcagttactcagcctagaaacctcacgggcatgcccgaggctggtcccctcagagactctgcctcctctcacactcagctggagaacagatggagcacttcccactgggcaccttcaatgactcccaacaaggcccaggctgtcctaaaggaacacatgattcctgatggtccccacaccagtttctttctggtgccagtcacagtgtggtctagatgagcaaagagcttgattttctaaagcaaacaagacccacacgccccatgggttgatgtgcaacaggcaggccacctttctttgtatccttcatccactagtctcagcacctctctggtaacctcacaaaaaagcattctgatcctaaggcttgagtctccctggaccaccagagaccaacagctaaggcactgggttcaagagtctttgtaaccagatgaccatcctggcttataggcaacccttgcctagaatgatctgtccattcctgcatatgcatgtagaagccagaggtcacctttgcctcccattccacaagcgccaccctcaccaagtatgccaagctgactggccagtgagcctcaagggtcagcctgtctcttccttcccagtgctgggattgcaagcatgggatttacaatgcctgactttttacatgggttctaaggatagcactcagtatccccatacttgcaaggaaacactttacctactgagctatctctccacctactgagctatctctccacctactgagctatctctccacctcctgtccatatttttgttctggaaaatatagaggaaataatcacatattagacccccagtccctctgaattaccagaatcatggggtttgattagaacaaatcatagcagtcataatgacatttttttttagcaaaatgccctgatattaagccttcagaaaccttttatttgaacctttagttgatttttttttgtctttgttggtgttatttttgttcctttaatgcagaaaaattagaggttacacttaatgaaaaaaatggcaaaataacacagtcccaaggtctacgacggtccccttctggaatgggatttaattactgtttcctgagaaatggaagtcggtgtacatggtaacagatgatagtttgagcagccattcttgctgtgtttaattctagaaagcactccaaagacctctgccagctgcagccctgcccctgagtccccaatgagttccagcgaatctgtgaagagtctcaccgagctggtccagcagccctgtcccgccattgagaccagtaaagaaggcaaaccaccagagcccagcgacccgcctgcctcagactcccagcccacaacaccgctgcctctctctggacactcagccctcagcatccaagaattagtagccatgtctcctgagctggacacgtatggcataaccaagagggtcaaagaggtgctgacagacaacaacctcggtatgtccccattgccagtttcctactagtcatttcctgtttgaagccttaaaaggatgagggagggaactataggctgagccagccaaaggctctaaaatctccatgcatccaacttttttacattgctacaagttgtcattcacaaagttcacaaaagaaattaaaaacagtttgattcccaaactcattcacccatattcatggtgggtaccagagcagagcagcttaatgctgcagcatcaggtaactttatggatgtcagaacaaggtttcctcctactttccctcactgtgactgctatgtatggggcaagcccttcagggatgctggctggatcctgccctgcacaggctaatgactcagtagctccaaggcccctgcctggcatcttgaagccatttaatcctgctgctgttacttctgctttgcagtcctgaggtggtcatcctctcagggtatcagccccaggccatataccttatacatgctgaagctaacctgggctctgcctcaagtgggctctgtcactgctggatggaagctgctgtggccctaagagtatttcgccacatttatgctatcatgcttcctcggggatgtatggatcagtcaagccctcctgggtgaaaaattgcggcttctctgcaaatcatatgtccccacaagtcccagttagaatgtcaatgaagagagcacactgagatggcccacagaatggccccagcagtgcagcaccttcaggaggggcctgtatgtctctttcccctgatacagcaggacaagaggaacattgctgttaaggctgtaagaggcagaactcagtctgtgaagagcccatgtagcactgagttcgagccctaaaacccatgtaaaaaatgccaagcatgatggtatgttcttaaccctactgtgggggattcttggagttcactagcctgacagccaacctagctgaagtacaggccagtgaaagaacttaaagaaaaacacaggatgaagcacaggcgcgtgtgcacacgtgtggaggcgtatacacacacacacacacacacaccactaaataaatataaaaggaaaaatttaaatgaaggtggactgtgcctgaggaatgactgccaaaattgtcctttggctgccacatgtgtgtgtgagtgtacacacacaagttgctactaagtttcagtgacatctgtcagtgacttctagtctggagtcaagcccagatgtcatcatgaacccccacatcccatttatgcaatgtactgtccaaaacagaacacaggaaaaaggaccatccactgagaacaattgtaatcattcattcataaaaagatgaaaatgtagctgctgatttgagaacagcccaaagcccatatgttcatcggttattgaaatatggaaggattcctacacttgagtcatccacttcttcacagacttgtcacgaatccaaggaagcaggccgatcactcctgctacccactcccagatagaaagcatccttccgtgtaaatgttgagaataacagaagaaaacctcctttcaaaccgccaagttttaagatcgcagtttagaaatgacaaacactggagcctcctccttggcatcactagccagtttccatcctcactggggagttagttggcacgggttacatccatcaagagcagtaccctgctggcctgcagaactttccaccactgcaaaggaccagttattaatctgagaaacttccaggaaagcctatagctcatcacctgggtttagcaatcagaagccccttggtagctctaactggtcttaatgtttataaggaaagttatctgccttcccaccggattcttgatatagttgggcacaggttggccagcttcaggctgcatcaagctgcagagacccctaggcaagtttcaaatccctacttaagcttggatcctggcatgttcaaacactaccactaagccacacttccagcccgtcactgggggattctaggcaagtgctctaccactgagctacaccttcaatcttgtaaattcaagttgggcttgttgttgttgttgttgttgttgttttaaaaaaaaaaaattttaaaccttaactaaatttggcttcacagtcaacagtgtttatagtgcatagtgccgcatcattttctctgggtgttcctgtagtcttttcagttcatagctgagggcattgccacagggagcataagccagcctccacagtttccagctgcagtgtggacttgacacattctttccagcatcctatgacccagatgctgtattagaccaacggtggcctttctgatcccagtctccacttccactcgatagcttctgtttactcaagcttttcccatcagttcatatgggtcataatcgactctgatgtgtaactttaagaattgcaggcctctgccctcacagaggaatggctttcacaaaggaagcaaacccctctgtagcatgtgtgtatatgtgttcacatatatacacatcagaggtcactatggactgtcttcccaaaaacctgagtctttcagtgagcctggagcactgtgagggctggactggctggctgtcaagttgcagggatcatcctgcctccccctccccagcccaggaattacagccacagactatgtgcccagctttttatatgagtgctggggttctagctcagctcttcatgcttgcatgctaagggctttaacgatgagctgtctctcccagccttcaagcccttcttttaagcctatgacacagtacaggcttggatgcctttgtgccttccacagccacctgccttgtgatcagcccaaggcaaggtgtttactctgcatgggagaagaatccagggaaggtttgatcttctctgaggtacactcagcagtggcagcttaaactgcagaagccagtactatcagtgagcctttcaaatggaagcttccagactcctcctccctgctgtaagccaggagtcaagtgcctatttgctcagaagccccttgaccttgctaatcacatgcctgcttggcctctggtagaagatgcctgagagtttagcagctgccattctactctctgggcctgtgtgggggatttcactgagtctgacagatgctgcaagtgtctaccctcagctcacctggctcctggaaacttttcttttaattttttttcctgaggctattgatagtttaggctaacctggaactccctatgtagcccaggctaacctaaaactgctcatccacctgcctcaatgtcccagtgctagaattacaagtatgtattgccatacctgctacgtggatgcttttctgaaagcgtagtcatttgtcacatacatatagaatgtaagtgtattctaatttccttgccaatgaagttgttagaagacaagtgaaagaaatgtttcagtactgaagctgccaccctagggtagagcacctgcctaggatccaccagcaagtggccggggtatagctcagtgataagacttctcatctcacatgcacaaagccctagggtctatctccagccatgtaaaaactaaagaaaaatacttatacatgttgctgtaggccaggcctccacaatcgggattattgaaccctatgtctaagttcaggttcttgttgcctgcttgccctctgtctgtcagtgaccatctctcacatctgctttccaggtcagcgcttatttggggagaccattttggggctcacccagggttctgtctccgacctccttgcccgcccaaagccttggcataagcttagtctgaaaggacgggaaccctttgtccgcatgcagctatggctgaacgaccccaacaatgtggagaagctgatggatatgaagcggatggagaagaaaggtacccacccaggcaccacctcactctcatagacgccctttctgcaaatcttcccacagagatgggggatgtgggtcactgatccttcatccagactctgtaaggcagggcaccatagtttaaacaagtttcagccagtgagtagctaagaggacaaggaagacttaccctctttggggccaaaagtctataaataaagatctcatgacccttgggtgcagcacagtctgtgataatggcttatcttctggctgtcttttagcttgtctatcaatcatctactgtgtgtgcacctcatgctaaaggcccatgaagatgttaagagctcagtaagaaatgtatactgatggacaaggattgtagcttgctcgacaagcataagacctgagttaaaccctcagtactatgggaaataaaggagagcctcagagtgctcttctagccctgggtataaagccctgggctccatcccagatcctgaggagcagggaggagagctgtcattgttgatccattttgccaaaggtctgccacactgggacctcagggtgcccctgcccatcagctatgagccgaaacagtagctctccacccatcgagagccacctcaactatagctcatcctaagacatgacccagtcgcataccctccagggcagctccaggcaacaccacatacttgaaaagcctagtgacttcccagtttttttaatttaaattatgttaaatttcaatcaaaaatacaaagagtggtatggaggacctactcgacaagtcaggtatagggcctttaaaagccatcactggggaggctgaggcataaggataggttctaactcagttgttcttagcatgcacacaaccctgggtttcatccccagcagcacttacacctaggaagcagttttaatgtcttttaatggcagcattgggagtggaagcaggaggatcaggagttcaaggtcatctttggccacctagtaagtctgaggaactcttagagagaatgaaaagaagatactaggcctgcctgagctacagagtgagtagaccagaccaagcaatgtttgtgagaccctagctcaaaggtaagaagacaaacaaaagaagctagtaaccactgctgctgagttccaccagtttctagtacttaccaagatagcattaaggtaccccactccctgtcaaagccaagatcacccacctaaggtatgacgcaaggccacctccaaagcatttccctgtcccttcagatgtccacagaaaggcttgttcatcccctctttttcccttcgccaccccaaattaggcggtccagactttccgggcctctagcttccttccatatgggctctggtgccatcttgtgtcacaaaagtgttactgtctcgattgaaccccgaccatctctaacagactggttggtgcctttaacttctgtggggtctccagtgtcactccccagtcctgatggccccctccatctccttcttaatacttccttcccatcacctgccttaccccaatctgcttcctaaggtgatcaaaagtagtactgcctttaccccacaaccccatctctgtttccatctgtcccttcctcctgtcagtctagccacctgggttcctccccaatgctttctccaacatctctctcctcagcttagagtttgttctttatcttgtgaagaatggttgggattgaacccaggaccagtgtgcagtgacttcattctctaccatggagccacactcatgtcacttcccatcaggaagtcacttgtcttactgctcttcccatttcttcctttcccctcccttccctgcctttcctcctttctctactctcctttcttcccctctcccttcctccttccctccttccttcccccccttccttccttatctcctcctttcttattaagactgtagcccagcatgatcctggcctgacaatccttttgccataatcccctagggcttgccttttccctgttcagcgtccctacacagcacctcctctggccacccttgctccctccctccagtcaggctctcagcctttgctgcccagcaccataggttcactcccattctccagggcctcagtttccccacattatcaagtccaaagtccagcctggccttctaaacattcctccctatggtgctagatgcctttggctgtccatgcccttgagattcttcagccctttctgtaacaccattggcccctggctgtcctcatgtccctaggcccttcttagcttctctgtgggaatgttctgtgatgttccatgttgatgaactcttgcctcagtcactgacttctattatcattgtcttctttcctttctaaacaattctacccactctttctcttgacagggtctcacgcagtccagtgataaccttcatcacctgatcatcctgcctctccctctcaagtgctaggattacaagcacccaccaccttggcttgggtttccattttctaaacagcctcctgccatagcccattttttctaatggctatgcaacatcattctttgagatgatcttgaaatatcctcttttctgggaagtctctcagccctctccaagctttgtctagtgatctctattagaactcctctcaggtgcccagtgcctctgccagcagggtattcaccaagctggatctttctgcagccctcaagaaactgtcaggttggacagggacagctaggaacccacatgacatcagagttgtcctcagtctatgctgaggacagtgtggttccactgcagggttttatttgggggcttttttgtttaggttatcctggtttcgtttggtttggtttttgaatgctaggactcaaactcaaggtatcatatgctagacaagcactctgccattgagctacagcccagctatttggttttggggtgtttttccccccactctaggtcttagtatgtagcccagactggcctcaaactcatgatcctcctacctcagtttcctcagtgttgggattacatatgccctaccacactcagactatatgttttcagcatcctgttttgttcccagggctgagactttgagctggtttgccagctgttcctgaattcacctgttgttttttttttgttggttttttttttttctctctctcgccctgcagcctacatgaagaggcgacacagctctgtcagtgacagtcagccttgtgagcccccctctgtgggtattgactatagccaaggcgccagcccccagccacaacaccagctgaagaaacctcgagtggtgctggctccagaggagaaggaagcgctgaagcgagcatatcagcagaagccatacccatcaccaaaaaccatcgaggaacttgccacacaactcaacctgaagaccagcaccgtcatcaactggttccataattacaggtaaagccctagcaagactcccaacagcaggacctatgagaacccacatgaccaaacacagtgtagccttggctcctgaagggagaccccaggccaaagcatgcagtgtgaacagctggggaagggctggtgtcccagtgtgcatgtgcatgctcgaagtcagagggactctcaggactcaattctctccaaccaccttataggaccttgggatggacacagatgtcaggtctgtgtgcacagtgcctctgcctgctggttcacctggtggtgccatcttcattttagacaggatctcacttactatgtagctttggcctagaatttgctatggagaccaaactggccttgaacccagagatctgcctacatctacctcccaagtactggggttaaaagcctaaaacaccacatccagccctagggtctttttttaaaaaagaaagctaaggactagtgggatgtcttagcaggtaaaggtaccttccacagaacctgactaccttgattcccagccccacacaaagaacaattcctgactttacacacgtgccatggtatatacatgtcctcaaccacacctacctcacacatgcctgcaagaagtaaattaaaacaaaagcagcaacaggacccttcagaattaacctaggtctggggtgtggcttggtagtagtagagctcttgtccacaatcaccctgaggagctgggggtgtggcacagtggtacagccctgcatggacaaggccctgcttaaatcccctacaccctccaaagcctactttcctgtatagcttttctagatatcaaatgcagggctgcagcagtgtagctcagtgggagagctaagcataagtgttccatcactagctgtcaagtacattgattagttaaaattaaaaatataatcccagtacctaaaagacatcaggagaataaaaagtttcagtctaacctggactacagagtaagctcttatctctgaaagtaaataaataaatgtatgtcctccacccagactcaagcccagaatcactattttaccaagacaagtcccacaaacccacaaaggcggctggcgtattaggccagatcctatgctacccttttgccacttccagccgtttacctctgctttactgactagagcaagcttccttcactgcaaaggccctgtaagaactggcatggcagtacacacctgtaaacctagcacctaggagactgaggtaggtagttctaggccaacctgggctcagagagagagagcttgagagcagatgaactcagaagtccacatttgtttatctaagctgcagctagtaaatggcaacgccaaatctcaaacccatcatacttgcatcctatttgtaagacttagcttagctacccacctaacctgccacctgctgactgggtagagcagagctcggtgcctaccttgctgccatgaggctcgaaaacagattgtgagcagagccagcaccaggggctggtcctctaattctcaagttcctgaagctacccaaggaaagctgatgcaacctgggtatttctgggacctatcagaacctcacttttctgaatcacagctttaaaaccttcaggagagatggttcagcagttaagagcactggctgctcttccagagaacccaggtttgtttcccagcacctacatggtggttctcagccatatgtccacttccagggacataacactctcttctggcatccctagacaccaggcatatagtgggtacacatacatacatgcagacaaagcactcatacaaaaataaggaaaaaaaaatttttttaaagctggacatagtggctcatatcttaaatcccagcacttgggaaggccagcctccttccccccaaaaaacaatctttaggacaaggttcagatttcattctagcatggacaagtaactatggaccaggtagactactatcctaaggttctcatatgttgaactagacccataaccccaaaatcaagcctaggacctagctgtgcattcccttagctataccttatagtgcagccctataaccctagctcttcaggaaggtgaggcaagaagactcaaaattaagggaaacttagaaagaccatgtcttaacacctaaaagctcaagaaatgttggggggatataacagcacttggctagaatcagccagtctggagttgagggcatggctcagctgacatgtctgcttggcttaaagcccttagttcagtcctctaatatgggggtacagaataggggactccctcattcagtaatagcatgaacagataaagaagtcttagccatgtccagccctagggcccactttctgcaggacactgggcttggtgctaattcacccaaagatgcttttctaactgtggacatttgcttatcatgcacacctagacagttgactgactgagcctaggactatgaaagtgatggggagttgagagggcaagctctacttaagggctctgtgaaggaagcattctgtcctggcattcagtgtctcagcaagttacctgcgcacattcccacctaaagctgggaaacactacattaaaaaacttggttggggctggagagaagactcagtggttaaagagcaccagctgctcttccagaggacctgggttcaattcccagcacccacatgtgttcacaactgtctgtaactccaattccaagggatctgagacccttacacagacatatgtttgggcaaaacaccattgcataggaaataaagtttacaaaaaaattagttgaaactaggcatggtagtccatacctttgatccccacacttgggaggcaggaactggcaaatctctgtgagtttgaggccagcctggtctccatacagcgagagcaaaagtaagactatatctcaaaaaatatataaataaacttggttggagtgctggagggatggctcagacattaagagtacttcctgctctctcaggggacgttggtttgcttcccagcacccatatagtagctcacaactgccataactccagtttcagaagagccattgccctcttctcacctataagggcaccatgcacacatgtggtacacacagatacatacaagcaaaacacccatacacttttttttttttttttttttttttttgcttgatatactaaaagcacatacttaggttccttccaacttgatcagctgactcctcagagttggtagtcagttgagggtacaccattgggcggaggcctgctagaggcccctggcctgtggctcacagctggagttacaagactcccaccttggactacatccaataattggctttccgctcacgtttcatttaagtcagtaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatcgaatgggagttctgagggcgccgggcctccgggcctgaccagcagggcctcgccgggccttgccgggcctcgccggccttgccaggcccacctgcgcctagcaggtcccctgggcccagtcagcaccggcagtgtgggctggggctggcgggtgtgcagggctgtgccagccgaggcctggacgtgttgcgcacttaacgccctgcgggccacagggcaaaatcgccataggccaaggtgcatatagaaaacaaaggagcattaagcccaatctatgtcgtgttttcaaggaagaaaacggaaatgtgtagtcaagcttttttgtaccctgaagtgtttttttttttttttaaattgccctaagtgatttccacaggttctggaataactctttacagcttttgccttgtgccctcctctttcgtgtgggctttaaaaaaaaaaaaatcaaacccacatattaaaagggggctttttatctgccatctaatggcttcagagcgataatacactattatcttcttaaaccaggaaggggggggattttttcagaaaaattaaaaaaagaaagtttttgtagctgttcagttgccactaagagattgcacagtcaaaccgactctaaacacactagtttggattcctaaatattttcaagaaaagaatcttctcgtttgaaactttgaattaaaataaaacacatttactccacatattttttaacaaaaaaagaaaaaaaaagaaaagtcacatcaggaaaagtatctgattttgtggtagctgatgtagtgttttcttgtacgtaactagaatcctgacatgtagtgcacattgatccatagctttaactgactctgggcttttgctggccagagtttgtttaatacactccattctaggccaaatcaggacaaaaagaaagatccgaatctaggtattttataatctgctttttaacctctaaccgcagagcacgctgatcagacctcatatctcggaggtttaggagacaagttagaactgtagcatgtaccggttcattttgttttatttatggtgtctgtctgtgttggcacatctgcgcatgtgcaagcgtcgaacggaaggaaatgtaggcccgcaaggtcgcagcagttagtcccgcacgtgcaggccaccgtctgctcatctttccttggcacagaaggcacctcacctcatgccactctccagggcacctgacagactgagccccccaccccccaggggaagatgttccctatgctcgggcagggctggcgcagctctgcgtgcacactctcttcctttctcttctcatccccttccttcccaccacaagcactgataaccctatgtactcgtgggaagcttcctttcctgcagaagagagaacgctgcagtctgggctctattcccatccctgtagagatggcccaaactcaccaaaatggtgacactcttcaattccagaccagaccattggcccttcatgaatttcttctctcacaatgtttttttaatgcacagtttagggcaatctaagtacaaatcaaaagtctaacttgtctcttgattcctcccgttgtctatgtgtatatgcgtgagtatagaggtggatgaaagtgtgcgtgcgtgtgcgtgtgcaattttatacgtctgtgtattttcttaagtatctgtgcacacatagagtgcattactgccacctttttcaataagctggtttatcagtcatggcttctacaggttttgctaatttagactccttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagctgtagctgtcatactgtatattactgatggaaaactttttgaccgtattgtgtatcattgaaacttttgtcttaggtcaacatctttggatgacattttaatggtgcattcattatttcttaagtttaattaattaatagtactttttttttatttgggagggtgggagggagttctaattttaaaggcatctcccactattgcccctcagtgtgcgtgttattccttagcttgtaggctttgactgtcagatgtgaaaccacacttcttgcatgatgtttggagcttatgtattttcattcacagtctttcaacctgcagctgcaagcccttagttggagttttcacaaactgtaagagtcacgacactaaagacaatgccttttcatgaacgagaagtttccaagaggctctaggaggctgggaggcaggcccctggctctgtctttggatggttgtatcactcctaagcttgagatccgggttcggtgagaagagaattcacagtggagggacggaagggaaacacagagtcccacctggctctgtgcaaggaagtactcattcacaccagggagtcgttagggacacggaggagcagagtgggattgtgccactccctccacagaaacctcaagggaacctgtcatcatgggtgatgatcttaaatacctaactttcactagagtgagaagcagagttaacaggatcgaggagggtagtgtgctagtttcaaaggcatgtctgttccttaaccgcagccttaaatctgcggaaatggaagttgaggtttttttccatcctgacacccacacggtagcagtgtaagacagcctttgactcttccaagcaagtttctttaatttttgaactaggttcttattaatttccatcctgtctcttgtgccagacctccatctgggtgcttgatacaatcacttggttaggtttttgcttgagttctgtatttgtattttcttatttattattattattattgttattattttgagatcccaacttgatggtgtttggggttaagttagcactgtctgtagtatgtctaagagctgccagtagataacacagaaacctggggggttatatctgcctcctcatcatgtcctccctcccttcccagtgtgagtccaagggttcatctttcatcttgaaaagcaatattcaagtgccttgaacagcgctccctcatgtggtgaccttccgctggctggagatccaagcagtagctcccacagacagccaaccatcctctttatactctcagcttaaaaagctgaattgtacttctccccaaggggaaaaaatggttccatataaaacactaacacttcatcacaagccactgttccatttcaaatgcctttttcttaattagaggcagtaatcctaactaggccattacccagttggctaagtgggagcctggtgtaaaatccatgttcacatcaagccctcttgacacctcttgattcatgccaagtccccttatggcatccgaagtggcaggaatatgagttcttagacatctgcccactcacttccactctgacctggctcccaatcaccacctccttgaaacaatagtcagttgagatgtctgaccactgtgtactagacctctctctttaaaaataaaattaaatttataaatgcaggcacttagctgaagtcgatatcttcctagctagccaccctgaaaaatatcacaccttgaagtggcttatcccgggttcgaatcagggcagagtcctggggatatagtattaggtgctgggccacaccactctgaaaaatgaggcaagaggacagctgtcagtctccgtgcacagatgcttctgcttgcaaagctcaggtgtccgtctccttagtaatcttccctctgatgggcatctctttcctccttgttgaaagtcagatctggtagatggctcagagtatagcagggctgtgagctgagtgttcctctggactcttgtggccaacagagtccccgcctgtggccatgccatagacctacatggccattcttctctacagccagggccatgttgagctgtggagcttataagcaagctcagcaggaggcagcccgcatctagtgcaaaggaggcatgctctaggcatcagctaagcacccaaggttgtgtagctgtgaaagccccagagctggggagtccaaatgctgatgctggagatgccctccctgcctcagcaagactggctctttgtcctttcggagctgtgttctcttacagctcggtgggctctagggacccttgggatatatgattcccatcacatgcttctgctctctgtcagatccctgaggctgggagccatccttgcagaggagatggggtagagcaaaggtcaagaacacattgagggaatggaaggctcttggctttgttcctcctgtccttcaatgtctcccctttctgttctcttctacctcaccacttgatgtcacccagaattgtgagggaagtgacctgggggtgggggtggggggaggggtggcttaagaggctacaagctagaccgatcatctcatcttgcttggcaggtgtgctttttgcctccttcaaagaatacatccagaagtggtgtctggagtctgctaagcacaggaattttcctcttggcttccagctgttcttgaaattccagcagctgttgggtctgtagacaggagtggtctccagcctcagaaattcttgccttttgctctgccttcccgcacagctgtcagactccatcacagccattcctttggtcttggcttatccccaaatactatgagcacacttccccaggaactgtggctgtccgagtctctcgtccctagaccttgccatgagctctgctttacaaacacagctctgtccaggacagaaaaggttggacagaattcttccccatgcatgcttggtctctacttcccaaaagaacactccagtttctgttccctgtgggaggcaagcagctcccgagacagcagtgggtctgggccatactgctccagagtgtacctgtagcacgtagggaacttttattttgttgttcccatcatgaatgtcaaagtcactaggcacagctgccactgcagattttctgaaactgaatcaggggaaggctttatggccactttaacccaggtgggctgagactctcaagtggctaggttcctaccagtagacttggatgctaagagaatgggctgatgagaaattttcattctgcccatgctttttagatggaaagtgagggtaggaacaagctccttagtaaaagatacaaccccaagacctcaggctcagccagtggaagaagacagttgaacagcaagggaaaagccaggatccccctgtgtaccgcttaaggacctgctgcttcaccgaacccccgccccacc

SEQ ID NO: 752 - DNA, 3495 bp, Mus musculus
aggagtttgctgaagtgaaaaatcaagaggttacgataaaagcacttaaggagaaaatccgagaatacgagcagaccctgaagagtcaggccgagaccattgctctggagaaagagcagaagctacaaaatgattttgcagagaaggagagaaagctgcaagagacacagatgtccaccacctcaaaactggaggaagctgagcacaaactccagactctgcaaacagccctggaaaaaactcgaacagaattatttgacctgaaaaccaaatatgatgaagaaactactgcaaaggccgatgagatcgagatgatcatgaccgaccttgaacgagccaaccagagggcagaggtggcacagagagaagcagagactttaagggaacagctctcatcggccaaccactctctccaactggcctcgcagatccagaaggctccagatgtggccatagaggtgctgacccgatccagcctagaagtagagttggctgccaaagagcgggagatcgcccagctggtggaagatgtgcagcgactccaggccagcctcaccaagctacgtgagaattccgccagccagatctcacagctggagcagcaactgaatgccaagaatagcacactcaaacaactggaagaaaaactcaaaggccaggctgactatgaagaagtgaagaaagagctgaacaccctgaagtccatggagtttgcaccatcggagggagcagggacacaggactctaccaagcccctggaggttttactcctggagaagaaccgctcgctgcagtccgagaatgccacgctgcgcatctccaacagtgacctgagcgggtcagccaggagaaaagggagagaccagcctgagagtcggcgcccgggacccttgccggcctcccctcctcctcagttgccccgcaacacgggggaacaggtttccaatactaacggtacacaccacttctcaccagcggggttaagtcaagactttttcagctcaaacctggccagccccagcctacccctggcttctacaggaaagtttgcactaaactctcttctccagcgacagctaatgcagtccttctactccaaggccatgcaggaagccggaagcacaagcaccattttttcaacaggtccttacagcacaaactccatatcttccccaagtccattacaacaaagcccagatgtaaatggcatggccccatctcccagccaatcagaaagtgctgggagcatctcagagggcgaggaaattgataccgcagagatcgcccggcaggtcaaagagcagctcatcaagcacaacattggccagcgcatcttcggacattacgtcctgggactgtcgcaaggctctgtgagcgagatcctggcccggcccaagccctggaacaagctgactgtccgtggcaaggagccattccacaagatgaagcagttcctgtctgatgagcagaacatcctggcactccgtagcatccaaggcagacagagagagaatccaggccagagcctgaacagactctttcaggaagtaccgaaacgaagaaatgggtctgaaggtaacatcactacccggatccgagcatctgagactggttctgatgaagccatcaagtccatcctggaacaagccaagagggaactacaagtgcagaaaaccgctgagccagtccagacatcttccacgtccagcagtgggaactctgacgatgccatccgctccatcctacagcaggcccgccgggaaatggaggcccagcaggctgcccttgaccctgccttaaagccagcaccactgtcccagcccgacctcaccatcctcacccccaagcacctgtctgcctcacccatgtctactgtgtccacttacccgcctcttgctatctccctgaagaaaacccctgcagcacctgagaccagtaccgcagccttgcccagtgccccagctctcaaaaaagaggctcaggatgtacccacactggacccaccaggatcagctgatgctgcccagggagtgctgaggccgatgaagagtgagctagtccgtggcagcacctggaaggatccctggtggagccctatacagcctgaaagaagaaacctcacttcttccgaagagaccaaggccgatgaaacaactgcaagcgggaaagaaagggcaggcagcagccagcctcgggctgagcgcagccagcttcagggaccctcagcatccgcagagtactggaaagagtggccaagcgctgagtccccatactcccagagctcagagctgagcctcactggagccagccgcagtgagacaccccagaatagccctctgccctcttccccaattgtgcccatggcgaagccagccaagccttcagtgcccccgctgactcctgagcagtacgaggtctacatgtatcaggaagtggacactatcgagctcactcggcaggtcaaagagaagctggccaagaacggcatttgccagaggatctttggggagaaggtactgggcctgtcccagggcagtgtcagcgacatgctttcaaggccaaaaccatggagcaaactgacccagaaaggccgagaacccttcatccggatgcagctctggctgaatggagagctgggccaaggtgttctgccagtgcaagggcaacagcaagggccagtcctccactccgtggcgtctctgcaggaccccctccagcagggctgtgtgagctcagaaagcactccaaagacctctgccagctgcagccctgcccctgagtccccaatgagttccagcgaatctgtgaagagtctcaccgagctggtccagcagccctgtcccgccattgagaccagtaaagaaggcaaaccaccagagcccagcgacccgcctgcctcagactcccagcccacaacaccgctgcctctctctggacactcagccctcagcatccaagaattagtagccatgtctcctgagctggacacgtatggcataaccaagagggtcaaagaggtgctgacagacaacaacctcggtcagcgcttatttggggagaccattttggggctcacccagggttctgtctccgacctccttgcccgcccaaagccttggcataagcttagtctgaaaggacgggaaccctttgtccgcatgcagctatggctgaacgaccccaacaatgtggagaagctgatggatatgaagcggatggagaagaaagcctacatgaagaggcgacacagctctgtcagtgacagtcagccttgtgagcccccctctgtgggtattgactatagccaaggcgccagcccccagccacaacaccagctgaagaaacctcgagtggtgctggctccagaggagaaggaagcgctgaagcgagcatatcagcagaagccatacccatcaccaaaaaccatcgaggaacttgccacacaactcaacctgaagaccagcaccgtcatcaactggttccataattacaggt

SEQ ID NO: 753 - protein, 1165 aa, Mus musculus
  VARIANT (1)...(1165): Xaa = Any Amino Acid
EFAEVKNQEVTIKALKEKIREYEQTLKSQAETIALEKEQKLQNDFAEKERKLQETQMSTTSKLEEAEHKLQTLQTALEKTRTELFDLKTKYDEETTAKADEIEMIMTDLERANQRAEVAQREAETLREQLSSANHSLQLASQIQKAPDVAIEVLTRSSLEVELAAKEREIAQLVEDVQRLQASLTKLRENSASQISQLEQQLNAKNSTLKQLEEKLKGQADYEEVKKELNTLKSMEFAPSEGAGTQDSTKPLEVLLLEKNRSLQSENATLRISNSDLSGSARRKGRDQPESRRPGPLPASPPPQLPRNTGEQVSNTNGTHHFSPAGLSQDFFSSNLASPSLPLASTGKFALNSLLQRQLMQSFYSKAMQEAGSTSTIFSTGPYSTNSISSPSPLQQSPDVNGMAPSPSQSESAGSISEGEEIDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPVQTSSTSSSGNSDDAIRSILQQARREMEAQQAALDPALKPAPLSQPDLTILTPKHLSASPMSTVSTYPPLAISLKKTPAAPETSTAALPSAPALKKEAQDVPTLDPPGSADAAQGVLRPMKSELVRGSTWKDPWWSPIQPERRNLTSSEETKADETTASGKERAGSSQPRAERSQLQGPSASAEYWKEWPSAESPYSQSSELSLTGASRSETPQNSPLPSSPIVPMAKPAKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVASLQDPLQQGCVSSESTPKTSASCSPAPESPMSSSESVKSLTELVQQPCPAIETSKEGKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGIDYSQGASPQPQHQLKKPRVVLAPEEKEALKRAYQQKPYPSPKTIEELATQLNLKTSTVINWFHNYRX

SEQ ID NO: 754 - DNA, 276276 bp, Homo sapiens
cgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacttcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatccggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaagaaaagaaatagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctatagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcatggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtgattttccattgggtccttggtgaaagccctcctggaaaaggaagctatgctcagaatacacagagctgtggtggattgccagcagaagtgccccgtgtgtggttgcaacaggcaggttgttggcgctacggcctttaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcatcctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacacgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatacttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcatgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagagggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacagaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccaggacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctccgtatgccccatttcaggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgattgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactctgggaggccaagtcaggcaggtcacttgaggtcaggagtttgagaacagcctggcaaacatggcgaaaccccgtctctactaaaaaaacgaagtacaaaaaaattagccaagcgtggtggtgggcgcctgtaatcccagctactcaggaggctgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcaggtgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggacgtatatatatatttatggggtggagcacatgagatgttttgatacaggcatgctacgtgtaataatctcatatggaaatggagtatccatcacctgaagcatttatcctttgtgttacaaataatctgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttatcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgagttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatattcccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacccactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggtttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcttgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagttacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggctgaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaatggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctgaacagactctgctacccacctgcctctcttagaagagccccagggagcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaactttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcatgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttttataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgaggggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcaacacccacaaccactgcccagcgcatctcactcggatgaaagcagtgacgtccgaggggtctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatcataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctccatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctctcgacaaatgttgagctctttgttcttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatactgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttattttttttttttaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaagtatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattagttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtgggggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggctcacttcatctttgccagagacccaaagactgtttagctgctgttttctaaataatatgtaatctcttttctttctttttttttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagatggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggtgtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctgtcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacgttggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatactcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttccctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactccagcctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctatgatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcagctcactgcaagctctgcctcccgggttcacgccattctcctgcctcagcctcccgaatagctgggactacaggtgcccgccaccacgcccaactaatttttttttttttttttttttttttttttaagtagagacgggatttcactgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcatgccagtattgcagtaaaaggtaacctgcaaatctgcacattgagttttcatagatacgctaccctaaaggggagtatcctggttttttttttttttcccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcaagaccagcctggacaacataacaagacctatctcttaaaaaaagaaaaaaaaaagatggtgtgagtccattgtgtgttgctgtaaagaaataccttaggctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacattggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccatttccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtggagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatcttttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctaacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgtatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagagagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctttttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacaagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggtttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggtgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttttttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcggatggatagatggatggatggacagacggatgggcagatggatttagacagactggcaaaaatatttgcaatatatatgagagagagagtgtgtgtgtgtgtgtgcgcgcgcgcgcgcgcacgcacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttcttttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatctttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacggggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccagggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccatgctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccccctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaccaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccgcttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacatccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcgcggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccgggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaacttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttagtagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcacggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccaagtctgaattggcagatgttgggtctgtcctttcctcgagggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaacttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacatgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcatgttccacgggccatgatcagccatggattctctgaggaatatcccattgcagcccagacattacccgcacactgggccaacaggcagcatcatggagggaggaggacgggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgtgtgtgtgcgcgcacacacacacactctcccccacacacacacacccccccacacacgcacacacactcccacacacacactctcccacacacacacactcccacacacacactcacacacacactccccacacacacacacccccacacacgcacacacacacactcccacacacactcacacacacacactcccccacacacacactcccacacgcactctccacacacacatgcacacagagtcccacacacacttctgcacacacacactcttccacacacactctcccacacacacactctcccaccacacacacacacacattctctctccctcacacacacattctctcacacacacattatctcacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggatgcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagggagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtatgggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcgtggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcacttggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctaccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagaccccgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggccaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcgaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagcattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccgtcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtgaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttcttttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatctttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgagaggctgaggcaggtggatcacctgaggccaggagttcgagaccagcctgggcaacacagtgagaccccatctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagccttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagtttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcgcagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacccaggaggaggaggttgcagtgagcagagatgacaccactgcactccagcctgggcggcacagtgagaccccatctcaaaaaaaaaaaaaaaaagaatgggcatcccaggcccttgagtggctctgccccagcccaccccacccccgtccccgccacacacacacacacacacgcgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatacaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacaggggcccttccctgcctggcagccgaggcagagagagagaggagacaaacagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattctgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccggccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggagccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttctttttttttttttttttttttctgagacagagccttgctctgtcacccaggctggagtacagcagcacgatctcggctcactgcaacctctgcctcctaggttcaagcttctcctgcctcagcctcctgagtagctgaaattataggcatccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacaaagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctagggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcgtggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgtttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagcttaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccaccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggctgcggccctggggcgggcagccaggctgggccgcaagggcctggacggggtcggacggggcaggcgctgcgacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcttgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggcttggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcgtgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtgttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaatccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttccaaggcccgcacgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaagaatgtgtgggttgtttttatttaaagtgctctggcctgaggacgagcagcaaacactgtcattcgaggtccaaagggcacctcaagaatcgccgttcccgaggtcgtcccctttgcacctgtccgcgggtcctcgggcgtgtggcttccgggcacacagaaaaccgtgtggttctaggatacatggggatctcgggcactgctctgtcaatctgcatccggttcacaggaagggcttcgccagggcctgcgttcctacttgctgttgtcaccagcactgtttgcctacccttgaaccaagcccttaccctccctggcgtccgcttccttttctgtaaaatggagacaccatctcctgtcatataggcttgctgtggggaaccaggaatggtggccagtgctggtgcggcactgggctggtggtggcagccccaatcgatggcacttgggcgaccaggactacggccagtctcctctgccgtgtggcctgcagctggtcagtggcgtggcctcagccttctgtgtgggggtctcactgtgcccctgactcctgatgtaacagaaagacaagtgaaaggcaccagttaatgcttgcgagtgggacagtggcttgcgggtctctggaatgacggggctactgagaagagtctctttccagatggcgcttgggctggaggtggggggagagctctgcagaggtggctgttaggcttctccgcgcagttgtgactcagaggctgttgctcgtcttgggttggaaaagagctgtctgccaggccgacgtgtgtctggtggaagtgggggatgacttggtcgcatattaatttggagatttcagattgtgaaatgtccacatgtgatacagaatcgtaagcccctctcccaattcaactggattcaatcctccctccagtgggagaacccagagtatgggatggagacaccccccagtgccaggtgccctcggcagccccgtgtctgatgcagtcacttagggccgggggtgtctctagagttgcccaaaatgctggtcccctcagataggagaggcctgcataaaaccctaagagctggcccagcgcagtggctcacgcctgtaatcccagcactttgggaggccgaggccggtggatcacttgaggtcaggagttcaagaccagccgggccaacatggtgaaaccccgtctctactaaaaatacaaaaattaaccaggcatggtggcgggtgcctgtaatcccagctacttgggaggctgaggcaggagaattgcttgaacctgggaggcagaggttacggtgagccgagattgcgccactgcactccggcctgggcgatagagcgaaactcagtctcaataaaacaaacaaacaaaaaaataaccctaagaactctgccagtttggtatttgacagactgaagtctaacgtggttaatttttctgtttgctagtttaggtatgcccctatgtatttcatgatctgctaactaaattaaaataagaaatgttaaaaaaaaaaaaaaaagaaaaagagaaaggaaggaaggaaaggaaggaagaaagaacagttgggcacagtggctcattcctgtaactcctataggcccagcactttgggaggaggtcaaggcaggaggatggcttgagcccaggagtttgagaccagcctgggcaacatagtgagaccccatctctacaaaaaataaaaaattagttgggcatggtggcatgtgcctgtagtcctagctactctggaggctgaggtgggaggatcacttctgcccaggagttcaacgctgcagtgagctatgatggcaccactgcactccagcctgggcaacacagcaagaccctaaatcttggggaaaaaaaaaaaaaggaacacttagctcaaagtctttttcctcagaaagttgagacaggatctcagtctgtcaccacctcctcctcccaggcttaagcaaccctcccatctcagcctcccaagtagctgggaccacaggtgtgcaccaccacgcctggctaattttttgcagagaaggggtttcaccatgttgcccaggctggtcttgaactcctgagctcagaagatccacccacctggttctcccaaagtactgggattataggagtgagccactgtgcccggcctccccatgtgcttctaaagtgagatttaattaagcaaaactgcagttgcacctggttttgcagggccagcttcagaggcagaaaaagagtgagatttcatgttctgactgcaattgggcgatgcctccattccaggcaaatggttcagccttgacctttctcccgtccctgcagttaagtgggtctgaacagaaccttgttccttgcttttgtttttgtttgagacagagtctgtctctcttgcctaggctggagtttagtggcgcgatctcggctcactgcaacctctgtctcctgagttcaagcaattctcctgcctcagcctcccgagtaactgggcttagaggtgtgcgccacgacgcccagctaatttttagtattttcagtagagacggggttttaccatgttggccaggctggtctcaaactcctgacctcaagtgatctgcccaccttggcctcccaaagtgctgggattacaggcgtgagccaccgcgcccggccccttatttgttatttgtttcgtttcgttttgtttttaagatggagtctggctctgtcacccaggctggagtgcaatggtacaatctcggctcgctgcaacctccaccgcctgggttcaggcgattctcctgcctccgcctcccaagtagctgggattataggtgcccgccaccacacctggcttttttttttttttttttttttttgtatttttagtagagatggggtttcaccatgttggccaggctgatctcgaactcctgacttcaagtgatctgcctgcctcagcctcccaaagtgctgggattacaggcgtgagccaccatacccagccgcgttccttatttgatgctctgaagaaacacaattgcaggtagacagggtggcgcgacgtgatgatgagatatattagagcacttgaattgtctgcaatggtcctgtgtgcttctgttacaaagcccctctgagtggctgcctgggggcatgctgctcctctccacggtcctaacatgccagctttgggggcacacagcttgctggtgtctacttcagctcatcactgattcctgtgaggtggcagaggcctgggcctgcatgtacggacccaaccagggaactgggagggctccacagagctaccgtgatgttgcccaggctcccggccagtgggccgttgcttagcaaccgactcatgcagtgtggagtgaccggcctccacagacaggggagacacagcctgggcccagccttaggcaggcattgctgaagttcctgtcttttccaagaagttcagactcttagaataccaacaggaagggccctggtcgagcatggtgggtcacgcctgtaatcccagcactttgggaggctgaggtggacagatcacctgaggtcaggagtttgagaccagcctggccaacatgatgaaaccccatctctactaaaaatacaaaaattagccaggcatgatggcacatgtctgtaatcccagctactcaggaggctgaggcaggagaatcacttgaacccaggaggcggaggttgcagtgagccaagattgcgccactgcactccagcctgggcaacagagtgagactctggctcaaaaaaataaaaaataaataataccaatacgaagagcccttttttttttttaagcagaatcaagtatggataagtaatagcagagcttcccatttggggcagtggtgtggcctccagggagcgggatttgaggacaaccctcccattgttcagggaggcgtcagtgtctctgtggtcaggagacactggctgtatcaggatcccagcagcgtctcttagtggctgatgaccgtgagcaagtcttaagtcgatgctcaggaaatctttgaaagaataaatgagtttaacttcctagtgcttctgtttctgtctctgtaaaggggatataaaaagccaaactcggtcgggcacgatggctcacacctgtaatcccaaggctttgggaagccaaggcaggaggatcacttgaggccgggagttcaagacccaccctgggacacatagcaagaccccatctctacgaaaatgtttaaaattcgccggatgtgctggcacatgcctgtagtcccagctacttgggaggctgaaggatcgcttcagcccaggagctcaaggctgcagtgagctataattgcaccactgcactccggcctgggtgacagagtgagaccctgtctccagttgaaaaaataagaggtaggtggctcatgcctgtaatcccagcactttgggagccgaggcgggtggatcacgagttcaagagattgagaccatcctggctaacatggtgaaaccctgtctctactaaaaagacaaaaaaattagccaggcgtggtggcaggcacctgtagccactcaggaggctgaggcaggagaatcgcttgaacccaggaggcagaggttgtagtgagccgtgatacctccactgcactccagcctgggcgacaaagcaagactccatcatggatggatggatggatggatggatggatggatggatggatggatggataactcacagggttactgagaggacccagtgagaagacctggaaaccactcacccagcacccagtggcagggcagagcctggaaggatccaagtgaggcctatgcagttactggcagtggaagcagcagaggactggctggccctgccagggtcttgctgcccgtggccaggccccatctcctggggtctttagtctcctctaacacacatggcctctgggtttggctgtgatggggtgggactgagccgtggtagatgcttacatcagacggattgcaaagagggccagctgtgccccagcctgggagaccctgcagctgtgggaatcccggtgcaactttccaactgaggaaacagatgcttgccgcggggtagtatccactcgcccgtgagctaatacataccgaaggctgaccgtgggccgctgccttacacgctggggttattacagggcaaaccaggagctcaccttcttgtgggagggacagacagtagacgtaataaataagtgaatgagatagttgcttcgaaggtgatcaatgttataaggaggatgggaagagcaagtgaaaagggttaaactttttttttttttttttggagatgaagtcttactctgttgctcaggctggagtgcagtggtgtgatctcggctcgctgcaacctccacctcccaggttcaggcgattctcctgcctcagcctcccaagtagctgggattacaggtgcatgccaccacgtccagctaatttttgtatttttagtagagacaggggtttcaccatattggccaggctggtctcaaactgctgatctcaagtgatccacccgccttggcatcccaaagtactgggattacaggtacgagccaccacacctagcctttttttttttttttttttttgagatggagtctcactgttgcccaggctagagtgcagtgacacaatttcagctcactgcaacctcctcctcccaggttcaagcaattctcctgcctcagcctcccaagtagctgggactacaggtgcacactgccatgcccagctaatttttgttatttttagtagagacaggagtttcatcatgttgtccattctggtctcgaactcctgacctcaggtgatctgcccgcttcagcctcccatagtgctgggattacagatgtgagccaccgtgcccagccgaaaggggttaaagttttaaatcgggtggtcagggtaggcctccctaagaagttcacttctctgtttaatttattatctttttctctttttttttgagacagggtctcactctgtcacccaggctggagtgcagtggtgcgatctcagctcactgcaacctccgcctccggggttcaagcgattctcctgcctcagccttccgagtagctggaattacaggcgtgcatcaccatgcccggctaatttttgtatttttagtagagacggggttcaccatattggccgggctggtctcgaactcctggcctcaagcgatctgcctgcctcggcctcccaaagtgctgggattacaggcatgagccaccattcccagacagaagttaacttcttttttttttttttttttgagacggagtcttgctctgtcacccaggctagagtgcagtggcgtgatgtcagctcactgcaacctccgcctcccaggttcaagtgattctcctgcctcagcctcccaagtagctgggattacaggcgcccaccaccgcgcccgactaatttttgtatttttagtagagacggggtttcaccgtcttggccaggctggtctcgaactcctgacctcaggtgatccacccgcctcggcctcccaaagtgctgggattacaggcgtgagccatcgcgcccagcccagaagttaacttctaaacagtactggcagagctgagggaacgagccctgcagatgtgagaaggaaggacgttctaggcagtgggaactgccagttcaaaggtctcgtggtgcaaatgtctctggaaaccagcatggccgcagcaccgtgaccaggaggaagagtgggaggcgatgaggtcagagagaccaaggagaggcggagcatgggggccttgtcggccattgctgaggctttggtttttactctgagtcaactgggaggcattggacggtttgaacagagggtcctggctctggtggggaaacaggaagtaggattctttggtaggagtgagtaaggaggggtcagcacaggggaagccctcagaagctcacccaggaggccacaactggggctgcgtttaacccccacagccatgccagatgagctgcttctcagccaccacgtgggatcgatttcttccacattgaacttggtcaaggcccgctgctttgtgctgtggatcttctggcagccagggaacttagacttggccctgcatatggcctcaatcacaccctcatggttctgctcttagtacggatagacacaatgacctggccaacataaaccctggctgtcacaccctggggctttccaagggcaccccgaatacttgcctggtgcctagaccacagacagcacgaggtcagagacacaaatgtccagtggaaagaattgtctccaacgttccttagggcaacccatgtaagaaacagactgtgtggccgggggtggtggctcacgcctataatcccagcactttgggaggccaaggtgggtggatcacctgaggtcaggagttcaagaccagcctggccaacatgaagaaaccctgtctctactaaaaatacaaaaattagccgggcatggtagcgggcgcctgtaatcccagctacttgggaggctgaggcaggagaattgcttgaaccccggaggcagaggttgcagtgagccgagattacaccactatactccagcctgggcaacaagagcaaaaatctgtctcaaaaaaaaaaaaagagaaagaaagaaacagactgtgtactttactgaggaggctgctgtttgcaaccactgcaccctacaaggtcactattttttttaagagacagggtctcactctgttgcccaggctagacggcagtggcataatcatcgctcactgcagccttgacctcctgggctcaagcaatcctcctgcctcagcctcccaagtagcagggacaggcgtgcaccaccacacacggctaatattttaattttttgtagcgacagtctggctatgttgcccaggctggtctcaaactcctggactcaagcaatcttcctgcctcagcctcccaaagtcctgggattacaggcatgagacagttgcacccgaccaactttttaaaaggctctctctggctgctgcttggtgcccagatcataggttgcagagggaggccaatgaggaggctgatgccatcatcacaatgagaggtggtcatgactcggactaggtggcagcagtggtaaaaagagactggattctggagatattttgaaagtagagccaaaaatgagacttaaggcaggggcagtggctcacgcctgtaatcccagcactttgggaggccgaggtgggtgggtcacttcaagccaggagtttaagaccagcctgaccaacatggtgaaaccctgtctctactaaaaatacaaaaattagccaggcgtggtggttcatgcttgtagtcccagctgctcgggaggctgaggcaggagaatctcttgaacccaagaggtggaggttgcagtgagttgagatcacgccactgcactctagcctgggtgacagagtgagactccgtttcaaaaaaaaaaaaaaaaagagagagagagagacttaagacagattcagcatcaggagtgatggagaggagtgaggctacctcccggggtttggtctgagccaccgaagggtcgcagagagctgggtcaggccgggaagggggtctctgcctatccctgcagatgtcacctcccaaggctggactacaggggtccacacttgggcttggggagtacagacttggggaggaagggatcaggctgaaattcagacctgtgaaggttgaaatgccagtagaagatcaagtagaagataaatccaaggagaggcgtggactggagtcccacactggggaggcatcggcttgtcaatggcatcccgcatggccagagcggatgagggggcagagtgaggcatctgcggatggtccctgtgcagcagcggcaagaagcttagcagggagggcaaggaccagtcaaggaaacagggcagagcagccagccggggaaggaggcccaggagggtcggtgacctggaaactagctgctaacacagcagctcagatgagagccgaaaaacaaggacgtggcaatgtgcggaggtcattagggaccttggcaaggacagtcagcgtgaggggtggcagagtctgatgggaagggcttgaggaattggaggagcggaattagacgcttgagaagagacagcttcttcaaggagttttgccagagtggggtcaagggaaggggcgtgtgtgcatgtgtacatgcctgctaggagaacatgcttgcatgcatgtagaaggcaagagccggtgctgcaggagagggtggcattgctggagaccccattgcataggggtgggggccagcacctgcaggcatggggagccggctgggggggctcagtggtcacctgaggctacctgcaggatctacaggtgcagaggcagggaggggtggatgaggcagcagcttggccccctcagtgtcctcctagcagagataccatgtgcaccgagcgtctccaccattcctacctggcctgcaagtgatttaataagacaggggcagccgggcatgtggctcatgcctgtaatcccagcactttgggaggctgaggtgggtggatcacctcaggtcaggagttcgagaccagcctggccaacgtgacgaaactctgtctccactaaaaatacaaaaattagccaggcatggtggtgcatgcctgtaatcccagctgcttgagaggctgaggcaggagaatcacttgaacctgggagagagaggttgcagagagccgagatcataccattgcactctagcctgggtgacgagtgaaactccgtctcaaaagaaataaaaaataaaaagacaggggcccctcgcgccttcaggaaaaccgtaggtacaacaccgctggcctcgctatgataagtctctgcatttaatccttctgcagtcagaaatcatgcctagactttttttgggcgtggtgcagagagggacagggtcttgctctgtcacccagcctggagtgcagtggtgcaatcgtagctctctgcagcctggaactcctggactcaagcgatcctcccgccttagcctcctgagtagctgggaccacaggtgcacaccaccatgcccggctaagttttgtatttttctgtagagatgacgttttgccatgttgcccgtgctggtctcaaacacctgagctccacctctgcctcccaaagtgctgtattccagccgtgagccactgcaccgggccctcctgaagtcttgaccttaaagatgctttgattccctcctcccctctgtgaggtgccccctctaggatgtctttgtgggttctcccagaggatgaggtcccagtctttcctgaggggaaggggaccgtcttgggcccttgcaccacagactccttttctgagcccctttccctgtcttatgctcacttatccacccgtcgcctgtcatccctctctcccctaaacaaaatctgtccctctctcctgggtttctgggttgcagatggtccattccacacactctatgcttctcaagatcccctctcgggcacacgttactgctcttccaccagttctgcccatcgggctgtgccttgcagccctgcatgcccccaccacctcgacgacaacaccttcgcctcgctcagcctctctgtagcttctgaccccctgaccctccatattcattgaccctcctgcctcatcttggtgccttcacatgcatcctcctgctgtctcccctgcctcctgctgcctcttctcagggtctttgcgggaccccctttgtggatcaccccctgaagctctggccacctcacagcagcactgtctcaggacctgtccaccacccctgattttctgtattagctgttcttgcattgctatagagaaatacctgaggctgtgtaatttatcaagaaaaggggtttctttggctcatggttctgcaggctgtaccagaagcgtggcgctggtgtcggtttggcttctggggaggcgttggaggctttactcatggtggaaggcgaagtgggagcaggtgtgagacatggcgaggccaggaggaagagagagagaatgggggtgggggaggtgccacgctccttaaacaaccagatccctatctcagagacagcaccgcgccacaagggacccgccctgtcccccaaacacctcccaccaggccccacttccaacactggggattaattacttttttttttttttttgagacagggtcttactctgtcacccaagcaagagtgcagtggtgtgatcacagctcactgcaacctctgcctcctgggctcaggtgatcctcccatctcagcctccctagtagctgggactacagctacaccaccacacccagctaattttttgtgtgggtttttttgtttgtttgtttgtttgtttgtgtagagacagggtttttccatgttacccaggctggtctcgaattcctgggctccagtgatcctccctcctcagcctcccaaagtgctggaattataggcaagagccactgcacctggcttgattacatttcaacatgagatgtggacagggatgaatatccaaactatataattccacccctgccccctcacgcaaatctcatgtccttctcacattgcaaaatacaatcatgcctttccaacagtaccccaaagtctttttttttttagatggagtttcactcttgttgcccaggctggagtacaatggtgccatctcagctcactgtaacctccgcctcccaggttcaagccattctcctgcctcagcctcccaaatagctgggattacaggcgtccgccaccatgcccggctaatttttttttttttttttttttttgtatttttagtagagacgagttttcgccatgttggccaggctggtctcaaactcctgacctcaggtgatctgcccgcctcggcctctcaaagtgctgggattacaggcgtgagccaccacgcccacccccacagtcttaactcattacagcattttggtcacaaccatcgaacaagtctctaagaagttccaaactttccctcatcttactgtcttcttccatgccccccccaaacgcttccaagctctgaccgttggggccctagatctcctcaaccagcatatccagcctcaggtccacaggtccaaaccccaccacacacatgcccttagctgttcacaagcaccttcgtgcttaccagaaccgagccagccagctgcccaccccttcccccacagggggccaggcccgggcctccccacctgggttctgtacagcgatggggtccacagctctctctccagctccttctgtgtcctcgccccagagccctgtactccagaggttgaagaacttgccgaagatcgtgaaattcataaaaggcagggccagaatgcaagcccggttctggacttgacatcaagtggccaccagagatgtcaccccagcttccccacctgcgtgttccagcctccagcagagaaggcagggtgaggcagccggtgggggataggggaccctcccgtggccggtgaggccctgtccttctctaagtacatctaactgaggcccctctctggtggaagcccgcacagccagtctcctggccttcgcttcctcccagcgtggagtgacagtttcaaagcacagctctggttgctgctgggatccagctgggctctgggacagtgtccagatcctgtcccctgcagcctccagttctctgtccacccccctctacccacagccttccctccagtctcaccgtctgccagcctctgctgccctgtcttacccagcctgttctctctgcctcaccagcagccatcccccaattctgctgcccgtgcaactggcctgtgctcctatcaccccaagccacctcttcagggatggcctcccccaaccactcagccctgcaccctcagatcccctcaggagctaacccagtgcccagagcatctgcagcagcgccaatggccaggcctccaggccagcttaacacatgggccttttccaggatagcgggccaccagctgggaactggggcagcctaggatagagggtttgcagccaggatgctcacacctgcacagaatgtcacctacatacacggcaggactgtgtgcccacccctgcagtagcagacacaggaacaagtgcacggggaccaggcccacgcaccccatcatctccctggtgcccacggatggtgctgggagctgcaagttgctgccaccccagggacctgaccaagaccacactggggtggtcacagactgggggcagataaaacaggcagtgcaaggaatcatctcagcagctttttatccacccctcttgccaggcgcacacctccagggaaaagggctcactctggccaggcaaaagtcacctctgcaaaggttctccatctcagccctgtctctctgtcccccaggccctcatccctgaggtggaatgtggcttccctgagccttgttggagcttaacgccctctttttatcccaggagtctgtccccatggtcccagcacggttcttggatgtgctcctgtttgtggccaaactgaagcatcccctcccttggtccaggaccttcacctctattaatgtgacccaaggccccattagctttctggtggtttcctctccctacatctcacaaccgctgtccacctcccatcctaagcatgagtggccggctctgccatcccatcccacaggccaggacccaaggactctgtactcaggccaggagggcatggtatttatcgtctctctggacctctcccctttggggtctccttaaagtccctgcaggtggcccagggccagccccaaccctgcccccgacagtcctccctccaaggccgggtcctgccttcaggtcctgcctcttccctcatcccctcctcacttccgcagataccaccttcctgccagggacccaggggctcagtgaatgtctgaaggaagaaatccatttaggggcccagtgcggtggctcacgcctgtaatcccagcacattgggaggttgaggcggacagatcacttgaggttgagaccaacctggacaacattgctaaaccccgtctctactaaaaatacaaaaattaactgggcacggtggcaggcgcctgtaatcccagctactcaggaggttgaggcaggaaaattgcttgaaccttggaggcggaggttgcagtgagccgagatggagccactgcactccagcctgggtgactgagtgagactctgtctcaataaaataaaataaaataaatccattcggggcctgaacgaggcgagactctggtgtgagcaagggcttagacagagctgggggtggatgccttgggtttggtcccaggtcgggaagcctccgttctttgactgtaaaatgtgaatcgtcttttctgactcatctataaggacttggtgtgcagtgggaacccaggagcatgtgggggtgaggctgggctgccccatcctggcccaggacactgagcccagccagggcaggtatgacagccggtcagcaggccgcgcagtcagggatgagtccacggaggaggccgcacataccatttccctggcactgcccacagcctgcagcctttgtgcatttctgaggccacagtgccccctggcggctgtgcagcctaccccaaaggacagcgtcctgggtctcaggcctcagtctccctctctgcggccccaacagctcaccctaaacaaggtttattgttaccatgttacatgtcaccatttgggaccagaaagggggatccagtggccctgagccgcacagtcaaccagaaacagggccaaacctcaccctcagggctgcctggctcctgggtcactgaagtcctgcctggcaatgcgtgcttgggtctgggtcccttccccgacatctctcaccctcctgcagggcaggaaagtcacagtttggatgctttgttataaagatgaccctggcacctggaggagggagagacagacagggctgtgggtcgggggactccttggggaccacgccaccccaaccactgcagctggagcctctgttgggggcgggaccaagcacctctgttgtcagcccagaggtggcacccctacgcgccacactgcacccccgcggctttctctgcctctcctacccccaggcttcccactggacattatcccagaacatcagctaggaagcaacctgagcctccttgcccctgcctgacaagcaaagtgaggcccagagagggaaaggggctggccagggccccccaaacagccgtgggcagagccacgttgcaccggtttctcctaatccctgacctgagctccttctcctacccaggggatttcatcaatccagagagtgcttggggccaggagtgcctctgacagtcagggagggcttcctggaggaggccctaggtctaatggggtcttctaggcagtggtgagttgggagggaatagccagcactctcacagcatccaggcagccctgcttccagaccgtgggttggagaggcagaaccaggggagggcaccaagggtcccaccaggctccctctgacggccatgtcttcctttggccacaggacgctgtgcggagctgcaagtccgtatcactgaggctgtggccacagccactgagcagagagagctgatcgcccgcctggagcaggacctgagcatcattcagtccatccagcggcccgatgccgaggtgagcccacccccctgccccatgcccatctcgctacctgcccaactgacttagcctctgcaaacactgacttcccagattagcctgtgtatcaggcagctggtgacaacccagaagggctgtcacctaaaaccattgggttctccctgcttactccatgaataccaccctgcctccgatttggggtgacaggccatggggcagaggccacagggcttcctagcggtagcacagaggcccgtctttccaggcactgccctgagagcagaggcagaggcaaggccaggaccatgcacccatctcccagctaaaggacctggagcccagagatcacagcaggctgggacataaacagcccagggagagcatctcctcgcccacctcccattctgtagagtccacagtgggactccgggagagaagtctgggctgtcccaggtcacgtggcaggctggttgcagggccagggaggcccaggtgtctgatgcatgtcaaagctgagtggctgcgaggagagctgcactgctgctgaactctggcctcaggagtgacttagggcccagccatctcttctttggtagctcatgtcacgtgtccaggtccgggccctcctgcagccagcctgcaccccggatggccccacccactccttgccacacccaccctgccatttgccttggccatgctgaaagggaatattccgtgcccattgtgcggaggcacctcctcatcgcttcctgtcacctgcagggtgccgctgagcaccgcctggagaagatcccagagcccatcaaagaggccactgccctattctacggtaaggagaggcctgacccatgggaggagggaggaggagggaagaggagacaggtgataccgcctgagaacacagatccccaaagagtagtcccttcctctaagaaggtcaggcccccacgcctgcaatgcagcagcaaccttcaaagggtcgggtaaggctaggtgtggtggcgcacacctatagtcccggctactttggaggccgaggtgggaggatcgcctgagcccaggaattggaggctgcagtgagctatgatggtgccactgcactccagcctgggcgacagaccgagaccctgtctctaaaaaacaaaaaggtgaatgagccctcaacctgcctttctggatcttagactgacaccccccaccttggggccctgacccttcagccctgccggtggcctgtgaaaggctggtgagtggtggtcagccaggcctcactgccaaagtgcagccggaggtccgtgcagtgaggggaaggcagcctccttgggtattgaggacagaaactgaggctgctggactgggatactgggggtgtgcccatgcctccccagttcccctcctgcccctttgcttccccaggggatataggcctagtctgacagctgcaagggtctcagattcaaggacagagtgactgggaggggagttctgggcctggccctctgacagcgcagacgggggtgctgggcccttccccagcgtgcgtattgtcaggtcagcccctgccatccattctcacgctccccggttcccctggctgtcccctccccttccccgacctgcccagcaccagggagtcagacaccatgtggcttctaccccatggcatttggcagaaatcccccagggctgggggacccaccccaaagggccgcctgctgggttccacctcctgccaccccccaagccaccctcctctacctgctaggacctgcagcaccagccagcggtgccctcccagagggccaggtggattcactgctttccatcatctccagccagagggagcgcttccgtgcccggaaccaggagcttgaggccgtgagtcacatccttctctccctgatgctccttgggcccaaggacacagttggggaacacacaggctttcaggagagagatgtggcacagaccgtaaacctcagggggaagagatttgttctgtgcagtcagggagggcttcctggaggaggtcatgccacactgggctttgaaagaagactcagatgctcacagtagaggagacacgggggccagtgagccagaagggagcatagatcattccaggtgaaacaagtcgccaggcaagtgccctcttgccaggctgggaggcgtggccttcaatctgcagggaggggcaccaaggaaggatttaagccaggcagtggcactgcaagaatgcagggtgagccaggtgcggtggctcacacctgtaatcccaacactttgggaggctgaggcaagtggatcacttgaggttgggagtttgagaccagcctggccaacatggtgaaaccccgtctctactaaaaatacaaaaattagccgggcatggtggcgggcacctgtagtcccagctacttgggaggctgaggcaggaggatcgcttgaacctgggaggtagaggttgcagtgagctgatgagatcgtgccactgcactccagcctgtgtgacagagcaagactccatctcaaaaaaaaaaaaaaatccttcctttttaaggctgtataatattttattgtgcatatagaccacattttgtttatccattcacctattcatttacattgcttccaccttttggctgtggcggataattctgctgtgaacatgggtgtataaatatctctccaagtctctgccttcaattcttttgggtatctacccagaagtggaattactagatcctatggtaattctatgtttaacgtttttagaggaagcgtcatactgccatatacttttttgtactgctcaagttttggttgtgtttgttttttgagacggagtcccgctctcttgcccaggctggagtgcagtggcacaatcctggctcactgcaacctccacctcctgggttcaagcgattcttctgcctcagcctcccggatagctgagattacaggcgtctgccatcacacccagctaatttttgtatttttagtagagacaggatttctccatattggccaggctggtctcgaactcctgacctcaggtgatctgcccacctcagcctcctaaagtgctgggattacaggcgtgagccaccgcgctggccactgcttgaattttgaatagtgtgaaagaaacacttattcaagcatttgaataaattgaaaactgagattccatttcacgttgcctttagattggcaaatattaaaaccacagcgtgtgattccatgaatacgaacattcggtataggcaaatccatagagacaaaaaagagactgccggttaccaggcagtaggggaggagggaatggggagtgactgctggcaggtttggggtttcttattggggtgattttaaatgttctggaattaggtagtggggatggttgcataacattgtgaatacaaatgaccgaactgtacactttgaaatgctgatgtttatgttatgggtattatatctcaataatagtttttaaaaggctaataccaatgacaaaaaaaagtatgaagaaatctgaccaggcatcgtggctcatgcctgtaatcccagcacattgggaggccgaagtgggaagattgcttgagcccaggagtttgagaccagcctgggcaacgcagtgagaccccgactctgcaaaaataaaaaagtagctgggcatggtggtgtgagcctatagtcccagctacctgggaggcagagatgggaggatcgcttgagtcgggaggctgaggctgcagtgagctctggtcatgccactttattctagcctgggtgatagagcaagaccctgtctctaaaatatatagacaggggccaggcgcagcagctcacgcctataatcccaacactttgggaggcagagatgggtggatcacctgagatcaggagttcgagaccagcctgaacaaaatggtaaaaccctgtctttactaaatacaaaaaaactagccaggcatggtggcacatgcctgtaatcccagctacttgggaggctgaggcaggagaatcgcttgaacccgggaggcagaggttgcagtgagccgagattgattgcgtcgttgcactccagcctgggcaacaagagcgaaactccatatcaaaaaaataataaaaataaaaataaaaaataaaataaaatatatagacagggtcttgctctgtcatatattaaggttgatgcaaatgtaatcatggtgtttgccattacttttaagggcaaaaaccacgattacatttgcaccaacgtgatacatatgaagaaacctgacccaagatccctgacttctgcctgtggtggggccacagtgggggaaggggcagctttacagagtcaggcaggtcaaggagaaggctgtgggcacagaaggggctccaggtagacggagcagcacctgtgccagcacggaggcctctcccccacccctttccttgcccctccccccccaggagaaccgcctggcccagcacaccctccaggccctgcagagtgagctggacagcctgcgcgccgacaacatcaagctctttgagaagatcaagttcctgcagagctaccctggccgggtgagggccctcccctggcctcagctccaggtggaccaggcagggagagaggccgatcagggctctggagatgggagggtcggggaccaagacctgctgggcagcactgggccccagagacccctgaggccttccgacatctccccacccacccacctgcctgctagctgccctccctaagccgggagaagctcacagagtggagcccctgtccagattcattcataaaaactggccagaaggaccaggcacggtggctcatgcctgtcatcccaccactgtgggaggccgaggcaggagaattgcctgagctcagaagttcgagaccagcctggccaatatggtgaaaccccgtctctactaaaaatacaaaaaaagtatccgggcatggtggtgcacacctgtagtcccagctactcaggaggctgaggcaggagaatcgctggaacccaggaggcggaggtttcagtgagccaagatcacaccactgcactccagcctgggcaacaagagcgaaactccgtctcaaaaataaaataaaataaaaataaataaaataaaattaaaataaaataaaataaaataaaataaaataataaaataaaatataaaataaaataaataaaataaaataataaaatagtaaagtaaaataaaataataataaataaaataaaataaaatagaaaagaaaatactagccagaagggccaggcacagtggctcatgcctgtaatcccagcaccgtgagaggccgaggcgggtggagtttgagaccagcctggccgacatagtgaaaccctatctctactgaaaatacaaaaattagccaggcatcgtggcacgtgcctgtagtcccagctactcaggaggctgaggtgggaggatcacttgagcccaggaggtacaggctgcagtgagctgagatccagccactacactccagcccaggtgacagagcaagaccctgcctccaaaaaataaaaataaataggctgggcatggtggctcaggcctgtaatcccagcggtttgggaggctgaggcgggcggatcatttgaggtcaggagttccagaccagcctggccaacatagtgaaaccccgtctctactaaaaatataaaaattggctgggcgtggtatcatgcacctgtaatcccagctactcaggcggctaaggcaggagaatcgcttgaacctgagaggtggaggttgcagtgagccgaggtcacaccattgcgctccagcctgggcgacagagcgaaactctgtctcaaataaataaataagcaataataaaaaatgtaaacagaatttggtccacactccaaaaagcaaccaagagagtggatcagaaactcacttgccgagtttttctgggctagggaggcctgtgcgtggcttctctcagcccccaggcctcccaggggccaccccgtgccaggaaaccctttctatgagtgagagaagagcgtggggcatagtggggcagggattcacctctccctcttcctttggggcccagcagcccccagccctgtccccacccatcagagccgctccttggccaccagagggcactcagactctgcaaaccagcctggctctgggtggccagctggggggcgtctcctctcccagctgcctgcctgctcgcatgaccaccccacactcccagcaaacccaccttcctgcagctgcgcccggccctgcctgggcctcagttccccatctgtgcccggaggcactgtggccctgaccccatgggtaactccatgcccctgtggcaggaggcaccagccacattcacattgtcaccccagcaccctctcctcccgcctctgagatctagggctccctcccccacttcccttttttgcagatgaggaaactgaggctcccctgggctcctgcccttcccgctgggccccaaggcactgactggttctcttcccctccctgtctgtgcagggcagcggcagtgatgacacggagctgcggtactcgtcccagtacgaggagcgcctggaccccttctcctccttcagcaagcgggttcgtgagcccagcctgggcaggggaggggaggggcatcagcccagggaagcccaggggtccccccatcacttggcccccatccctgagcactcggccttccctggctcccctccacctgccctcgtctgggtgctctcggccagccttgccacgccagccctgcacaccctggcccctcaggccaggagcccccccaagacagcctccccaccgcttcagtgcaatgtaggcccagggcccattcaggaacacctgccgaggactacccgagggtgtgtggcagtgaccgggttaacctggagtgcatttgcgggacaggcagacaaggaaaaaccagttacagctcccagaatcgggcgatccattgtggggaccccaccccacaactcccctcccccacccagactgcagaagttctgcccgtggagtactttcccatgggcagaatggacggctgcagaggcggggaggggctctcacagatgtcaggggagtccagaatgtcacactgagtagactgtgcacccagggaagcccctggcagcaccctggcagccccctgggggtctgcaagaacagcgggcagggtgtcctgtggctggccaggccctgctctctgccacaagccagggcctgtgaggtcctttggggtcctttcctgactgtccctccctgtgcaggagcggcagaggaagtacctgagcttgagtccctgggacaaggccaccctcagcatggtgagtccctgcccctacccaccccctccctggacaggcctgagcctctgtctccaggcacctcttcacctgccctgcagcccaggctggaggagccgccagccctgccaagagtggctgtgtgatctgggacagggtctctccccttcccgggcagatcctctgagagcatggttcacagcatggttctgaactgggctgtagagggggcattcctcagaattcctgcagcctagagtcagacatggtggctcacacctgtcatcccagcactttgggaggtgggaggattgcttgagcccaggagttcgagaccagcctgggcaacacagtaagatcctgtctctacaaaaaataaaattagccaggcgcagtggtgtgcacctgtagtcccagctactcaggaggctgacggaggaggatcacttgagcctaggaagtcaatgctacagtgagctgtgaccactacattccagcctgggcaaccttgtctaaaaaaacgtttttaaagaattccggtggccgggcacagcagctcacgcctgtaatctcagcactttgggaggccaagttgggcggatcacctgaggtctggagttcgagaccagcctggccaacatagtgaaaccctatctctagtaaaaatacaaaaattagctgggcgtggtgacgcacacctgtaatcccagctactcaggaggctgaggcaggagaatcacttgaacccaggaggtggaggttgcagtgagccaagatcacaccactgcactccagcctgggcgacagagggagactctgtctcaaaaaaaaaagaattccagcagcccatgtccctggcccataatgatggaataggggccccagcttcctgtcccttccctccccttgccaccctagggccctttctgtgaagcccaggcagccctgcaggggtgggtgaggccggccccatccccactcaccccctccttgctcccaggggcgtctggttctctccaacaagatggcgcgcaccatcggcttcttctacacactgttcctgcactgcctggtcttcctggtgagtgtgcacacgggcgggccagaggcacattcaccatccccagccctgacctccagggcagcaggggcctgttacggtggcctggcccctgggcctaccccaagctgcatctctagcttgcggccatgcctctccccttcgagagccttggcccaccccagggacgagaaggacccaccccattgggacctctggccagggcaccagccgggccgctccgtgaaagaggcctggctgatcacatctgggactggtcctggacgggcttcataggaagaagggatggagtgggaagggagcaggtctaatgaactccaccaagggacagtcacgaagactgcacagagaaggggcgtcttgaactaacctccccagctgtggaggtggcgttctagttagcggataagggcctccatgtctgccaagttgggggagaagaggggtggaaggctgtgtctctggaaggatccagccttggggactcctgtccccagcacagtcaagatggcccctacagagctaacctgggctcaagttctgaccccagggtccagcggctcctggcccttccaagggttggcccacagtattagaggaggtgcctccgtgtctgggcccatctgatcatctgcagaagcagtgggtgcaggaacatgtctaagacccacccgccccggagtctggggctcgagaacctttatgttccaggccaggcccaggggccatgggtgggctgcaggggtggccttgaggcgaacgggcagctcaccgtgtctccacctggccaggtgctctacaagctggcatggagcgagagcatggagagggactgtgccaccttctgcgccaagaagtgaggacccccacttgggccccccctcagccccacagcgagctcccagcacccccgcaacacccccgagttcctgcctcatgtcccccactccttagccctccatcacagccccccattctggccctccccctacccctactcccggtatccactacctcctagccccaccccatcacatggtacacaccccccttccccaacacacacactcggcctcagcaaagcttcccgtgtcccccaggttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagccaccctggtgccctgtgctctgggacgctggagggactggaggctggtggggatgcctgcggtgccacccctgggagctggggctggcctcacagctgggcacacagaacattcctccccctcttctcatctccaggaattccatgagtacattcagagctctgctgaaacccagatccagtgtccgagtgcttttgagaggacaagtagcaccatcaaaaagggaaacccattcctttattcaaaaaccacccggggccaggcgcggtgggtcacacctgtaatcccagcgctttgggaggccgaggcaggtggatcacttgaggtcaggagttcgtgaccagcctggccaacgtggtgaaaccccgtctctaccaaaaatacaaaaattagctgggcatggtggcgcatgcctgtaatcccagccactcaggagggtgaggcaggagaatcgtttgaacccgggaggcggaggttgcagtgagctgagatcgtgccagtgcactccagcctgggaaacagagtgagactccatctcaaaaaaaaaaaaaaaaccacctgtcgggctgtggttgggtgtatgacgtgtcttggtccacgtcagttcctggggaatctctgcttccctttctgtgctcccctttcccatgggcccccgcctgccaggggctgcaaagcccgtgcccatcaatccccctgagcaccagcctcgcatgggaaccccccgagacacaggttctgggccacctcacctccagcccagcctcagatagaggagcgcattctctgggtctggagtgggtgcattaactcattgtccagctgtcacaagactggctgcaaacccaggtcccccactgcagcccaccaggccagggtcccctgtgctacctctgtctccattttagttctgaacagtctaaagcatgtgtatccaggggcctttctttggggtccccgtcccagcacccctcatctcccccatgaggacttcttccaagcccctcaagcctcctgccctcagggacccaggatggacctttcctccctgaccttcattcctatccccagcgaggcgacagctgctcttggccaaccacgccccctccacccccacagccacttccacatctccatcagttcctccttgtgggtccgaggcgctctgccgccggcccctcctcacttcttcctccctggggatggatccaagctattgtcctgcccatggcttcccatctcaggaccctctctggccgctatcatcccagcagtggagttcagcccactactctgaaccaggttagtccaccgcgggtcaggctctcccctctcccaggagggtggagaccacaaccaggccatgtatggagcttccctttctcccactctcgggcaccccctcctcccccttcccggcctcattcataggtgtcctggttcccaaccaggcgtgcaggcctgtgtgcagctccgatcgagggctggcccactgccgaagctttcattaaagtgtctgctggcctggtcctgcggagggaacagagccgagatgtggggcagggaaggggtctgcctgtcttccgtgcccccgtggagggcagcaccggggttttgggcagcaggtgaaggctctgtcccctccaccttcaactctggaagccccacctttccatccctaagaagggtttgataaaaacccttgtctgtaaattagagatgggaaatggctctgggaaaagtcagaggtcagtttgggcccgggagggcgacagatggaggcagctccggctggcaaggagaccaggacagaactgccagaggtgggggcaggggacaaggagggagatgaggggagaagacacccaggggtccccccctgctatctccaggagcaagactactctcttctctgagcggccctttccacacctctgcccccaccgaagccctccctcccctctcagaccccttccaggcctgctgagccccctgcacctctttcaggaagcctcccagagcccccgcgccgtgccctcagcaccaggggtcaggctacaaatgccccgcaaagcccagcgggactgtttcctcagccccactggtctctgccctaaagcaggcgagttctggagccaggcaggggtgaggaaggtgccagggttgtggcccctcatcgcccctctatgatctctgacacctctccgggtggcatcaggcccccatcacagcgaaggctgggtggtgggggcactgcgctcaggggggccgtcccgccctgtggcccgggggcgatttcccgcaccggagggctgcagggagggggcgtggtggcgccctcgagatttatgagaaccaggcgtcgacttcctccgttgcgacatccaggcctcctccaggctcccattgtccctgctgcggagagtctggccacagcggcggctcccgcgaagcacccgtcagcgaggggcgcttcgagggcgtccgcgtcccatacacccgccacgcaggacattcccccggccccacgctccgcgctcccggggccaccaccaccgcgggctcgaggggtggcctccacgaggaggagtgggagtcccgcgcctggcctggggccggctcggcgacatggggacccccgcccagatggggcgactcggagccggctcctaacccctctctccgggccccaggaccgggcagtctcggcaccgcagctgcggggagccagcaagcaccggccaccggcgccgctcgggctccgcggatggccgggggcggggcctgagcggcgcaagtgggggcgggagggggcggggccaggacgcgcgagggggggcggggccggggctcgcggcgggggcgggggcggggccggggccgggaggcgcgcgcctcgcgggcggaggggcgcgccgcgctggggctgggcttggagcgcgcggagctcggctgccagagagccgcgcgggggacgcgccgggaccgcgaggagcgcaggagccttcgaggcggtgaacgagggagggagcccagtccgcgcgggccatgagccaccgggcccggggagcccggccgcggtccgggcagcgctcagccggcgccccagcccgctcggccgcagctgcgcgcctgtaggtatggcctccttatacccagttcctcgctccctggtccttcccccgggacccctgtctgtccccggggacgtgcgctgtgtgcgcaccgctgcccgaaggagagcggccgcacgcgccttggtccgcgcgtgtcgtctttgtgtgcgcgggtgggagggaggagggcgcgcgagggaggggaggcgcccccggctgggatctgctccccgatccccatcccgggcggggcggggagccgctggaggggccgagccgcctctggagcagctgcgcccccgccccctgctagggccccggccgggtagtggggcgagagcagccgggtccttagaggaggggtctctggttgggggaaggggtgcccaggtctcttccctacgctgggagcgctgggagggggcgtcaacctagaatgagggtgagggccacgggatgggatcggggaggacctcctccaggccacaggcacgccctccctttggcccaggcccccctttctcgacctgcccagccggggagctccccggagcccccgattgccgggaggatcgtggagggtgcccaagaggccggcgcctttaagaaggggcgggttcgtgccctccattcaggcccttgggcctcggccattgatgaacctgcgggctgcgcgggccggaaccgcgccagcccagcgggctgaagccgggcagaggcagggacgcatcctggccccctgcagccccgaagtgggggccttcagggagggaagtctgcagtgactggagcctctcaggagccacgcaaggcagaccgggcagccccaggcgagactctgaacacgaataagccaggatctacgtgcacttcgagctagtgcaagggagagcctcaggctaggctgtcagacctgggtggagccctaccaatgcccccgagccaacatcacctaccctgtaaaatgggatggtgctgcctgcctcctggctaagggaccggcaactcccggcaggaattgcgtcccagagtcaggtccctggagctcctctgggaggactgggggcagggggtgtggtttccccaagaggttttgactgcctcttgagctgaagcccccactactgtgtcccaccttgaactctcccaacctcttccctcctggcctccccactccacgcaggaagaggttgggagagtgacctagaacttttcagctccaggagctttgggagaggtctggtggtggcggtggtggcacttcttttaggctagtgtggatcagggcatttttgggggtctcagagacagtttcccaccagctacttccttagaggtctgtcctaccaacatacaagaacagccccaccccgtggcaggccggcttctgatgctgcttggttgaatgcttctaggtaatcaagggttaatgcacacgcttttctttttacccttgttgtgaaaaatctgtctgaagtttctaaatccctcttccctacttagcgtgaatctcctagggaggacttctatacaaatacccaggggtgggcttcccttgggggtcttggaagtgggatctccacccaagtgatcctgggcctcccagggctgagcttttggtttcaaacttacttgtgccaagctaagggcatcaggatcgccgttcgtgtcatctttacaacaatcctgtgggtttagtgctattattatccccacacacttagggaggggaagtgactggcccaaagtcccgcagtcaacgagccaggcctcccaaccactcctctctgacaagaggctggcacttcttgccctgcctacccagcctgggttgcaaggaattgggggtttaggggcttcaggcctcctggctgctgtcttcccggggctacgctcattcttactgtccaagtgaggccaggggactggtcagagccctggggcctggggaggtttctcttccctgctcacctggctgggtgccgttttatggctatgctctgtctagggggatagcaggtgtgacccctcaacacgaggtcacagcccacacctgtttgggcagagcaaggcagggcatcgctgtgtgggcgtgcagcatcttttggttcctctgggtgaagcagggtttgggccccattctccacatacttccgggccatctgagggtagcgcccacctggggggtggggaggacaaccagccaggagctcacggttcggtggaagagacaggccacagccatgtggtgtggtggaggggcagggggcaagggtggaggtgggaagaggatcaaggggcgttcccgaggcctctgtgggcttgggggcctgcctgctattggggcagaacaggggaaataggcagtgcccagctgggtgctgaggctctgtgcagaggacaggcaggagttggaggaagaggatgtatttgaacttggatgtggtgagtttgaggtacctggagatcagccaggctgggagttgagctcagagaaaggcccagggaagctttattagcacctgtagtctccagagttcggggatgctcagatcttaggggtgccaccagaggtctcaggaggcactggtatgagtgtcctggaaaagccagaaggcagctgggtgggatgagttggtgaggggcactaagggggtatcctgcaggtttagggggctgggccaaggcccatgtgagagttatgacactgggggagtggaaggggctgagtgtctcaggccaaggctggagatgggaggggggaacctctgctctgcaaccccagaaaggcagggtggggtgggagtaaccagggccagtgcagctggaaccagctcagcctgtcctccacctgcagagcccatccaggaactgtccagcactgggtgctcctgaaggaggctgagtctgcctcttgagcccacaggccctggcttagcttgttgtcctggcccccactccctgcttatctgacccgcacttcctgcagagcccagctgtggattcccccgcccccccacccagccgctcagagtgccccatcctctaaaggtggtcatttcctttcctgaaacagggattcagtcttcccactctgcccttggaagcggagttccccagaaacaggtctcagaaagggaccagcctggaacttggctccatacccccctttttttttttatttttttgagacagagtcttgctctgtcgaccaggctggagtgcagtggcgtgcaatctcagctccctgcaacctccaccacctctggggttcaagcaattctcatgcctcagccttctgagtagctggggttacaggtgtgcaccaccacgcctggctaatttttgtatttttagtagagatggggtttcaccgtgttggccagactggtctcaaactcctgacctcaagtgatccgccctcctcggcctcccaaagtgctgggattacaggtgtgagccactgcacccggcctcccctcttgtccattctgcagccctggaccctcccacctggcgtctgacacacagtgggagctcaccactgcgtggtggccagagcatggtgggtagtcacctccctccccagaaccccatttcttcatctctgcaatggagaaacaactctttcttacagggaagatgtgaggggagaagggttttaacaggggcatggcccactgaaatgtgggttctagaacgctgaccttggccacattggaggctgggtttatgtgttggggcagtgggtacctctgcagctgcctgccaagagcagttggaggaaaagggaatgaatagagctgtgatttttaaacaaattgcttatttaatcttcatgacagccccttaagtttagcactgctgtcacctccatcttaacagatggggaaactgaggctccagagtccaaggggtcatttcactgggtagcaaggcagctgggatccaaacccagacagtctggctccagatctcagacttttaacactgtcccagcatgtcaaatgaccagaggtggccatagggagatgcccaggcagtggggctccctttgctggggaacaactgtcaaaggcaactgtgggaacccctgggactgagggtctgcagacgccggtgccagcagggcttgtcaagcttgggatgtctgcaaaagccggggggctcagcagaagggctcccaccctcccgtggcggtggcaaaggctgagcgtggcatgagaggcctggggttgtcctgggtgcagggctgttgcaatagctgcctccaagcgatgctgctcagggcgagccttggactagaaagttatctgcacggaagagcagctagggaaactaatgctcagaacagccaagaccactagtacctaatcacccatacagaggcatacaagtcccaagggctctgaatccacacctgtccccatcgccagccagaaggcccccacccatccactctgcagcaaagtcacagcaagttcaagggttaagttaagaccagaagccatgcctactttgccttctgccggggtggtggagtgagctcagatattctgggaggggagagttggggaattccagccacatctggcaggaggccctggttcagagcctaccttgtggggatgtggtctctgcggaggtgagcagtaacacgggcttgaaaaccaacgcccacgtattcagcagtgaagcagagactgcgctgtgtgctgtgttcctgaatctgcaggggagagagagactcatacctagtcagcgggtgggagtcactccaggccggagggatgacctgcccaaagagcatctgtgtcctgcccagggaggggtgcagagaggaggctgcaggggtggaagggactgccccaccgaggccaggagggtgcttgaggaacagcaggattgaaggagcctatgttgtccagagtgaggctgagtgggccaggccagtgctgctaaggtcctgaggacccctaagggcagtggacatgagaaggcatggctgggcaggttttctgaggatggtggaggtgagcagagtgaggccttgtctcttgtgtcaggcaaggaggtaccccaagaagaggctgcatgagaccagcctgggcaacatagtgagacccccatctctaccaaaatatcaaaaaattacctgggaccgggtgcactggctcacatctataatcccagccctttgggaagctgaggtgggcggatcacctgaggtcggaagttcgagaccagcctggccaagatggtgaaaccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctatgattgcaccactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagctaagtgagggtgcaggaggaagggggggtctcttggcagtggggcgcagccttttgaggtgctgcatagctagtttgacctgtgggaccactgaccatccctcctcttcccggtgctcctggcctcctgtggctgggatggtgctggggaggaggtggggggtgccagctggaggtgggcggggctcctgcctctccccgcccccagggccaccgcccactgtgccgcgcatcgattggtcgcgggcccattagctggggcggcgagtccgactcatcaatattttaaggaatgacccggccttggggtgcggaattgctgcgcgggcgggggctgaagaccggcttttttttttttttttttttttggtcctccaattgtcagcgctatttttaccgccggaaagccgccgccccctcccccatgccggctggacctactgtctagccgggctggtggctggggtctcttgtctgggttgctggtcgtggggttaggagaggccgtggcctggaaaggcgatgagcagggactccattagacttcccctgccctcctcgctccatcccccagcaccaaaaaccactctgaagcccccatcccatcagagatggggaaaaaaaaaacacattttttcaggaggagaaggcagacagcccagctgagcctagaaaaaccggaggtgggggggtgtaatggatggggggagggtggtctacccgcccagtgctccgaggagggccagcaccacagggggccctggctgggcttcctttgtctccaacgccagtcctcagagaagcagcctgtgagggggagaggcaaccccctacctgtccctagtcccaatggaatgacagcccagtcttcaatgtccaaggccatcacttctgcatcaaaatcaggagcccctagaagccacacacagctccagcaatcccattttactgatagggaagtggaggcaccaagagacacagggcccggcccaggatagagtccagatctcccagagcccagtccagcactgcctggcaccaactcagctggtctgtttgga

SEQ ID NO: 755 - DNA, 2669 bp, Homo sapiens
gctccaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcagg

SEQ ID NO: 756 - protein, 484 aa, Homo sapiens [sequence omitted]

SEQ ID NO: 757 - DNA, 28932 bp, Mus musculus
gccaatcagatccaggcagtcctccaattgagactccttcagataattttgggtttgtgtcaagttaatagcagaaactaacaccacctaaggttgatctgtacacacacacacccaagtacacatgcacacacacacacacacacacacacacacacacaaagaaaaaaaaagaaaagaaaatgaagccactaaacagaaaccttgagtcctgtgggaaaactgggacagggccccctgcagcactttttggtgacctgggtctgcctctgggttttggcaagtggccctttctttttcctgtaacagaatccacacaactgtatcgactcccctgcctgcctcttcccttcctttcagaaagccttaagccgagttgcacaactgacctcttaacagtattgagctggttgcagggtggggttcctatttcttcagccgctctgtggtcacagaactataaaagaccgaggggaacttttttctttgttttctttctttgtgtttttttgcttttctctgtgtagccctggctgtcccagaatttcttctgtagactaggctggcctggaactcacagagatatgtctgcctctgcttcctgagtgctgggattaaaagtcatcaccgccagtccaatgggggtgagtcacacacccccatttttatttattcttctctcatatattacaccctgactacactgtaatctctcctccttctcttttccccaccatcttccctctctcccagatctgctcccctcaaccttccttcagaaaagaacaggcctagggacatcaatgaaatactccatatcaagctacaataagacctggcacatattcttacatcaaggctgcatgaggcaacctagtagaaaagtattgtgtcccactcaaccgcaagaaagacgcaaccaccggttcttctacggcaaagcttttattgcttacttctcaggaagaccccgaccccagaaaatggagtcgcttatatagccctcagccatggcgtttcagcacctgatatggcgtgtcagctcctgattcgttgctcgcccatcaccccattactatgccctgagatgggcagtgactaggagtgagttcactctcgcacctgcgtacaaggcttgtttactagttaggcacagcagaggccagcaccgtcttataatggtgattgctcgcagctcgcaattgctcgcggcacggctctccacagaaaagggtcttaaagacaggtaaaagagtcagagacagtccctgctcccacaagaacaccaagttacataactgtcttagttagggtttccattgctgtgaacagacaccatgaccagggcaactcttataaaggacaacatttaattggggctagcttacagtttcagaggttcagtccagtatcatcatggcaaggaagcctggcaggatgcaggcagatgcggtgccgcaggagctgagagttctacatattgacccacagacaatcaggagagattatcttctgcaggaagccaggaggagggtctcttctgtcctgggcggagctcaaacataagacctcaaagcccacccttccaacaagaccacacttcccagtagtgccacctcccatgggccaagcagattcaaaccaccacagcaaccaaaacacatgcagaggacctaggtcagatccacgcaggctccctgatctctgtgacccctgggagtccaggtcagttgattctttaggccatgttttcgtggtgttgacccctcggcctcctccaatccttcctctttgtcctcctcctcttcctcttcctagggactcctcaagtttgtgaaagtcaaaggacaacttgtgggcgtcagtcccagggatcaaactcagctacaagtcacaagtgcctttacccattaagccatctcaccaacccaaaattttagcgagaacttgtctcaaaaaccttgaaaaaccttgctggatctcattagtagctaattaaggtcatttgtccagcaaatgcttaggaccgctcctgctgtgtgcttagcagggtaatttcaaggattaggtaattacagcctgcaattacagcctgcaatccacttagacaagtagcgagtctgggatcctgcagacaccatgccaatctctgcagccagcaccaccagcaacaggaacctctaagcttcccccatgcttcccaggaatgccttggtctaatgctgtgacaattctccataccccacttccgacatcctgagtgtccctgcacactagtagcatcagggacaagagtcagcctgactggtcccattttgtcaaatatcagacagaactatctggtttcctcttacaccattttgcaacactcctcagcccttaccccaccctgcctactcactcagcccttgaagctagctcaaaactgaaatcacttaaagggttgctgacggtacaatctgtaattgaggctatttgggaggcagaggcaggaagataatgaactcaagggctgctggagctacagagttgagttcagcctggacaatctagtgagatcctgtttcagattacaaaataaaagtgatctgggctgggtggtggtagtgcacgcctttaatcccagcacttgggaggcagaggcaggcaggtttctgagttagaggccagcctggctacagagtgagttccagggcagccagggctatacagagaaaccctgtctcaaaaaaccaaaaaaaaaaagtgatctgggatgtatctcaggggctgagtgcttatcccgaatcctccgattgaggcctggaggtgagtttcagcagtcgagtgctcgcctaacctgtacaatgccttgggttccagaaaaaaagggggtgggagcagggacagaggagaggagggggtggaaatggagggaagggagaagagataaaacatgaactcagaaccaggaaaaagaaactaaagtgcctcctttcaagctaggcacagtgatgcacacctttaatcccagcactcaggaggcagaggcaggcggatttctgagttccaggccaatctgatctacagagtgagtttcaggggatccagaacgatatagagagaccatgtcttcaaacatcaaaacaaaccacaaacccacctccttccaaactaaattcatagccaagaaatagggccagtgagagggctcagtgggtgaagatgcttgctgccaaggttaacgacctgagtttgatcccagggaccaacttagtggaagaagagaactaacttctcaaagttcttgtgacttctacactcatgctgtgtctcctacacacacacacacacacacacacaacttttcattaaaaacaaaacgaggaaaaacctgtagcgtaaccaatagcaggtaaaggagcggagcttccacaggactctggtccccagggttgctgcggcttggccgagctggctaggtggtgcctgcttcctccttggccacttgataagcttttagaggcagcttcgagatctgataaagaggatgactgctcccaggggaggaggaattttctaaagtcttttcttccgttattttttttacgtgtacatgttttgtctgcatgtacgtctgtgtaccccatgtatgaagtaacctcagaggcctgaagagggcagcagatcccctaggctggagctagagactgttgcgggctgccatgtgggggtccttgaaattgaatctgggtcctctagaagagcaaccagtgttttttaaccactgagccatctatctatctcaagaggaatatttttccaggggtacacgagtgactgtgcttccctgctggaccctccaaaccagctcttggggcccatctgtaggaggacatacaaccctcttgctttctaaacaccagacgtgggcaggagacagctgagtgggtaaaggcactacccttggaagcctgatgaccctcgtttgattcataggacccacacatgccagggctcatatttgtaatcctagcacacctgcagcaagatggaagaaagagaaccatttgggagtctgtgggtcagcctgtgggccagcctgtgggcctaaagtccactaagtgaggagcagacacaataaaagtcctgtctcagcagggtagaaggggagaactgattccttcaagagttgtcctctgccatctatacactctctatgacatacgtgtgcgtacgtgcacacacgtgcacacacacacactcatgcacaaacacaaagaggaaaaaatcttcagatacatggaaagaaaaactatttaaaaaacatcgcttaagaggcagaggcagaggcagagccagaaagattaggagttcagcctaatgactatacatatagtaaattcaaggctagcctaggctatacaaaattttgtttcaaaaaccaaagtaaagcagcagctaagaaaggcagagatgacttgagagtagctggagaatgggacacaaccctcccatgacacagagggccggcaatggaggctacaagaagaaaggcagagtctatgctggcctgacagtcaaccctgaccttcacctccaaataccccagaatgagcaggcaggcttcctttcaccaggccgtttattatcacagcactctgtggatggaccacccccacaacagtcctgggtccgtgtggccttccttggtcggcagggcacagctttgctgggtgaatgggtagtttctccctctctctgtcctttgtgaatgagctggggtgggttgggaagggtgggggtactttctctccctgatgccaggtttacacggtccacttcagacacctgcagaaagagagagagaagcccattggagaaggagggaggtcctgggatgctacatggaataagactgtaggcatggctgggtcaggctcgggctcacctggtctcctgatgggtacccaggcagcgcacggtgcagtaccgggcaccacagctcacacaggtatacggggatgggaagccacacacagcacagaagggacgctggggccgagatggggggccggcacaggctgtcaagtagttggggccctcagatgcactcaggttctgcaaggacatgaagggtcaggcatccggaattctccagtccgccatgcagctgatgtccacaaggggcgctgaagagcaggaccttgctcaccccccccccccccctccgtgctctctagggtcccaacctcagactgagccttctctcacctgctcctccagcaaagcctggaagtttttccggaagcgaagtttaaagtggtcacctcgagttttcttctttttctttcctgggggatgaaggacactgagttgctggacagtggctgtgacagtcctgttggagaggcctatccacaccacaatcggggtctgtccctccctgcctacatctgcactaacgctgactgatatctgcaatcctggtcgaccgtcagctacttaaaagtccaacctactccatctttttattttggggacaggagctgatgaagcccaggttggccatgaactcactgtgtagataaacggtgatctttgatcgatctccctgttcccacctctcaggtgctcggattacagtcttgttgttgttgctttgatacaaggtctcactacctaccccaagcccacttcaaactcactatatagaccaggctgaccttaaattcttggcagttctctggcttcaaactttctgtgtgctgggtcgctatacctgattgctccatcttttttatcccacacatatgaagaaactgaggcacagagacacagacaggaaaggcagatgctcccaacacaggagccaggcactggcaaagccagaagtaattcccaagtcaccgccctactgccagccttccctcccacagtcccgacgccttccctttcctccagcccaagggcagggatattttatgtggtctgtccctctctgcctacatttgtataaatgacacacttgagccggcaagatggcgggaaaaggcgctggctgccaaggctgccatcctgagttcagtccctggccctcagtacaaggagaaaagctactcccaaacattgtcctctgacctccatgccacacatgaaacaagagagattatttaaagtttaaaaacatcttgccgggcgtggcgcacaccgctgatcccagcacctgggaggtagaggcaggcggatctctgtgagttccagaacagcctggtctacatagagagaccctctctcaagaaacaaaaccctccctactataaacagaccagacaacaggcacatacatggtgtttctagcttagcgtatacagctgttcctggttggtttgctgagctaaccaccccctccctgtcagatggccttggagtacaaagatgacaccagcagacactaatttgactcagtggttcaagaagtgccggagcccagcccagacatgagcagagtaaggaacaagtacacaggatgataacaaaggtcacggccatcgctagtctcagagatgtggctgacacctgacacagagggaaggggaaatggcaaccaatccagatgattgacagccttttgtctctgtctataacctgctgactgaacatggtttgtttgtttgtttgtttgagaaagggtttttctgtgtaactctagctgttctggaactccaattgaagaccaggctgacccacagaaatccacctgcctctgtctccctagtgctgggcttaaaggtatgtgtcattgtgtcatgtgtgtatgtgtgtgtgtgtgagtgtgtgtatttgtaaacacacgtgcacatgtgagcaatggctcccccaggctagaagatggatctttagaatatcaataagttgatattaattaatatcaataaatttctcagattgcctgctctctgaataagttgcagttttaaagaaacaggggctgctaagatggctcggtgcttaagggaacctgctgctgaactcagcaacctgagtaaccagaatttcaactctggaaggagaaaacgaactcctgtaagttaatttctgatctccacaggcaagcgtgtgcaggaatgaacagacacacatatgcatgcacacaaaatgaggaaattaaaaacacaataaagatgcaattcccatctgcgctcattggcatcatctgcagttacgggtgacaaggagcttcacggcactgtctcgctcctcctccctaacccccatctcacctgtgtctgcatcatcatcaaactgaggtagcctcttgcccagctgggggaggccggcatgggggtcatcctggaagttgtcattctccaatgcctccagctgtcggttgatccgccgctgcctggctgccctgtccagcacccgccgctgtccagggtcctgggagcgaactagatggggcaaagagagttaccggggtcaagacaggaggaaagttgcactgccgttgcctagagccccagtctcctcgcctcggccccttcattatgctgtgaggaattcccagatcttcaccctgctttcttccagcttggcaagcttgtttcggccctttatgctgcctctaagtcctcccagtcccagcaataactggagacacaataaattgcagctggagagagggctcagtggttaacagcgctccctgctcttgcagagtgctacagctgtttccaggacccaggaccagcagccatgagggtggctcacaactttctgtaattccaactgcctcttttgtccttcatggatacctacactcacctgcacagagcagcacacatacacaaattaaaataaagagcgcctttgagaattgacacagtattgacttctggcctccatattctcaagacctgtgattcagtagggcaaaatccagtgtacatttctagaatgttccttcagcctgagacgcatgcctgtgccctgtgactgcaccgactaccttccttggactaaaagtctccccagtgtggctcccagatgtccccctatcttgttggatatatttcctatcccgacattttgtctcctctcttgctctcgaggctgcttctgcctgtcctttttctttaattgatagcgctctttggcctgtccctttctcacccccacaaccttcaataggatctcaggaagcccaggctggcctgggatgacctcctgtgcacagccacaccaggcttatgtgatgctggggatagagcaagagttttgggcatgctggacaacaccctatcagcaggggctcatctctgacctctttttcttgtatttctatctttcttcaaaaagtgcatttattctgagtgtttctgtgcacatgtaggtgttgcagtacacgtgcagagatcagaggacactgtatggaagccttttctcctatcatgtggatcctggggactgaactcaagtagtcaggcttggcagcaagcaactttacctactgcatgcaccatctcacctgcccattcctggtgctgggtttcccataacatgccagtctcaaaccagaactcccccaaaccacagacttcaggactacaggacaccaagaggctgaggtccagcctaatttacataggcagcctaggctacattaaaaaaaaagagaaaggaaggaatgaagtgtgtatgttcgtgtgtgtgtgtgcacgtgtttgtgtagtacccaaagccaagccctttgatttcctaagtttctctgttccctccatccaacatccagaagctggaggaaagtggggcgatggtggcgcacgcctttaatcccagcagtgtggaggcagaggcagaggcaggcagatctctgtgagttccaagccagcctaatctacagagctagttccaggacagccaagggtacgcaccctgtctcgaagaaaaaaacaaaacaaaacaaaaaacaaaagcaaaacaatccagaagccgaggtgagtaccactgctcatagcacccgagctttggagagacaacacatcctctccatccccaacgtctgctgaagcaagcagtcacaaaacacgaattaatggttccgagactgccccaacactgagcgaaggtaattgacgtgaaaagctaggcggggagatgttaggctgaatttgaacttgggaagcacaaaagggcgaaccactcaaggctcacataccggcgggtttcttctccaccattggcgcaacacagttgacagaagagcctactgcgcacgcgtactaaccaccgacccttgctctgagcacaccccttccggtggcgtgcacacgtacgcgtgcgcagtctttcccctcccgcttgaagtcattacgtgatgttcccttggagatcagcaagctttcgctttccgccatctttgataggggcaaacctacttccggtcgcattgtggttacccaaaaaaaaaaatctgagagccgcctgcaaatggtcactttttaaaaactggcgtgggtggtctttaggggagcgctcttgtccctgtgccctttgcatccccggtgcgtgtccccgcgctgcgggacaggataggcaggttcggtggctttgttgaacccagacccacgaggatgtccgcgcgatcccgcctccggcttcccggcccctccgggcccgtcgcccccgccgcgcgccaccccaggccttgccgtcctgtgttcctccgggtcagacttgtggtcaagacccgcccccgcgtcgcctggaccctcctcaaaaggtcacttcccctcccggggggattcggttgctccggtgtgagtcaggcagtgcccaggaccggaccctcggctcctccccaccctccagcccgcgcccgcgggacaatccttgccttgtctcgccgtttgcatctcgggttttcggtggcctcgggttacgccttttttccagggcggagtcccgagcacagctcctcctctcagcgggctcggtttccccttttcccagaatcttcccggggcgtcggaatccaggcgctcagctcagcgccggtgcgggcctgggtgtagcctaagcgtgctgctagccatggctgcggcaggcccggaaccccggcttttgctcctgctcctgctgctgctgccgccgctgccccccgtaacttctgcctccgatcgaccccggggcgccaatgctgtcaacccaggtgagaacccgggcggccagtgggcagggtcgacacgtccgccagcctggaagggagtgtccagccttcctggaacccagtgcattagcctttcatgcaaaactaggggttccaggctccccagacagacaggaacaccccagcccccattcgtgtatgttactctcacccgactcttctggagatcaaatgtgctgaaagaactttagtgaagtaatatggaggtgtgtgtgtgtgtgtcgggggtgatacagagggctaaacacgtgggacactaagccgtgtcttaagtgccagttctctggctatgacagacaaattgctggtgatcactgtggctacggcagagacagaggggtaccggcgttttctgcagtctgcggagttctttaactacactgtacgggtgagtggggggacccatgggagaaattccagcgggagagggcaggggtcgtgggggttggtcctgtttcctcatcttggccagctgaacctcttccgctgcgtgggggtgggatctttcctgcagaccctgggcctgggacaggagtggcgagggggtgatgtggctcgaacagttggtggaggccagaaggtcaggtggctcaagaaggaaatggagaaatatgcagatcagaaagacatgatcatcatgtttgtggacaggtaaggagggctggggtggaaagagtgggaaactggttatggagagagaaaaagagactgaggttcctcctggctctcgtcttccccttttcttgcccagctacgacgtgattctggcaagcagcccaacagagctgctgaagaagtttgttcagagtggcagtcatctgctgttctctgctgagagcttctgttggcctgagtgggggctggcagagcagtaccctgaggtgggcatggggaagcgcttcctcaactctggtggtgagtggccgagttcccaagacagacttgtcccctctctatctctccctcccccagtggagcaggcattgcatgctctgggtgcttgagtcggggaccctggcagtctcgggaggtctaactcacttctgcttgccacccccccaggattcatcggcttcgctcccaccatccatcagattgtccgccagtggaactacaaagacgacgatgatgatcaattgttctacactcaactgtacctggacccagggctgcgggtagggagactcagggacaggaaccccctctccagttgaatgggagggaaggcataaagggagttggagaaagagagatatagtgtcacctgtcccccctccgttcactgctctatcttatgccatctaggagaaactcaaacttagtctggaccataaatcccggatctttcagaacctcaatggagccttaggtgaggacggtggttagaggtgggtaatgagggatgggttcctgccagaactgggttgatctacaactcaccagtatgctaacttaaccaactcctgagcatgtgtgttagcgatggatgtgtggctcagtggtagagcacctgcctagaatcccccaatgaaaggctgggggtgtaactctgtggtagagagtgtgtctagcatacagaaactcctaggttcaattcttagcaccacacaaaaacaaaaggaaaaactggtgtttggagctcgggtatcgatctaccgagcacttgcaaagacctttgtgcaccagaggagttgggatcctatcgcttcacaccttaaagagcctgttgcctcgtggttccaaaatgaaggagctcttgaaaaccttcccctttttgcccccagatgaagtgatcttaaagtttgaccagaatcgtgtgcgcatccggaatgtggcctacgacacacttcctgttgtggtccatggaaatggtcccactaaggtgcccccaggccctcagccctccacgcccccccccctgctaccccaaccctcctggaccccctccccctggttttctccattcccagcagaaaagggtgccaggatggctgcctcaccctgctgactttttcctgagcccaatgtccttgccatctgtccccagacacctccactttagccactcaaccctgtcccaacagctccagctcaactacctggggaactatgtccccaatggctggactccccagggaggctgtggattctgcaaccagaccctgaggacactcccgggggggcaggtgaggacagcacggatgtcagcagagggccagctgggcggcctggggctgagctcctgtgcacctggacctggccgagtgggcagtgggtgactgctgtgggcagagagaggtctgggcttgtgtgagccttgtcctgtggtgtcccccagcctcccccccgggtgcttctggccgtgtttgtggagcagcctactcccttcctgcctcggttcctgcagcgcctactgctcctggattaccccccggacaggatctctctcttccttcacaacagcgtgagatatggagagcataccccttatcccccatcccaccgcactgacacctccttccgtctgtcctccctgactgcatcccccatgtacccacctctctgcccagaccgtcagtgtatccctctctccgcccatcttcaggaggtgtaccacgagcctcatattgcagatgcctggccacagctccaggaccatttttcagctgtaaagctggtggggccagaggaggccctgagcgcaggggaggccagggacatggccatgtgagtgagtctgcctgggctgtggtcacactacgctcccctccctcatcctctgacacagacagtggagcccctggggaaggagacactgacccttgacctcatgtcagaaccaggagagccccgctcatccctccatccccactgccctgcctccatgcccccatttgggctcacctctctatctgtggctcttctcctccagggacagctgtcggcagaaccctgagtgtgagttctactttagcctggatgctgatgccgtccttacgaacccggagaccttgcgtgtcttgattgaacaaaacaggtgaccagcaccacccatgcatggagccccagaagagcttcaccccttcccctggtggggcatagtcctatcccatctcgtccatccctcacctacgtcttctccataggaaggtaatagctcccatgctttcccgccatggcaagctctggtccaacttctggggtgccctgagccccaatgagtactacgcccgctccgaagactacgtggaactggtgcagcggaagcgagtgtgagtcccacccacgtaccgtgcagtgccaggcaggcccttccctcggtccccctccgcagcctcctacatacacactaggcccccgctatggaaagggtgatatgatggcctcaggcttgggattctgggggacaccgaggaggagcttctgcagtgagcaaagcgtagtctgtggggttgcccacctagctgatcatacccggtgcctgcaggggcgtgtggaatgtaccctacatatctcaggcatatgtgatccgcggggagaccctgaggactgaactgccccaaaaggaggtattctccagcagcgacacagacccagatatggctttctgcaagagcgtccgggacaaggtgagtggggtggttggcatgggttgcccatggggactcgacgctgtgcccacagcctcctgatgtcctcctcacgcatgcccaccctttaccccgctccagggcatcttcctccacctcagcaaccagcacgagtttggccggctgctggctacttctcgctatgacacagaccacctacacccagacctctggcagatctttgacaaccctgtggtaagaggggacctttgctccctgcttccagcccatagcccccaccaccattgctgatcatgggagggcaggcgttaagaaggctccgctcgagcgccctaacccttcctacaggactggagagaacagtacattcacgagaattacagccgggccctggatggggaagggctagtggaacaggtaagctgccccaggaccttggcccgtgtgaagtacccactgctggcattggtgggttctaagctgagcacccggggactgagggtttcctattcgggcgagaggaaggctaacggccacactaagtgttaagggcctgtaatcttagaggtctggaaggtggtgcagaaggatggagagtttcaggctaacctgggctacataataggtaccagaccagccatggtcagatggcaagaccaagtctcaaaagaagaaaaaagatgggctgagagagaactcagtggtcaagtgcttaggacataagcatggcgacctagtacaggtctccagagcccacctgcagttccagactgaggacccgcagcaggttgattcgcaagactggctgcatccgtaagctctgggttcgattaggagatcatgctcggtggataaggtgaaagaacaatggagcagttcctggtgtcaacctcagaccttcgaatgcacaaatgtgcacacacacacccccaacatagccgtgcccacccgcacatgcacacccccacacagccgtgcgcacacgcacataaaaacaaacagaggtgtggtacatgccaataatgccagagcccaggtcgaggaagataacagggatttggagttgcagggcagcatcagacacgtagccagttcaaggccagcctggggactggagagatggctcagcagttaagagcaccgactgctcttgcgaaggtcctgagttcaaatcccagcaaccagatggtggctcacaaccatctgtaatgagatctgactccctcttctggagtgtctgaagatagctacagtgtattcacatacataaaataaataactcttaaaaaaaaaaaaaggccatcctggattacatagtaagaccttgtctaaaaataagtaagtagatgggctggagctggggctcgtgcagtagagagctcccccagtattcacagagccctaggttcagttcccagcacagtataacccgagcatgaagttgcacgcctgtgatctcggcattcaggaagtgcaagtaggacgatcagtgccagcctcagctacctagtgagtttgaggacagcctgggctacaaaagaccctgtctcaaaaaggaggaaaaaagacaggacaagatcattgttctagatgttggggctccaggccccctattcctgccctcctctgctaaaacacccttcctctctccacctagagagcttgggtcagccctccatagatcctctcctgtgtgtctcccctcccctgtccttgttgcctgtcccacctctcttctgtgagcttcaccttgccttgtcccttgctgccctgctctgtccctagccatgcccagatgtgtactggttcccactgctgaccgagcagatgtgtgatgagctggtggaggaaatggaacactatggccagtggtctggaggccggcacgaggtgaggacagagggctcccaaggggacagggtgggcctgaagagggacaggggacttgggggatagaggggatccccaagggcggggctcataaagagtatgctagttacttgtggccaggagaaagtatatgtccaaagcaacttgaagaaagggtttcttgtggctcacagtctgcgggcacaagcccatcatggcaggaaggcatggcagcaggagcgtgagagagctggtcacgtggtcatattgcactgtagtcggaaagcagagagatgagttctgttgctcagctcactttcaggccaggaccttagcccaggggatggtgtcacccacagtggtcaggtcttcccatctccgttaacctaagctagacagtccctccccagcatgcccagaggcttgtcttctaggtgaacctaggtcccatcaagttgacagtcaaggttagctataacacagaggttgcttggggctacggatgttagatagcatgggaaggtggcgtggattcacagcagagctaaggacagcagagactaaagggcccggcagcagtgagtctgccttgacaatagaagagaaaactgcttctagatgtcacagacagaaagagactccggctgggcagtcatctgcacacctttaatcccagcactctcgacagaggcaggtgaatctctaagttcaagcccagcctgatgtgtagatcaagttccagggaaccaaaacaaaaaacctgggaaccaacaagaagaagctggtattgtccctgaaggagaatgggctagcccagggatgtgggtggctgagtgtctgttgctcacaggattccaggttggctggaggatacgagaatgttcccaccgttgatatccacatgaaacaggtgggatacgaggaccagtggcttcagctgctgcggacatatgtggggcccatgacggagtacctgttccctggctaccacaccaaggtgggccatcccaaccgctgctgtacctcttcttgtaccccagtctcggaaggctctatgtggaccccgccctcagccctttagcaactgaggcgccacggacttggggcccaggataaagatggactcggaaggaagttaagcctcctactcgggccactgtgctattaggagagtcactggcagggcgtgttgacacctgtaacctcagcatttgggaaactgaggcaggaaggtcgagtttgaggagagcatgggctgtgcagtgagcgcctgtctcaaaacaggagagagaggctggagatgtgggtcagccagtgcgttcacccagcacgcacaaagccctggcttccatccccagcactgcatagcctgggggtaggagcacagcctgtgatcccagcactcagacggtagagcagggggatcagaaattcagggtcgtctcgagctacatagtttgaggccagcctgggctacaaaaaataccttgtctcaaaaaatggggaggaacgggactggggagatggcttggtctataaagtgcttgttcccatgtcttccacctcatgtacaaaacaagtaaagggctagccttggcgtgccctgcccttcccatgacttccaccttgtgtcctcacagacacgggcagtgatgaacttcgtggtccgctaccggccagatgagcagccctcgcttcggccacaccatgactcgtccaccttcactctcaatgtcgccctcaaccacaagggtgtagattatgaggtgaatgtagggtcctttctgtcttggggcccggggggctcctccacacccttcattttacggtcttgtctctgttaccccctagcctccggctgggccttcttgagtttctcagtggtttcctgtcgtgtcttggctcagccaccatattaattagctttccgctgctgtaacaaaacaccgcacggaagaaacttaagaaggaaagttacactgcttaagcgtctccgtcacagtccatcgtggagggaagccagggcaggaactgaagcagggcaggaacctggaggcaggagctgatgcagaagccatgatgctgcttgctgccttgctcctcatggcttgcttagctattttcttagacactccaggaccaccagcccagggatggccccacccaccgtggactgcgccctcccacatcattcatctgtcaagaactgccccccacaggctcacccacaggccaatctgacagaggtgtttcctcagttgaggttcccgaggtcctgacaatcccagcttgtgtcaagttgacaaaatcccaactagcacagctgctctcctccttcctcctgctccccaggactccactggtgacgtccctgttcctgccacacactccctgacaagatagtggaaggaaaagagggagggtctaagtccaaggggacggtccctcacagggaaggcacagcaacggcaggagcgtgtccacaatcaggaagcagagagagtcctggtgcccagctcactttgtcctttttattcagtcctagatgccagccggtgggttggctcaccctgattcagggtggctctccctgccctcctctaacccattttagaaactcccactcaggtatctccagaggtttgtttctatgatgattctaaactccaccaagttggcagtccagatcaacaaccacatagcctcccttgtccatttgattggcacctctcccacatgcctgttgcccccctgcaccctcatcaccctgtgaactaaccttagttttattttcgtgatctcatctccccagggaggcggctgccgcttcctgcgttacgactgcagaatctcctctccgaggaaaggctgggccctcctgcaccctggccgcctcacacactaccatgaggggctgcccaccacccggggtactcgatacatcatggtgtcctttgttgacccctgacactcaaccagtctgccaaaccttctctgccactgtgccttgttggacaacctgggtcgccattctcagagagaggggacgctgcccgtctcatctcccgagagtgtctgtgtgcctgggatggaatgtgctggtcccaacagtcctcaggaggtccctggagtcttccacttgcccactgaccccatggactcagggaaagtggacttctgagggtcccctgcctgataaattattaagcttcctcagcctcactttcaataaaaggatgtttgtaaccattgagtccgtgagtccaatataaagacagggtctcatgtgtcccatgctggcctcccaccatgcacaaatacacatgattaaaatttttttttaaaatctgcaaaatatttatttgtgagtgtgtgtactcatgcatgtgtatatgtgtgcacacatatacatgtgtgtgtccaagaacaagcaggagcctgtgggggccaggaaagggcatcgtagcccctggagctggagctcctggtggctgggagacacttcacatgggtgtgggaattgaacttaggtcctctgcaagagcagttaagcgctcataagtgctgagccatctctccagatgctctctacccaccctttctatgcatggcagtcatttagccagattgtgtgtaggtccaatgtgtcccagctgctctgatttcaggattgtaagttcgtttatttgttgtgcctgaagacactagaatgttccaacagctgggcaccagaacccacctgagatgccacagttttcacttgatgctcacagcctggggaattcgaccttaactagacacaggcagtgactatggggttttcaagcttgttcttgtaaaggccatggtgtgtgtgtggcggggggagggggcgacatcccagttcatctcagatctctctaactatggaattcaaacactttgccctaggctcctggctatgacccaggtccttcccactgccccttcccgctggtcggggctcctgcaagctcagggaggaatatctttgccttgtcccagttcacagttcactgtccacgtggctcagtgtgtaggttgggggtggggagggggggggctccccagcctcctccagccccctgcaccggagccttcaagtgttggctgtgctccagtgggtcttttccttcttgggacttggtgagcccccaaaccactggaaccagacagacctggctattggtgctctgctcccatgatcctaatgaggtagaacagacctctggggtccttaatggaatctagggcttaaataccataggcctgggagggtgggccagaggggaggaaagggcttattacatcttcgggttgtttaaaaaaaaattgtattgtgtatatatatttgtggggtggcatgtttatgctacagcaaatgtgtgtggaacagagagcagcttggcctgtcctttcactatgtgggattgggggatggaacccaggtcctcaggcatggcagcgtgcacctttacctgctgagctatcttgccagccctgcacatctgggctcttagcctcgctctctatcttgccctccagccctgctatgcctggtgacattgattctagcctccctaggccgggcttggacccttgtggttctctacctgctctggctttatcgagactgacacatacccaggatgaggggtcgccagtctgcctgggtccgcaactggaagtatttccgagatgactttcccatcacggtgagaggtcccagaaggtgccctgggttgctggatgcacggggctctaaaatagctaaatgtggccaaccctctcctgtctccaaggccatttctcactgggaaatgggatacatttatagtctctgctctctcgctcgttaaaacagctgagttggatccatcccaaaactgcctttttggttttcatcctcatggggtcctggttgttggggcaacttccgtacagaggccacaggcctcttctgcctctttccgggtctcaagccacatctactcacgttaccatgttggttccaaatgcctctcttccgaattgcattatgaccagtggtaaggaagatcagggcactgatgtcaccgtgttcctcttatcccagggtgggggtggggagctcctgagcttacctctatcttggtggtgtctagcctttgcccttcccacctaggtttagtttcttctgacaaggctagcgcttcctatctcttgtcccaccctgagggtggccaggtggccgttctggctgtgggaggtctcctggaggctttggcggcaaagcctggaacagtgagcttgcggctccggaatcagaaaggattcattaagttatcactggaacacgggtgaggagtgggcgggtggcggcaggggcgtatccatcggagctgccctgcatgggaggaatgtgagcctgtatcttcaggccccgtcagccacgtgcgtgtctgttcctgttcctccagggcctctctcatgcctgtcttctcctttggagagaatgacctcttccagcagtttcccaacccgccaggctcctgggtacggaggatgcaggaagcacttcagacaatactgactgtggctctgtctctcttccatggtcgcctgggtctcctgataccgttccgcgtgcccatccacactgttggtgagccatgtacctctgtctcatcatctcccagctgagaggactgttcccttaaagcccgacatcctagccttctggttcacacgcctggcacttgctccgagcaggccccgacctctgtccaggcagatccccggttagtgggatgtctcagcaatcagtcttcttccctcatgttccttcctcagtgggcgccccaattccagtgcagcgaagcccgaggcccagccaggaacaggtggaccagttgcacgagttatatgtagagcatctcacacggctgtttgaagaacacaagatgcactacgggatccctgctcatcaacaccttgtcctgatgtccatgtccctgtgtcctggccttcctgaaaaactgcagggtgggattggggacatgattaaaggtggaagcagacaagaagtgtgttttagccgggagtggtggcgcacgcctttaatcgcagcacttgggaggcagaggcaggcggatttctgagttggaggccagcctggtttacagagtgagttccaggacagccaggactacacagagaaaccctgtctcgaaaaaccaaaaaaaaaaaaaaaaaaaaaaaaaaaaaaagtgtgtttttgtgtttggggagggcggggagaaagagataagccacagggcacaggggcagggggccccattgtcctcactgattctagtagccaggaccactccctgcaaacagacagcattgcaagcacttgcctgtgtgtcagggtcctcctgccctgcctggcctgaatgttagagatcaaagtctcaggtccccaccattgcccgagactgtggccagtgggcaggctagccagctgcttccctaccttaatgcctcagtcaccagggaggcgagcactgtcccctttctatagtctctttccctctctttctcaattccaagatcctcccagtaacttacccagactcattgaccaaggaagttcaaaggtcagtccaaaaaggagcctagaaagttctgggtctccatgtctaacatccgatcacctcagaagtgagctgctgggctggtgagatggctcagtgggtaagagcacccgactgctcttccgaaggtctggagttcaaatcccagcaaccacatggtggctcacaaccatctgtaacaagatctgacgccctcttctggagtgtctggagacagctacagtgtacttacatataataaataaataaattaaaaaaaaaaaaaagaagtgagctgctccctgggagttcacatccccaaaccttcgccgtctgtttcccgggccctggagtcctggtggcgcaatgggagccattaggttggatgttcccatgccccctcccttctctctcatcagaaaatacctcagaagcaacaacttaaagtgataggcacctactggttagtgctcacttttctcttcatgggtgagacaggaaaggggtgggggtggggcaggcatgggggcccagagacaaggggactaggaaagggggattagaagacatatggctgacctatgacccttgtgggtaccaggcaccaggaaagggcctgaggagaccacaaggctctttggcaggggtggaggggagggagccgattgtattgactgactgcatgacaaaacctacgtctttccttttcagccatgccctttcttcacccttcactagagatgattcttgtctgtgttttgtgcacgcgcatgcagttttgtttttgttttcaaatatgtgtgggtacaggtgtgtgtgtgctcatgtgtgttgcacatgtgcacacctgttgctcttggagacctgaggttgagcccagcacttttccaccctgaaacagggtgaaacagggcctctcaatcaaacccagagcactgaaacagggcctctcaatcaaacccagagcacactgatatggctgttcttgctagctggtttgccctgggattcctctctccagcttctgaggctagaatttcaggaggcgtccatgcccacttggcagttacctgagttctggggatctgaggtccccagattgcctggcaaacgcttgccccctgagccatctgcctgagtctggaagatggagttttccctgagaacaacacttcagccctgccctctctctgcatgcaggcggaaggcgctgaagggtgagaacgtggagaatttgtagttccctatcaaggtaaccagtttaaactcttgaaagacagtcttctttttctctgccaccttctcaccttcctccatcctggagcctgcactggatgggtccctgagctcagacatggggtgacatgaaagagtgacctcctgaaccctgggacccatcttaggaccttgaactttgaactttggtgaggtaaagacacatctttccagcagtaatcttggattcttggtttttaatttaactttttagatggctcagtggttaagagcactgactgctcttcaaaaggtcctgagttcaaatcccagcaaccacatggtggctcacaaccatccgtaatgaaatctgatgccctcttctggggtgtctgaagatagctacagtgtacttacatataataaataaataaattgttaaaaaaatttttttaggggctggagagatggctcagtagttttaagagcactgactgctcttccagaggtcctgagttcaattcccagcaaccacatggtggctcacagccatctgtaacagatctgatgccctcttctggtgtgtctgaagagagcaatggtgtactcaggtacatacaatatataaataaatctttaaaaatttttttaaatttacactttatttatttggggtctggggaggggcttgtgcatgctatagagtgcatgtagcagtcagagtcgattttctccttctgtcatgtgggtctcaggggtggagctcgggaggtcgggcttggcaccttctgtacaagctgaataatcttacctggccttcatcctgcattctgtgcctctatctcctgacatctcccacacacctcaaagctactgaaaaccgaagagctacctgcagacgggagctacatgctccgggcccacccccacgagatcatgagcacaggaatcttttgtaattttccagtgacagcaaggccttctcccagctctttcccaggcttgggcctccggtagccatgttggctggactctgctatcttcctctctatggggaatacctcatgttcagtggtagccttgtgtggcacaacctagagccatctgagaagggaatctcaatcaagggatttcccagatcagattggcctgtggttttgtggaagattgtcttgattgttaactgatgtaggaagacccagctcactgtgggcggcatcattccctgggtctgtataggaaagctagctaagcatgcgtctacaagtgagcctctaaggagcattcccctggggtttctgcttcaaattcctgctttagttccttcactgacttcctactgtgatggaccaaagcccacaaactgaaacaaatccttccctcctctaagttgcttttaatcagagtaaacacagagatgaaaaccgaagatgaaagttaggagtacccattggtcatagggcaccccctccataattaacaagatccttctacagcagactcccccctggggaagaaagttgacactagcattggttccactcagaaggggacactgggtgtgctgtataggaagcagggaacaaaggacttagaaggatcaggacttaaggcttgctctttctgtactaaagagtgaggctggaagggctggggatctggggagagagtggtgacggcatcccacttttatccacaaaaggctgtgtgtcctgtgagttgccagagtctggacttcattgtgtcacagccctgcttgggcaggcatcctgactgggggtttgtgggaagccctgtatacagttctgaaggagcactatgtcacactgcggccgcacaaaggctttgtgctcctggcgcgaaggcatgagtgagcagggctgcagattcttttcaagttaggtgttttgctttgtaacaaggtctcaggtagcctaggctggcctcgaaatcactatgtagccaagaatgacacagagctactgatcctcctgcctctacctcttgcatacaagtatgcaccatcaagtatgatcaagtatgcagtgttagggataaaatccagggatatatatatataatataaaattattatatatatgtatatatatgcgtgtgtcattgatattcatatatatcatatatatgttatataacagcaatatatacatagacaccacacacatctctatgtctatgtctatgtctatgtctaggtctaggtctaggtctaggtctaggtctaggtctaggtctaggtctaggtctaggtctaggtctaggtctaggtctatatatctgagttatagccccagcccacaaacccctagtgtctagagggatgcagttcagtatctcagccagcatctaaagggatccattggttccgtgttatactctgggcttttctaattccttgacatccaagtccatgccctctccttacaggttctgtgactcttgagcttcctgctctgtgtcaaggtcattcccagcttgagtgagataggatcttaatacaaacggcaagacccgactcagaacacccttgtgtgtgtgtgtgtgtgtgtgtgtgtgtgtgtgtgttagaggctataagaaggcatcagagtccccgtctaaagttacttgtgtgagccattcaacataggtgcttctggtcctctgtaagaatagcaagtactcttacctgctgagccatctttccagccgcacacctagaattttttaaatttctttttatctttatgtgcatgtgtgtttgcctgcatgcacgtgtaaaagtgtcttttattcttctggtaataattgtcttcaaggcttactgcctctgtctgctaacctaggcctagtcctggaaacttctagcctctgtataaccttatctaggcccagaatgtttccagcctctgagacttgctgttgaaatagctcacccttcctagttctttctgagctctgcctggctggtcagtccagctgttctggctcaacacccctcttcacactaaccgagtcaatgtggcttctctctcggcctcaaactaactttgtcaatctgttctaatcttttggttccttcttattctctagctcgtcctgtcttcacctgtgtctagattgttctctctccgcaacctgtctctgtacaaccttccaggtaaaactgtctcctccccttttccctctctgcactgctctcttaagtggcttccgtctcttcccgtgagagttgtgcatagcctaatctgtcaaatcattctctgattcatcactttgtctgccactcagttagacatcactttcaaacatgggtgcttccttctataaactaactctaccttcactgtttgggattaaaggtgtgaactaagcatgagtctgcattccaaccagagaaattaaagatgtgtgtgttaaggacgagccacaatggaactagaaacggccttttcagtaaataacacaatctccaggatcacaatgggatcaaataccctgtaacatgcatgtccatgtgtgatcaaatgccctgtaacatgcatgtccatgtgtgatcaaatgccctgtaacatgcatgtccatgtgtgatcaaatgccctgtaacatgcatgtccatgtgtgatcaaatgccctgtaacatgcatgtccatgtgagatcaaataccctgtaacatgcatatccatgtatcacgtgtgtgcagtgcccaaggaggccagaaaagggcactgggtctcctggaactgaagttaaagacagttgtaagagatcacgtgggtgctgagagttgaatctaggtctctccagccccatctcctgcccctgcatttttaaacatagattctgggaatcaacatcaagttttcaaaattccatataagcacttcattaactgggcagtatcaccagaccttcaaccctatctcaatgcaaagccaggcgaggtgagacaggcctgggatcccagcacactgggaagctaagacgggaggagacacacatgctaaccagagcaagcctttcttcccccttgccacccttccagggcctccctcctgcctgtgtactccactgggaagaatactatttacagattcaagtcttttgcctaaaactcctggcggcatcgatgtcaagttgcctgcaagagacttgtgggattttccccttgcatcttctgggaccaaagtctcttctcagccaactcctgggatctggtaccatttgctctgcccatcattactgtaagtgagtgggtgtctctggggaagagagccaccatcagtttcatttgcaacaagagaaccctctcatgtacccacatccacccaccctgcagtggccactccatctgtgtgtccccatgcctcaaactcacagaagaccaagtggatcattgtcaccaattctacataaaggctctggaacaactgttcggagaccacaaagagacctgctcctgtccccctcaccttcctctagacctatgaccctaaaccctgggcctgcagatgtccattatgtcatgattcagtctttcccaaatgctaattctgcaggcaaacatgtccagactcgactatcccggtcccaaggcaccttcgtctgggtctctctcctgaccttggttctcttcccagtgagtcttggttgtttcttgaccttgaataagtcattactctatttgcttaaattttttatcaacacatattaattatgcacaatggtggattacatggggctgcagagatggctcagttaggagcacttgctgctctttcagaggacctgagttggattcccagcacccacatggaggtttaccaacatccttaactgtagttctagagatccattgccttcttctgatctccacaggcaccaggcacgtgcatggtgcacacacattcatacaggcaagacactcattcacataaaataaataaatctaaaaaatgaatgggttttattatgacactcttatacacatatacaatgcattttgactatacacccatgaccttctcttttcccttctcccttcctctttccaactagtctgtcttttattttcatgtctttttatttgtttgttttccttgtttgggggatgcagtgagtttcattagaattattttctcaataattctaggcacctcaccagaggctacactattggaaaaaaaaaaaaaaaagcctcatcctttcattaagatccttgcccagccctctttttaaagacagggtctcattatgtacctctagttggcttggagccaactatgcagacaagctgatttcaaactcgtagagatccacctgcctcttggttcctcctctctccatttccccaagtgctggatttagagatgtgtgccactgaggtaatccttgcctggatccttctcc

SEQ ID NO: 758 - DNA, 2574 bp, Mus musculus
ccggggcgtcggaatccaggcgctcagctcagcgccggtgcgggcctgggtgtagcctaagcgtgctgctagccatggctgcggcaggcccggaaccccggcttttgctcctgctcctgctgctgctgccgccgctgccccccgtaacttctgcctccgatcgaccccggggcgccaatgctgtcaacccagacaaattgctggtgatcactgtggctacggcagagacagaggggtaccggcgttttctgcagtctgcggagttctttaactacactgtacggaccctgggcctgggacaggagtggcgagggggtgatgtggctcgaacagttggtggaggccagaaggtcaggtggctcaagaaggaaatggagaaatatgcagatcagaaagacatgatcatcatgtttgtggacagctacgacgtgattctggcaagcagcccaacagagctgctgaagaagtttgttcagagtggcagtcatctgctgttctctgctgagagcttctgttggcctgagtgggggctggcagagcagtaccctgaggtgggcatggggaagcgcttcctcaactctggtggattcatcggcttcgctcccaccatccatcagattgtccgccagtggaactacaaagacgacgatgatgatcaattgttctacactcaactgtacctggacccagggctgcgggagaaactcaaacttagtctggaccataaatcccggatctttcagaacctcaatggagccttagatgaagtgatcttaaagtttgaccagaatcgtgtgcgcatccggaatgtggcctacgacacacttcctgttgtggtccatggaaatggtcccactaagctccagctcaactacctggggaactatgtccccaatggctggactccccagggaggctgtggattctgcaaccagaccctgaggacactcccgggggggcagcctcccccccgggtgcttctggccgtgtttgtggagcagcctactcccttcctgcctcggttcctgcagcgcctactgctcctggattaccccccggacaggatctctctcttccttcacaacagcgaggtgtaccacgagcctcatattgcagatgcctggccacagctccaggaccatttttcagctgtaaagctggtggggccagaggaggccctgagcgcaggggaggccagggacatggccatggacagctgtcggcagaaccctgagtgtgagttctactttagcctggatgctgatgccgtccttacgaacccggagaccttgcgtgtcttgattgaacaaaacaggaaggtaatagctcccatgctttcccgccatggcaagctctggtccaacttctggggtgccctgagccccaatgagtactacgcccgctccgaagactacgtggaactggtgcagcggaagcgagtgggcgtgtggaatgtaccctacatatctcaggcatatgtgatccgcggggagaccctgaggactgaactgccccaaaaggaggtattctccagcagcgacacagacccagatatggctttctgcaagagcgtccgggacaagggcatcttcctccacctcagcaaccagcacgagtttggccggctgctggctacttctcgctatgacacagaccacctacacccagacctctggcagatctttgacaaccctgtggactggagagaacagtacattcacgagaattacagccgggccctggatggggaagggctagtggaacagccatgcccagatgtgtactggttcccactgctgaccgagcagatgtgtgatgagctggtggaggaaatggaacactatggccagtggtctggaggccggcacgaggattccaggttggctggaggatacgagaatgttcccaccgttgatatccacatgaaacaggtgggatacgaggaccagtggcttcagctgctgcggacatatgtggggcccatgacggagtacctgttccctggctaccacaccaagacacgggcagtgatgaacttcgtggtccgctaccggccagatgagcagccctcgcttcggccacaccatgactcgtccaccttcactctcaatgtcgccctcaaccacaagggtgtagattatgagggaggcggctgccgcttcctgcgttacgactgcagaatctcctctccgaggaaaggctgggccctcctgcaccctggccgcctcacacactaccatgaggggctgcccaccacccggggtactcgatacatcatggtgtcctttgttgacccctgacactcaaccagtctgccaaaccttctctgccactgtgccttgttggacaacctgggtcgccattctcagagagaggggacgctgcccgtctcatctcccgagagtgtctgtgtgcctgggatggaatgtgctggtcccaacagtcctcaggaggtccctggagtcttccacttgcccactgaccccatggactcagggaaagtggacttctgagggtcccctgcctgataaattattaagcttcctcagcctcactttcaataaaaggatgttt

SEQ ID NO: 759 - protein, 765 aa, Mus musculus
GASESRRSAQRRCGPGCSLSVLLAMAAAGPEPRLLLLLLLLLPPLPPVTSASDRPRGANAVNPDKLLVITVATAETEGYRRFLQSAEFFNYTVRTLGLGQEWRGGDVARTVGGGQKVRWLKKEMEKYADQKDMIIMFVDSYDVILASSPTELLKKFVQSGSHLLFSAESFCWPEWGLAEQYPEVGMGKRFLNSGGFIGFAPTIHQIVRQWNYKDDDDDQLFYTQLYLDPGLREKLKLSLDHKSRIFQNLNGALDEVILKFDQNRVRIRNVAYDTLPVVVHGNGPTKLQLNYLGNYVPNGWTPQGGCGFCNQTLRTLPGGQPPPRVLLAVFVEQPTPFLPRFLQRLLLLDYPPDRISLFLHNSEVYHEPHIADAWPQLQDHFSAVKLVGPEEALSAGEARDMAMDSCRQNPECEFYFSLDADAVLTNPETLRVLIEQNRKVIAPMLSRHGKLWSNFWGALSPNEYYARSEDYVELVQRKRVGVWNVPYISQAYVIRGETLRTELPQKEVFSSSDTDPDMAFCKSVRDKGIFLHLSNQHEFGRLLATSRYDTDHLHPDLWQIFDNPVDWREQYIHENYSRALDGEGLVEQPCPDVYWFPLLTEQMCDELVEEMEHYGQWSGGRHEDSRLAGGYENVPTVDIHMKQVGYEDQWLQLLRTYVGPMTEYLFPGYHTKTRAVMNFVVRYRPDEQPSLRPHHDSSTFTLNVALNHKGVDYEGGGCRFLRYDCRISSPRKGWALLHPGRLTHYHEGLPTTRGTRYIMVSFVDP

SEQ ID NO: 760 - DNA, 31898 bp, Homo sapiens
ctgacctcgtgatctgcctgcctcggcctcccaaagtgctgagattacaggcatgagtcaccgtgcccggccaatttttaaattttttgtagagatggggtctccctgtgttgcccaagctggtctcaaactactaggatcaagagaccctcctgcctcagcctcccaaagcgttgggattacaggcctgagccacagcacccagcctcattgaagtttttaggagtaaccacccgtgtccacacttccaaaccctggcaccaacctcttcctcctctgtgctcccaggaaaggggggtgctgcccttatcacatgacactaggtttaccttctagaaccttagagcagagtatacatttcccaaagaccaggtgtctcccaaggtaggaaaaaatctccctagcatgaaggaagctggcaaaattgtttcaggctgtccttggggaattatggttttctttcttttttctttttttttttgagactgagtcttgctctgtcacccaggctggagtgcaatggcgtgatctcagctcactgcaacctctgcctcctgggttccagcaattctcctgcctcagcctcccaaatagctgggattacaggcgtgtgccaccacacctagctgatttttgtaattttagtatagactgggtttcaccatgttggccaggctggtctcgaactcctgacctcaagtgatccgcctgcttcgggctcccaaagtgttgggattacaggcgtgagccacctgcctggccgaattatggtttttcaatgggggtccaaagtccctggactcagcttcctagagaatgtcatggatggcatcagagagcaaccagaggccttcagggtccagccctgtcctctcaaggtcattttggaaggcggagtacgtcactggggagagaaatcttacattgaacagaaccagtgtgcctctttttataaccacaaaatatgaaacagtcagctaagttaggaaagaatccaaagagattgtgctgacagtgcaagctggacgggaatcccagcctaggatgccacggagaagcacagatggtgttgttcagccccgaaatagtcttttcttttctttttggagacggagtctcactctgttgcccaggctggaatgcaatggcgcgatctcagctcactgcaacctctgcctcccgggttcaagcgattctcctgcctcagcctcctgagtagctgggattacaggcacatgccaccatgcctggctaattttgttttttttgttttttttttttgagatggagtcttactctgttgcccaggctggagtgcaatggtgagatctcagctcactgcaacctccacctcccgggttcaagcgattctcttgcctcagcctcccaggtagctgggattacaggtgcccaccaccacgcccggctaatttttgtactttcaatagagatggggtttcaccatgttggccaggctggtctcaaactcccgacctcaggtgatccacctgccttggcctcccaaagtgttaggattacaggcgtgagccactgcacccggcctttttttttttcttagccggggtctcattctgttgcccaagctggagtgcaatgacgtgatctcggctcactgcaacctccgcctcccaggttcaagcgattctgctgcctcagcctccagagtagctgggactacacgcacacgccaccatgcccagctaatttttgtatttttagtagagacagggtttcaccatgttggccaggctggtctcaaactcctgacctcaagtgatctgcccacctcagcctcccaaagtgctgggattacaggcgtgagccaccttgcctggccgtaacactccactttttaatgggaggacaaagatttttgagccatcttgaaaaaccacctcacctggattgtctctgaatcctgacatcagccccccaacatgaagctgacaccaaaaccagtactgcctgcccagctgcaagtcttcagagaaagggaggcagttcctcaagaaaaccctggggaatacttgagccaacccccaggaaagtacccaaaagtgaaggcctaacatggtgactggccaggcacggtggctctcacctgtaatcccaccactttggaggccgaggcgggtggatcatctgaggtcagaagttcgaaaccagcctggccaacaaggtgaaaccccatctctacaaaaaatacaaaaattagctgggcatagtggtaggcgcctgtaatcccagctactcagaaggctgaggcatgagggtcacttgaacctgggaggtggaggttgcagtgagctgagatggcgccactgcactccagcctgggcaacagagcgagactgcatctcagaaaaaaaaaaaatggtgcctaacgttgactttgctggatctctctaatatcttaatgaggccatctgttcaatggatacttactaagcacttgctttgctatgaggttaacagggttctgggccttaatacagcaaccaaaaggaccttacgagattacagcttgcaattcatttagacaaggtatgggtataagaagttcacatgagtcacagcacccagggccacccagaccaggggcctctaatccaggggtgtccactcttttggcttctctgggccacattggaagaagaattgtcttaggagacatataaaattcactaacattaacgatagctgatgagctaaaagaaaaaaaaatcgcaaaagaatctcataatgttttaagaaagtttatgaatttgtgttgggctgcattcaaagtcatcctgggccacatgcaggctgcaggttggacaaatttgctctataccatgaattcccccatgtttcccagaaacttctgggttttccgtactgctaataacttcacacactgcagcccctggtaacaggggcttcctaaggacaactgctccctcagtctggcagcaccaaggacaaggaccactcccctttgcctaagtaccttgagaggaagacaggccaaggtccctccgcggtaccattctgcacatgttccacagtcctcccgccacctccctgtcacccatccctggaacctagctgtactttgaaaatatagcaactggagaaataaaaaggaaaaacatggccgggcgcagtggcccacgcctataatcccagcactttggtaggccgaggcgggtggattacctgaggttgggagctcaagaccagcctggccaacacatcaaaaccccaactctactaaaaatataaaaaaattagttgggcgtggtggtggccacctgtaatcccagttacttgggaggctgaggcaggagaatcccttgaacctgggaggcagaggttgcagtgagctgagaccgcaccactgcactccagcctgggttacagtgcgagaccctgtctctaataaataaataaaatagtttaaacaactaaatcaataaccaaaaagacttaaagaagcagccaaggagggcaggggctcgggggtggcaggaaaatgggacagaatctctcgcgatcagggacacagaggggcggacggtggcaggggtgagtgggaggcaggaggaagagagacagagccgtgagcaggagagacgggtgacccattaccatcacctcaaacacaccacgaccaaacaggaaggcttccggcacgaggctttttattctaacagcactggggggcccagcctacctgccagacagttcccaggagtgaggctggtctttcctggcagataagacacagttttgttgggtgaatgagcggctcctcccttggtccaggaagagctccccctgcattgggtgatgaaattctgtctttctgaaggccgggcagtgcacagcggcccttcctctctgggaatgcccaggctcacacagtccacttcagacacctgcagacagaggggaagccaggatgaggggagagaggtctggggaggctgtgggaaggagggagtgggagtggacagcaggtctcatgctcacctggtctcctggtgggtccccagacagcgcacagtgcagtaccgggcaccgcagctgacacaggtgtagggggatgggaagccacagacagcacagaaggggcgctggggccgcgatgggggtcccgcacaggccgtcaggtagttagggccctcggccacactcaagttctgcagagacaaggggccggctctagaactcctccgcccacccacgcagcgaacacctgcccgggccaggctcaccccttccctgtggggtcctcccaggccgaccctcctctcacctgctcctccaacagggcctgaaagttttttcggaagcgaagtttaaaatgatcacctcgggttttcttctttttctttcctaggggtcaagggtgatccgttgcttggcacttgcccagaaagacagcagctttctctggttcatcactccccatgcccatgtgccctcctggttctttttgagacagtctcactctgtcacccaggctggagtgcagtggtgcgatcttgactcactgcaacctccatctcctgggttcaagtgattttcttgccttggcctcctgagtagctgggattacaggtgtccaccaccatgcctggctaattttgtttttgtatttttagtagagatggggtttcaccatgttggccaggctggtcttgaactcctgacctcaagtgatccgcccacctcagcctcccaaatgctgggattacaggcgtgagccaccacacctggccctgccctcctggctctaagtcggcccctcgctaccagcctctgccctccaccccaattctccaatcccagctgacagtcacctccatgcccccaagcctaaggcttcgtgtcagagcttatccagtctctcttgtttatttcacatacacgagaggaaactgaggcacagaaagggggtgtggttgctcacagccatgggagccagtcactggcagaggcaccaggagctcctgggtcctcccacagcctgagttgggcggactctcccgccctcctctcagtcccatcccccgcttcctcctccatccgcctcaccagtgtccgcatcgtcatcaaactgaggcagtctcttgccgagctgagggagtcccgcgtgggggtcatcctggaagttgtcattctccagggcctccagctgccggttgatgcgacgctgccgggcagcccggtccagcacccgccgctgcccggggtcctgggagcgaactggatggagcagggcacgcaaagttacagggcttccaagaaagagcagtgtggccgccgctctgggcagggcgaggaaggcacccggggtggaagctgcagctctctgatctcatccccattgccaagcccttggtccccttgtctcctcccgggccaagcccctgggcccacacttcctgtcccgccagctgagaccctttcagtttctcctgcctgttttctccgccttcctctcaatcccagtcccagccagtgagccccggcctggagacagctcactgctgactggggaggtcacagcgccctggggcttccaggctgtcctgggccctcaatacacatggccctcacactcagcatctcacctcctacctcaaaggaaccaggggccacccatgcttggatacgctcatcttccaggccacctacccacaaacgtgatgccaagtgggcacacccctgccctggagcgccccaagtcccaccactgaccccgagccttcacctccagcccattccctccctctcccatcttcaacccctcctcctcaaccggcactttccatcaaagagctggcgacgctcatgtgtctactcggcttcacagctccttctccttcacagcaactcacgtgatgtgtcactttttcacctcccatcctctccttgaaccccaaaatctgacacctgcctggtcatcctgggggaccacccacccacgctctgggccccagagcggctccagtgtgccttcctcctcctccttggacctgagccctgtccaccctgtggcggtgccgactaccttcatcgagtagaaagagaccctttgcttgcttccttgacaaaactgcaggccttctccatgtccaggaatcctccggctccagctcggctgctctccctgcctctatggaggtggctggccctcttctctgctcagtctatgcactcttcctgggattttgactccaaacaaagggctctgatgatcacccacaagcaaatgactcccagagtgactccctcaacacagaacctgctcccgggctccagaactggccatgcagccagcgcctggtgaggccgggtgtggtggcgcacgcctgtaatctcagcactttgggaggccaaaggatcgcttgatgccaggagttagaaaccagcctgggcagcatagccaaaccccatctctacaaaaaattaaaaaataagccaggcgtggttgcacatgcctgtagtcccagttacttgggaggctgcggtgggaggactacatgggcccgggaggttgaggctgcagtgtgcagcaagccgtgatcgcgccaccactccagcctgagtgacaaagcaagactgtctccaaaaaaaaaaaaaaagaaagaaggaaaaaagaaatcacccactggccctgtggacactgcaactcaaaaaaaaaaaaaaattcccatccaagtctgcttctcctgcagattctctctacgcaaatggaaccgtctatgcagacatccaaaccagaaacctagaagttattttaaacctctttcctcggctggacatagtggctcacccctgcaatcccagcactttgggaggctgaggtgggctcatcacttcaggtcaggagttcgagaccagcctgaccaacgtggtgaaaccatgtctctactaaaaatacaaaaattagcagggtgtggtggcacatgcctgtaatcccagctacgcgggaggctgaggcacaagaatcgcttgaacccgggaggtggaggttgcagcgagctgagatcgcgccattgcattccagcctgggcaacagagagagaccctgtctcaaaaacaaaaaacaaaaaacctctttcctcattgccttatcagctgtttgccagattctgataattttgcataatatatctctttattcattaaccacctgttaagcataataataacagcagcagccccagtagctatcacttgttggacacttactatgagccaggcacgtgctcagctctttgcaacacttgaaccatttaacccttacaacagctgtatgggacagtatcatcatccccaatttaccaacattcagagattaagaaatgtgtccaaagttcacatagctaacaagtggccaggtcaggagtcaaagaactacccagcatcaaaaagcatgaccttgccaggcgcagtggctcatgcctgttatctcagcactttgggaggccaaggtgggtggattgtttgagcgcgggagttcgaggccagcctgggcaacatggcaaaaccatgtttctacaaaaaaaatacaaaaattagccaggtgtagtgggacacacctgtagtcccagctattcaggaggctgaggcgcaaggattgcttgagcccaggagctcaaggctgcagtgagctgtgtttgtgccactgcactccagcctgggtgacagagcaagaccctgtttcaaaaaaaaaaaaaaaaaaaaaaaaacccaaaaccaaccaaacaaaaaaaaatatgattatgatcactgtactactctgtctcccctccaaatgccaggcagtgctctaggttttagggatgccaaagcttacagtccagtggcaaacacaaatgattaatgaaacaaacacagtaagtacagcatggagtaggctaggatacggaagtataaagtgctgcagagcccaggacagaaacacccaacctggccttggagtagtcagggaagacttcccagaagaaggtaagtctaggttaaggcctaactggtgaatgacctggctaggggagacagcggggtatttcagaccttgaggccaacatgaaaaaactgatggctgggagactgcgatgcctttgaaaaactgagagggccaagcgcagtggctcatgcctgtaattctagcattttggggggccgaggcgggtggatcacgaggtcaggagatcaagaccatcctggctaacatggtgaaaccctgtctctactaaaaatacaaaagataagctgggtgtggtggcgggcgcctgtagtcccagctactccagaagctgaggccagagaatggtgtgaacccgggaggcagagcttgcagtgaaccgagattgcgccactgcactccagcctgggggacagagcaagactccgtctcaaaaagaaaaaaaaagaaagaaagaaaaactaaaagggccaagcgcagtggctcatacttgtaatcctagcattttggaaggccgaggcaggaggatcacatgagctcaggagttcaagaccagcctgggcaacatagtgagacacccatctcaacaaaaaatataaaaactagcccagcatggtggcctgcacccacctgtagttccacctactcaggtggctgaggtggaagaatcacttgagcatgggaggttgaggctgcagtgagttatatagaaccactgcattccagcctgggtgacagagcaagactctgtctaaaaaaaaaaagtctttgctggctctccagtgtttccctacagagttcaaactcctgggcagtgtgtataatgcctttcaaaatgtaacctttccccagccttcgatcctttcttattactctgtaagatccaaactgtgaacttggcttcctaagcgacttgctttttcttgcttcactgcctttgcacgtgaggttcccactgagagaaaccctaactagactttcaagactcaattcaagctttttcatttttccttcaagctttcacagtcccctgcctcccagaacctgggctagatgccacgtctccctgttcccaggcgctgtgcttccctctgccatagcacaaatcacaaatcacagtaaaatacagtgttaggtctgcgtttctgccccccttccagaaaaagccaatgcttggataagaggggtctttctcctcttcatccccagcgcccggcttggagcaggcaccaataaaacgtgaatgaagggtcaacgccaggacccgagggctgaggaagggatttacgaggaatagctggggccgggcgcggcagctcacgcctgtaatcccagcactttggaaggcccacgcaggaggatcgctttgaggccaagagttggagaccaacctgggcaacatagcgagagcccgtcaccacataacaaattaaaaattaaccaggcgtggggcctcatgcttgcagttccagccactccggaggctgaggtgggaggatggtttgatcccaggaaatcgaggctgcagtgagctatgactatgccactgcactccagcctaggcgaaagagcgagaccaaaaaagaggaatgactaggtaagaaaattctaggactgacttgggaaggggaagggggcgaaccgcgggggctcacatacccgaagttttcttctccaccattggcacaacacaactgtcggaagaaactgctgcgcacgcgtactaaccccaaggctttagtaggggcgccatcacttccggtagcttgtacttctgcgcgtgcgccacagctttgactcattacgtggcgtttccttggagacaagaaagcttttcgccatgttttataggggcaaaaccacttccggcctcagtgtggaggtgtaaatcttgtgggagccacgaaatgggtcattttaaagatgtggtcacggtgttcttacaagaaatcttattttcctttggtccttgtgaagatgctgtgatcacaaaggcagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccaggtgagatcccggggaggcccggcacggccgagggggcagaggctggcgtgcctgccagcctggcccggagagggtcggaggctcgaggaggtgtctggcccgtcccccgcccagcgtgctcttgaggctgagtcgcgccaagcccctcgcccatcactaccctgaactggggtttccagcctccctatgcaaagggactcggaattcctgggcaccactcccaccctgccctccttggggtcagagtgttcctgggtgagaagagtttaagaatgggaaggaagaaagggagggaagtcgagtgagagggaggacagcaaagcacgtgaggcccggagctgggcggtggatctcaagtgccatttccctctggtaacagagaagctgctggtgatcactgtggccacagctgaaaccgaggggtacctgcgtttcctgcgctctgcggagttcttcaactacactgtgcgggtgaggagagggaaaggcccctgggagggggtcccagcaggaggggtgggctgaagtctggatgcccaggtccccacggtaagcctggtcaggagttccccccacaactccccaccccttgcctggcacggggcaatcttctccacagaccctgggcctgggagaggagtggcgagggggtgatgtggctcgaacagttggtggaggacagaaggtccggtggttaaagaaggaaatggagaaatacgctgaccgggaggatatgatcatcatgtttgtggataggtaacggggctggggatagggagcggggtaaggatgctgaggttcccagtggacccctgcccatcctccccttcctcacccagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggtgagtggcagagtgcccaaggcagaggggccaagagcggtgggacacagagtgttaaaggcgcctgagggctggagacagcctgggggacaggccctgggaccctgggagtctcgaggtcaacactccccctccccgccaggattcatcggttttgccaccaccatccaccaaatcgtgcgccagtggaagtacaaggatgatgacgacgaccagctgttctacacacggctctacctggacccaggactgagggtagggaaggcagaggagtgggcgcatcccgcagctctgtgggagtggaggcctcaggctgaatgggatttggggagcaaagggggttgcaaagagaaaaatgtgtgcctgggcgtggtggctcacgcctgtcatccaagacttttgggaggcttaggcaggaggattgcttgagtccaggaatttaagaccagcctggacaacatagttgagacctcatctctacaaaaaaaaagaaagaaaaaattagccaggcttcatggtgtacgcctgtaatcccagctacttgggaggctgaggtgggaccatcacttgagcccaggagtttgaggatgttttgcaccactgcattccagcctgggtgacagaatgagactctgtctctcacaaaaaaaggaaaaccatggtggctcatgcctataatcccagcactttgggaggctgaggcgggtggatcacctgagattgggagtttgagaccagcctggccaacatggtgaaaccccgtctctactaaaaatacaaaaattagccaggcgtggtgacactctcctgtagtcccagttacttggaaggctgaagcaagagaatcaattaaaccgggaggcagaggttgcagtgagctgagatcgtgccattgcactccagcctaagcaacaaaagcaagagaagaaaaaaagagagagaaaagtgagaaatgatgtcctttccactccttccattttaaccactccatcgcatctcattccatttaggagaaactcagccttaatctggatcataagtctcggatctttcagaacctcaacggggctttaggtgaggaggaagacagccgcaggtgggcgatgcgcagcctctgcagctaggggtcttgagctgggagaggcttctggaggagctgggctgatccaagcccacctctatgtggttttgtcaggcgtctgagtggctggttgtgtaagttgcactgtgctgatggtactaccagaagcaagggaagcaaaaacgtgtctggcatctgttgcacacatgctgtgcctgggcaccgggccagggacttttttttttgagacagagtttcgctctgttgcccgggccggagtgcagtggtccaatcttggctcactgcagcctccacctcccgggttcaagtgattcttctgcctcagcctcccgagtagctgggattacaggcatgcgccaccacgcccagctcattttgtatttttagtagagacagggtttcaccatggtggccaggctagtctcgaactcccaacctcaggtgatccgcctgcctcaacctcccaaagtgctgggattacaggcatgagccactgtgcccggtctacttctgtgattccatttaacaaagggaaggtccctggttatccttcttgtacagatgaggaaaacagcttgtggaggggttggtgacttgcctcaggggatggggagaacggggagagagagaggccaggcacggtgcctcacgcctgtaatcccaacattttgggaggcccaggcaggaggatcacttgaggtcaggagtttgagaccagcctggccaacatggcgaaaacccgtctctactaaaaaaaagtacaaaaatgagctgggcgtggtggcgggtgcctgtaatcccagctattcagaaggctgaggcaggagaatcactggaacccgggaggcagagcttgcagtgagccgagattgcgccactgcactcctgcctgggtgacagagtgagattccttctcaaaaaaaaaaaaggccaggtgcgacagctcacatctgtaatcccagcactttggaaggctgaggcgggcagatcatgaagtcagaagtttgagaccagcctggctgacatagtgaaacccagtctctactaaatatacaaaaattaggctgggtgtggtggctcatgcttgtaatcctagcactttgggaggccgaggcaggtggatcacctgaggtcaggagttcaaggccagcctggtcgacatggtgaaaccctgtctctactaaaaacacaaaaattagccgggcatggtggtgcgcgcctgtaatcctggctacccgggaggctgaggaaggagaatcgcttgaaccctggaggtggaagttgcaatgagccaagatcgtgccactgcactccagcctgcgtgttgggagtgagactccatctcagcataaaaaacaaaaaatacaaatacaaaaattagccaggtgtagtggcatgtgcccatagtctcagctacctgaaaggctgaggcaagagaatcttttgaactcaggaggcagaggttgcagtgagccgagaccacgccattgcactccagcctgggtgacagagtgagactccatctcaaaaaataaaaataaaaaaaaaaaaaaacaaggagagagagaatatgaggaggggtagggatgctgaggctcctactggcctcccgctcagctcaccctccccttcctcgcccagctgcggtgtgatcacgcaggtagtaggcagtggagctctctgggccagcagcctggtcagaacccaaaggttcctgcccacaacgagccacactccaggatagccctggtgtccctttattccctggagaatttgggaccccatatttagaagaatgtgttgcttggtagctcccagagaaagggggtctgaagcctggcctttttcttccccagatgaagtggttttaaagtttgatcggaaccgtgtgcgtatccggaacgtggcctacgacacgctccccattgtggtccatggaaacggtcccactaaggtgccaccagtggtctcaacccccgccccgccctgccccaacccccaggcacctccaacccttctgagaagctggcccttcccagcccccatatcagaggtgcctgacccccacctccacccctggaggcctcagccactcagcctcagtctgtccccaacagctgcagctcaactacctgggaaactacgtccccaatggctggactcctgagggaggctgtggcttctgcaaccaggaccggaggacactcccgggggggcaggtgaggtgggggtgccagggaggggcacgagagggcagcgtgctgagcaggaggtacaaggacagcggactggggggcggtgggggcatcgctcctgggtccctgcacctgtcagggtggaggttgggtgggggcagcagggaagtccgggcttctctctgagtccctgcgtgttgcatcttccagcctcccccccgggtgtttctggccgtgtttgtggaacagcctactccgtttctgccccgcttcctgcagcggctgctactcctggactatccccccgacagggtcacccttttcctgcacaacaacgtgagactcccctgttggagcctctcctgagggaccctttccctgccctgatcagaactctcgtgcccccacccccatctccttcctgcacccccatccctcaggtgccgcctccctgccctctgagcccatccccctatgtcttcccctcccaggaggtcttccatgaaccccacatcgctgactcctggccgcagctccaggaccacttctcagctgtgaagctcgtggggccggaggaggctctgagcccaggcgaggccagggacatggccatgtgagcgggtgcttgcggggaggagagggtgggatgaggctgtagggtcaggggtgctgccacctgctgcctggcccttgcctcacctgtcacccatccagcccctcctgggcctccccattcgcatccttgcagcccccatgctgtcactcctgcccttgccagctcacccagacagcagagagcctggggaaggaaggatagacactgcctccctcctcttctcctgggggcatgggccagttaccccatccacaccgcctccccacctgccgccgtctcagctcgcctctcacctccagggacctgtgtcggcaggaccccgagtgtgagttctacttcagcctggacgccgacgctgtcctcaccaacctgcagaccctgcgtatcctcattgaggagaacaggtggcttaccccctctccccgcagccggagggcaccccaacaggccccgggaaccccactcctgccctgggcaccgggctccccaggcctgctcccgtctgcccagccctcacccccacctgtccgcaggaaggtgatcgcccccatgctgtcccgccacggcaagctgtggtccaacttctggggcgccctgagccccgatgagtactacgcccgctccgaggactacgtggagctggtgcagcggaagcgagtgtgagtcccgccagcctgcagccccccgcctcctccgacccggggcccaggtagacccaagccccctactctcaggggtttggagtggtcaccagtcagaggtgccatgaggctggctgcagtggctcacacttttgatgccaccactttgggaggctgaggtaggaggactgcttgagcctgggagtttaagatcagcctgagcaacgtagcaagagcctatctctacaaaaaacttaaaatattagctgggcacggtggtgcgtgcctgtggtcccagctactacggaggctgaggtgggagaatcacttgaacttgggaggttgaggctgcagtgagccatgtttccaccactgcactccagcctggaaacagagggagaccctttctcaagaaaataaaaaacaagggccggccgcggtggctgacgcctgtaatcccagcactttggaaggcagaggcaggtggattactcgaggtcaggagttcgagaccagcctggccaacatggtgaaaccccatctctaccaaaaatacaaaaatcagccgggcatggtggctggcacctctaatcccagctatttgggaggctaaggtgggagaattgcttgaacctgggaggtggaggttgcagtgagccaagatcacaccactgcattccagcctgggtgacagagcaagactccgtctcaaaaaccaaaaacaagaaacaaaaaagaagtgccacagcttggggtaggaactgaccgcattttgggaggtggggtggttgggaccagcagtgcttgacaagggacatgcaggggccttatgttcagggactgggataccctgagggaagaaggacttcccgggatgagctgggcagaatttggggggctgtcctcccagctgaccgcggtgtcggtgcctccaggggtgtgtggaatgtaccatacatctcccaggcctatgtgatccggggtgataccctgcggatggagctgccccagagggatgtgttctcgggcagtgacacagacccggacatggccttctgtaagagctttcgagacaaggtgagcgcgggtgcacggtctggcctgggggcagtcccccagactccaggcatcgcctgcatcacggacacccccaccccactacagggcatcttcctccatctgagcaatcagcatgaatttggccggctcctggccacttccagatacgacacggagcacctgcaccccgacctctggcagatcttcgacaaccccgtcgtgagtggggaccccacgcccagagcacacaggttccccgccttgtgctaaggaagacaccaaacgtgatggctgctgccagcgcaggacactgagtgggagggggcggtcccctgggggctgggagcgaggggggcacagatctgatgtgccccccaccctctcacaggactggaaggagcagtacatccacgagaactacagccgggccctggaaggggaaggaatcgtggagcaggtgagcccacgcagcctccccacccaccccctgccctcatggccatcgcctcttgggggcccccgcctggattcaaagttttcacactgagttccccagagatctgagggttttctgttcagacaagatgaaggcagaggccgaacagaaaggactcttgcccccaaagccagcattgatcagacagcctcttctcctgtatattgggtatactggtgttatgcttgaaatcacatcttaaaagaagaatggggctgggctcagtggctcatgcctgtaatcccagcactttgggaggccaaggtgggtggatcggttgaggccagaagtccaagaccagcctgggcaacatagcgagaatctgtctctacaacaacaacaaaaaaattaaataagaaatgaggccaggagtggtgctcatgcttgtaatcccagtacattgagaggccgaggcaggcagatcacctgaggtcaggagttcgagaccagcctggccaacatggcaaatcctgtctctaccaaaaaaaaaaaaaaaaaaaacacaaaaattagtcaggtgtgatggcgtgcacctgtagtcccagctactcgggaggctgaggtgggagaatcgcttgaacctgggaggcagaggttgcagtgagccaagatcacgccactgcactccaccttgggtgacacagcgagaccctgtctcaaaaaaaaaagaaaagaaaaaattagcttggcatggtggcatgtgcctgtagttccagctacttgggagtctgaggcgggaggatcgcttgagcccagaaggtcgaggctgtagtgagctatgattgtgccactgcactccagcctggttgacagagcaataccctatctcaaaaaaaaaaaaaagaggtatgcactgttacggaagtttggaaaccactgtcccagcacgaggggctccaggaccctctgccacctctcctgtgccagaaaccggtcctcagccttgccactccctcagcccctacctggcgggtccccggctgctctcacaaagccttccctgctcctccctgccccttcccattctgcctgctgcctgtccccttccccgttctgcggcgtcagctagccctgttctccctcgccccatcctcagccatgcccggacgtgtactggttcccactgctgtcagaacaaatgtgtgatgagctggtggcagagatggagcactacggccagtggtcaggcggccggcatgaggtaagggcctgggcgaggagggcagaggccttcccagaggaggaggtgcaggatctggtaaacaaacaatggaatcaggaaaatgggagcaaagaggggttcccaggggggaggcagaccctggggtcacaactgcattcattcatgtattcaagaaatatttactgctgggcacagtggctcatgcctgtaatcctagcactttgggaggctgaggcgggaggattgctcgagcagggggagtttgaggccagcctgggcaacatagcgagaccctgtctctacaaaaaatttaaaaattagccgagtttgggccaggtgcggtggctcacgcctgtaatcccagcactttgggaggccgaggcaggtggatcacctggggtcaggagttcgagaccagcctgaccaacatggagaaaccccatctctactaaaaacacaaaattagccgggcatggtggcgggcgcctgtagtcccagctactcgggagctgaggtagaattgcttgaacccgggaggcagaggttgcagtgagccaagattgaactccaggctgggcaacaagagtgaaactccatctcagaaaaaccaacaaattagccgggcatggtggcatgtcccagctattcaggaggctgaggcagaaggatcacttgagccccagagttagaggctgcagtgagctatgatcatgccgcagtactccagcctgggtgacagagcaagactctgtctctaaaaaaagagaaaaggaaatcattcctgggccactgtcctagactgcactgcaggaatgcctcatgccggtcgagctctgccctgctgtgagcagcagccaccacacagcttctaaggctgcgatgagcagcctgggtgcaatagaagccacggggaagccttgacccagacttgggaggagtagggagcttcacaggacaggtgacatcttagctgagacttgaagggccgggagcagtgagtcaggccgagaagtagcaaagaagactgttctgcacagaggaacacaggtgtgaaggctggaggacgggaggaaggaggctggactgccctggggtggggagcgccatggctggaggggcgggtggctcagtgcccgccgcccccaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggtgcgctgcccacctgccagctgcctccccaccttccccaccccagtcccggacaggaagtctccacgcagacccctttcggccccggcagcatttgggctccatgcattttagttcccaggggaatgagacgctgcaggaggcaccccaggggagggagggcgccaggctgagacccaaggtgaggcttggccctaatttaatgccagtgagcagcgagagcctcctacgcaggggtcccgccgcccctcccctcccctccctggacagggaccgtcatctccctgaagacaccctgcgatggccgggcgtggtggctcacacatgtaatcccagcactttgcgaggctgaggtgggtggatcacctgaggtcaggagttcaagaccagcctggccaagatggtgaaacctcgtctctactaaaaatacaaaaattagccgggtgtggtggcaggtgcctataatcccagctactcgggaggctgaggcatgagaattgcttgaaaccgggaggcagaggttgcagtgagccaagatcgagccaagatcgcaccactgcactccagcctgagtgacagagcgagactatctcaaaagaataataataatacaaaataaaagaccccctgcgcccgcagctgtccctgcagcctcttccctcctctcccccaggcgcgggcggtgatgaactttgtggttcgctaccggccagacgagcagccgtctctgcggccacaccacgactcatccaccttcaccctcaacgttgccctcaaccacaagggcctggactatgaggtgcgccccagtcacactacccacccacgcttcacctcaggaccctcgggtccccacctagagcccctgcgtgcatcccccagctcccctccctgcccatttcccagtgactttgtgggtatcagctcctggatcgcttctgggcaggcggcctctgcttcctcctggatcttcctgtctgcaggcaccccagcctccggtgtctgccatatctgccatctcccttgtcaccccggtctgctgcaccgtgccccccggtctggccgccctgccccgtgtatctgcctgctccccaggccccacgtctgctcactccatgtttcctttcccttctctttccagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttgagtccattggtctgcccattaaccccatctcccctcctgccagcagcgtagaggggagagacccagaaaagcgaagacaagaggaaaagggagaggcagaatgttagaccctcgtgggaacctgggagcttccctggctcccactttccccttcccctgtattgcctgagctggagacagtgtgtgagaggggccgggcgcggtggctcacgcctgtaatcccaacactttgggaggccaaggggggcggatcacgaggtcaggagatccagaccatcctggctaacatggtgaaaccccgtctctactaaaaatacaaaaaattatccaggcgtggtggcgggcatctgtagtcccagctaatcaggaggctgaggcaggagaatgacatgaacccgggaggcagagcttgcagtgagctgagattgtgccccggcactccagcctgggccacagagtgagactccatctcaaaaaaaaaaaaagtgcatgagagggcacagaccaaaagagggacttcccaggctgggcacagtggctcacacctataatcccagtactttcagaggccaaggcaggcggaggatcactggaggccaggagttcaagaccagcctggacaacatagcgagaccccccccatctctacaaaaaataaattagctgggcgcgatggctcacgcctgtaattccagcactttgggaggctgaggtggatggatcacctgaagttgggagtttgagaccaccctggccaacatggtgaaaccctgtctctacttaaaaaatacataattaagctgggcacggtggcccatgcctgtaatcccagcactttgggaggctgaggcggacagatcacgaggtgaggagttcaagaccagccaggccaaaatggtgaaaccgcatctctactaaaaaatacaaaaattagctgggcatggtggcgggcgcctgtaatcccggctacttgggaggctgaggcaggataattgcttgaacctgggagggggaggttgcagtgagctgagatcgcgccatcacactccagcctgggcagcaagaatgaaactccaactcaaaaaaataaataagccgggctcagtggctcacgcctgtaatcctagcactttgggaggccgaggcaggcaggcagatcacttgaggtcaggagtttgagaccagcctggccaacatggtgaaaccctgtctctactaaaaatacaaaaattagccaggtgtggtggcacaggcctgtaatcccagctactcaggaggctgaggcaggagaattgcttgaacctaggagacggaggctgcagtgagccaagatcgtgccacggtactccagcctgggtgacagagcaagacttcgtctcaaaacaaaaaaacaaaacaaaaaaagctttccacgctacccacagagggctccatccggcgttgttctggattcctgttgtaacttaaagagaaactttcacaacatccggagcccttgatgtcctgcaaatgaaggaggaagatgtccttaatttccttgcagcaggaaaccaattaggtggcaccaaccttgacttacagatggaacagtacatgtataaaaggaaaagtgatggcatctacatcccaaatctgaagaggacctgggagaagcttctgctggcagctcgtggcattgttgccattgaaaaccccgctgatgtcagtgtcataccctccagaaatactggccagagggccgtgctgaagtttgctgctgccactggagccactccaatcgctggccgcttcactcctggaaccttcactaaccagatccaggcagccttccgggagccacggcttcttgtgtttactgaccccagggctgatcagcagcctctcacagaagcatcttatgttaacctacctaccttgctctgtgtctcacagattctcctctgcgccatgtggacattgccatcccaagcaacaacaagggagctcactcagtgggtctgatgtggtggatgctggctcgggaagttctgcgcatgcgtggcaccatttcctgtgaacacccgtgggaggtcatgcctgatctctacttctacagagatcatgaagacattgaaaaagaagagcaggctgctgctgaaaaggctgtgacaaggaggaatttcagggtgaatggactgctccggctcctgagttcactgctactcaacctgaggttgcagactggtctgaaggcgtgcaggtgccctctgtgctatctagcagttccctactgaagactggagcattcagcctgccacagaagactggtctgcagctcccaccactcaggccactggatgggtaggagcaacaactgaatggtcttaaacacctgtactgtgagctccccctgccccatcttccagcccaggtgcacctggcagcctggctcttgcattcctcggctgggcttggatgctggcggtcctctacctggtctggctctattgggatagaaacatacccagggctggagcccgcagatctgcctgggtttgcaactgggcagtttgagacatttctgtgactacttccccctctcagtgaggacctgggctgtggggtgctgggtgcggttggggcttcagaatagactcttgggaccaccatctcccaaagtgcaatctcaccgttggggtggggtgcgcccgtctgctccccagctagttaaaactgcaaagttgggcacctcctggaactacctctttgacttccaccctcacagggtcctggtcgtgggagccttcgccaacttctgcacagagcccacgggctgctcctgcctcttccccaaactcccgccacacctgctcatgctgccttgttggttccatctcctcttcttccaggactacatcatgtcaggtggtgagaagaggaggaccttgctgctgtctcccgccccaccatcctcttcccaggggacactggggcccagctctcctttccccatgtcctctccactcttctttccaagtcccaggctttggctgggtgcggtggttcacacctgtaatcccagcacttgggaggcgcaggcgagaggatcgcttaaggccaggagttcaagaccagcctgggcaacacagtgaaaccccatctctacacaagaaaaaacaaaaacaaaaatttagccaggtgtggtggtacacacctgtggtcccagctactgggaggcttgaggtgggagggtcacttgagccctgaaggtcaaggatgcagtgaaccaagatcaggccactgtactccagcctgggcaacagagcaagactccgtccctaaataaataagtaaataagacccaggcgttgggtcccccagcttctgccctccccccaggtttggtctcctttgtcaaggccccgctgcctcagtggtggccaggtggctgtcctggcgtgggagggcccctgcaggcgctggaggcaaaacccggacaactgagcttgccgattcggaatcagaagagattggttaagtcagctctggaactcgggtgaggacccgagcgtgacccggtggggacgccccagggctgccgggccggggaggaggagagtggcgccacccgcggaccccggggccaggagtcagccgcgccatgctctcctgcggcctccctagtgcctgtcttctccagggagaatgagctcttccagcagttcccgaacccgcagagctcgtgggtgcagaggacgcaggaggctctgcgtccgctgctaagcgtggccctgcagctgttcctgggccgccggggcctcccgctgcccttccgcgcgcccatccgcaccgtaggtgagccccggcctccgccccgcgatcctggcccagggcccgctccctccccgtcccgggttggggccacccagactggcctttggccaccgcgccagccctgaactctgttcccgcctatccccaaggaggaaaagaggaggagaaccggggatcccagcccagatcgcctcccgtcccgcccgcagtggggtcggcgattcccgtgcagcagagccccccgcccagtccggcccaggtggacacgctgcaagcgcgctacgtggggcgactcacgcagctcttcgaggagcaccaggcgcgctatggtgtccccgccgacagacacctggtcctcacggaggcgcgccccaccgcctggcctcgcctgtccgctgggtgactgcaggtggggaagtgaaattaaagactggcggcagggcacggtggctcacgcctgtgattccagcactttgggaggccgaggcgggtggatcacttgaggtcaggagttcgagaccagcctggccatcatggtgaaaccccatctctattaaaaatccaaaaaaaaaaaaaaaaaaattagccagacgtggtggcgcgcctgtaatcctagctactcgggaggctgaggcaggagaatcgtttgaacccgggaggcggaggttgcagtgagccgagatcgtgccactgctctccagcctgggtgaccgagacgtgtgaaaaaaaaagaaaaaaaagaaaagaaaagaaaaagaaaaaaattaaagtgggaaacagacctgcagcctgtgtgtgtttgtgcatggcgggggaggtccaggcaggggtggtgaccttgacattcctggagatgccccggaccaggccctgcccccaccccgactggaggtcaaatagtctcagcagggcttctggccccttccagcacctgggacccagtgggtggggctagccagatcactcttgtccactccaacatcaattcctgaggcactcgggtgtcacctctcccttgcacaccccttacgcctcccagccccacccagcagccagcccagactggtgactgacaggaagttcaaagatcaggctgagaaaaaacccagagacatctggggctctggatccaaagatctccccactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggtgagagctggggaggcgtgggtgcctggggtctgccaggggagtagggcttggagggagagtggctgggctgctggcttgcatgcctgaggacagtgaccaggtgactggtctgggagagggccagaggagagagctggttgttctgaaggggaggaagggaagggagcagctggagggaatgatggagtttcagaagtgaactcttttctttctctcccttcccccaggccctttcttctcccttcttgtctttgtcctcctcttcacgtcactctggcccttctctgttttttacttggtgtggctctatgtggactgggacacacccaaccaaggtgagctccggatgggggcccaggtagccagagatggtggggacatggggggtgaggggaggtgactccgggggttcgtccaccagtatctcattgtccgcaggtggaaggcgttcggagtggataaggaaccgggcaatttggagacaactaagggattattatcctgtcaaggtgatgggtcaccctgcagaaaaactgcttcctacctctccccatctccctcccacacctaggagcccttccttgtgctggggcctgagctccccgctgcctaagctcaggcagtgggacagggaatggatttttttttttttttagactgagtctcctgtcaccgaggctggagtgcagtggtgcaatctcagctcattgcaacctccgcctcctaggttcaagctattctcatgcctcagcctccctagtagctgggattataggtgcccgccaccatgcctggctaatttttgtagtttagtagagacagggtttcaacatgttggccaggctggtctcaaactcctggcctcaagtgatccagccacctcggcctcccaaagtgctgggattacagccttgagccaccgcgcccggcctgggagtggatgatgttcaagagcggggccttggtggggcaccatggctcatgcctgtaatccaagcactttgggaggccgaggtgggaggattgcttgagcccaggagttggaggctgtagtgagccatgattgcgccactgtactccagcctgagcaacagagtgagaccgtctctaaaaaaaaaaaaaaaaaaggcggttgtggtggctcaagcctttaatcccagcactttgggaggctgaggtgggtggatcacctaaggtcaggagttcgagaccagcctgaccaacatggagaaaccccatctctactaaaaataccaaacaaattagccggacatggtggcacatgcctgtaatcccagctactctggaggctgaggcaggagaattgcttgaaccagggaggcggaggttgtggtgagctgagatgatgccattgcactccagcctaggcaacaggagcaaaactctgcctcaaaaaaagaaaagaaaaaaagagagagtgggtgaggtggcttacgcctgtaatcccagcactgtgggaggccaaggcaggcagatcacgaggtcaggagttcaagaccaacctggccaatatggtgaaactgcgtctctactaaaaatacaaaaattagctgggcatagtttcgcatgcctgtaatcccagctactcgggaggctgaggcaggaggatagcttgaaccgggaccaagaggcggaggttgcagtgagccgagatcgtgccactgcacttcagcctgggctacagagcaagactccatctcaaaaaaaaaaaaaaaaaaacctgggcccttaaccctatcctaagaacctttaactcggaactctgctggggtggcccttgaccctatcctaagaacctttaactcggaactctgttggggtggagggcccctcttttcagccggtgtcttgccttccatcctcccttcatcctgctcaacaccccgaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggtgagccgaatgggaggaggagaacgggaggagactcctgaccagatgttccccagcccctctgggaccacccccccccataataagtcccccacccaggacaggggccagcctgagcactgcccagacttgcagtgagcatttgggtaggttccccgccttggagatgggggtagggggcttggaactaaaggctgggtgaggggcgggggtgccgtggaggcagatgggaactactttccacctcctcctgcccacaggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacgggtgagtgcgcgtgcaggccctacctgtcagttctctgctggtttatgccctctctcagtccccagacatctaggtccctgcaggggggatccgggtgcccagagaccagcgccctgccctgcaccgaggcccacgtgggctctccagggcatgactcggtaccaaacatggggcccgcttaccctaggctccctcccacatccgtggagacaggaccataatgcaaatagcagggccctcggtctcagaagccctggcttccctctctgaccccaactcaaaggcaagaccttgcacttgtttctttttttgttattgttgttgagacagagtctcgctctgtcgcccaggctggagtgcaaaggcgtggtctcggctcactgcaacctccgcctcccgagtagttgggactacaggcgcccaccaccactccgggctaatttttgtatttttagtagagacggggtttcaccattttggccaggctggtctcgaattcctggcctcaagtgatccgcccaccttggccttccaaagtgctgggattataggcgtgagccaccgtgcccggccggacttgtttctttacttgcgaagagggctgatacctaccttgccacgatgttgttattgcaaagaccgaatgagaaaatgactatgagaaggcccactacacaactgtgtctcaagaaatgtgagtcccggctgggcgtggtggttcacacttgcaatcccagtgctttgggaggccaaggcaggaagatcacttgaagccaggagttcaagaccagcctgggcaacatagggagacatcatctctacaaaaataaaataaaataaattagccaagtgtggtagtgcacgcccgaagtttcagctattcgggaggctgaggtgggaggatggcttgagcggagaaggttgaggctgcagtgagctatgattgcaccactgccctccagcctgggcaagagagcaaggccttgtctcttttaaaattttttaaattatttattttttaaaattttctaatttttaatttttggagatggagtcttgctctgtcacccaggctggagtgcagtggtgtgatctcggctcgctgcaacctccacctcccgagttcaagcctctgaagtacctgggactacaggtgcacgtcaccacgtctggctaatttttgtatttttagtagagatggggtttcaccatattggtcagggtggtctcgaactcctgacctcaggtgatccacccacctcagccttccaaggtattgggattacaggcatgagccaccgcacccagcctatttattttttgagacaaagtctcactctgtcacccagactgaagtgcagtggtgtgatcttagctcactgcaacctctgcctcccaggttcaagcgattcttgtgcctcagcctctgtagtagctggaattacaggtacccacttccacacctggctaatttttatgtttttgcagagacgggggtttcaccatgttggccaggctggtctccaactcctgacctcaaatgatcctcccaccgtggcctcccaaaatgctgggattacaggtgtggttacaagaccctctctctaaaacaaagaaaaagaaagagaaagaaatgcgagtcctgtcttctagatctttctttgtagccatagtcatgtgctttgaatgaccctgggaggtagcatctggacgtagtgggaaggacttgtagcccctgggggtgcccatctcggagcagtccagcagcctgagccccctcttctctcttgctccttcccagggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtgggtgagtgcccacctccggggggacggccaccagcagctgcgtgggcatcagggatccctcgcccacttgtctccctctccctgcagtgggccgccccatccccgtcccccagcgcctccaccccaccgaggaggaagtcaatcactatcacgccctctacatgacggccctggagcagctcttcgaggagcacaaggaaagctgtg

SEQ ID NO: 761 - DNA, 3121 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaa

SEQ ID NO: 762 - protein, 738 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 763 - DNA, 28334 bp, Mus musculus
  misc_feature (1)...(28334): n = A,T,C or G
aagcatcagacctttaagttgtttagactttcctgcaaaggtggggtgtgtacggtgaatgcatttggatatgcgggtgcatgctcgcatgtgcagaggccagagtaggactcctggtgtcttcctttggatgtctgctgttcagccttgagtcagggtttctctgtcaatccgaacttgccttttctgctaggctggctattgacagctctcagcatgcacctgtcttcacctctcaaagccagggctgcagacacatgcagctggacctgacgttgtacatgagtgctacagatttgcactcagggttttgtacttggaacaaaaagttctctcagtcaaccagaccatctccataggtcatgaagagagtcgtttggtgggtatattggtgcaaagagggaaaatgagttgggtcatctccctccctccctccctgccttccttcccccctttctctctttctttccctctttcttttgtatgcctatatgtacatgtttgtgggtgcacgcacatatatgtgaggtgtgcattgtggtgtgtgcatatggaaacttggggacaggcttgggtatcctacctcaggtgccgtccatctttgtgtgtctttctatgtgtggtctatacatgcttgtgtgcatgtgtgtacacacatgtgtgctaccacacttggtatttccttacatatgttctaggggtggcactaagttcctcctgtctataccgcctgcggcatctcccagaggttaggtctcagacctgtcagtcacacttgtggcagcatgggatatgggatttgaattcagaggtcaggccagcccgagcagccggaggcttcacttgggtgagagctgagcttgggggtgatatttaaagttcaggaagagtgaaattaaaaaaaaaatctcaggtctggtgcacactattaatcccagcacctgggaggcagaggcaggggaatctctgagttcaagactaggctggtctgcagagtgagactgcctctgataaaactgaacaaacaacaaaaatccaacccaaagcagaagtctcaggtgtcaaagtgttctgtgtggaaagtggtaggaagacttccccgtccatctgaaatggaacttctggctttctttacctgatgcctggcacatcagaccactcgcccttcattatgcagcagttcgattgttgtctgtccctgctgtgaatgtcagctccacaagagactgcatttctgtccagtgctgttcagcacaccacccggaagggtgtccagattgctatacctgctccttaagcagttactgaatgaatcagtgaatacgtgcgattctgtgactaatggaatctagattggtttaagttggttatagtccagatattgcctttttgtttcctgcagaaggtttttttttttttttcctttaacaaatcctgtttgataaatgaacactgacacaaatcaaaaagactcagcatgaagtattggccttgtttctgcttgcattttcccaatttgtgccttctcctgactaagatcagtggtgccctcctcagctactgtgcctaagaaactagatgtgtctctgtcttaaaatccaggcttttctggttacccctagattatctctttgcatctatctttttgttgttatttgtcgagttttgggtttctgctagctctctttcccctttactggatgaacttaggctcttatctcattgtagctgtgaatatcagagctccatttacaaataacaagtatgcctgtcacccttgtctacacgtttctacagtaatgttgctgctatggaatagggccatggagttgtcatgaaatacaaccataggttggttaggcatttaaaccaattccattctctcccaaggaaccacacaaggtacatctgagactatttttgaattctcttattattacacgcctcctctttcagcagcctgaatcatgtaagtgacattggaattattgggtgaaggaatttaaatgagggtgctctaacagatagggaattcctttgttgggggtgggggcgctattgaaatcaccggggaattgtaccaggtgccccacaccagtgtgaagatcgtatgtggcacagaacaccagttggtaagagttatacccatctggaaacttggggaaatggctgagagtcactgagaatctcaaggattctgatgagacattggacttataaaactaaagccaaaaacaaaacccaacaaaaccaaaccaaaactaaacaccttgtttccatccttagttctttctgcagaatctttttttttttcatcactctccctgccacttcagactctttgttgggtttctctggaactctatcctgtattggttgatgtaggtggatgggagaggttgccctgcaggtaatgggacaggcctgtaagatctagaatgagtttcaggagctgggatttgacctgatgtttggaaacagggaagatggaagaatgttgagaggagccctgatttgctgactcattgctgattggcgcatcttcaggaattgctcattctaagttttctaacgtattaattcaacagtacaatattttaaatgatatctggctcctttttaaaaaatattttttattaggtattttccttatttacatttacaatgctatcccaaaagtcccccataccctcccccccactcccctacccacccactcccactttttggccctggcgttcccctgtactggggcatataaagtttgcaagtccaatgggcctctctttccagtgatggccgactaggccatcttttgatgcatatgctgctagagtcaagagctccggggtactggttagttcataatgttgttccacctatagggttgcagatccctttagctccttgggtactttctctagctcctccattgggagccctgagattcatccaatagctgactgtgagcatccacttctgtgtttgctaggccctggcatagtctcacaagagacaactatatctgggtcctttcagcaaaatcttgctagtgtatgcaatggtgtcagcgtttagaagctgattatgggatggatcctggatatggcagtctctagatggtccatccttttgtcacagctccaaactttgtctctgtaactccttccatgggtgttttgttcccaattctaagaagaggcaaagtgtgcacactttggtcttcgttcttcttgagtttcatgcgtttagcaaattgtatcttatatcttgggtatcctaagtttctgggctaatatctacttattagtgagtacatattgtgtgagttcctttgtgattgggttacctcactcaggaagatgccctccaggtccatccatttgcctaggaatttcataaattcattctttttaatagctgagtagtactccattgtgtaaatgtaccacattttctgtatccattcctctgttgaggggcatctgggttctttccagcttctggctattataaatgaggctgctatgaacatagtggagcatgcatccttcttaccaattggaacatcttctggatatatgcccaggagaggtattgcgggatcctccggtagtactatgtccaattttctgaggaaccggatatctggctcctttttcaccagtttaatgacacaaatgtgaaagtgtgtgcatgtgtgtgtgtgtgtgtgtgtgtgtgtgtatgtgtgtgctatacagaaacaagctatgactgagctacattctgagaccccagctaacttttatgttttgattcattaaatccattggtctggcttgaactttaatagttcttttacccatagttgatttttcttaatgtcttgcattgttcatctggaacatatagttaattgagtgatgtaggttctctaatgctttatcacgggtataacgatatacacacatgtatgtttcattaatttaaaaattatatttgtggataacctcatactggcctcatcacagaagtctttatgtaccaatcagggggctatccagctcaggtgacctgacagaaattgcctcaaagtttactttttcattaaaaaccttaaattctttcattgtcaacaaatactgatagctattcttcttgagagagcagatttactttgtaattaaaaagaaatcagaatatctaggttgcctttcacatgaaattggtattttctgacagtggctcagcttacagcccagtgtttgattagaacaaatagcaacccctactccaccctggtgagcaaagtacgattttgtttttcaaagcactcttttttttttcttttaaagctttattcatctattttatgtatatgagtacaccatcgctctcttcagacacaccagaagagggcatcaaaccccgttgcagatggttgtaagctgggaattgaactcagagatctctggaagagcagtcagtgttcttaaccactgagccatctctgcagcccaaagcactctccttaaagacaattatcgtacctcaaggtactgcacaaacatctatgtatgtctcttcacacagaaaattaatgtgatattaatgtaatatttcagggatcagtatgaataaaatttagaatcatgattctgtctaagacgtccttgagtgaaacatacgattttgttcccctagccttaagttaagattcaaaacggtgagtgtacatttcagatgtctcaacgccagctgcatctgtagttacacactcctgtaatctgctggactgatatcaggcgagggagaccaagtagcaggagcagtctgtagaactgtcctctcaggtggaagcagaattcttcacaagagctgcttgctgaggtgcccggtcatttgaaagtggcagtgcagtcatcccccccccccccatttccctccccttcctgtcagcaaatcaatgagcagccattcctgccttcttgcctgcttacttctgccaatacagtatagtagctcaccctcttagatactggtgtctccatttcaaataggaaatgctgttctaaactatttacggtattaagaaagttcattacatttacacttaaagaattctgttccatttttagagctctgacaatggtgttacaacattacctgtaccataaaacagttcaaactgttcagccgtatgaaacacaataaagtaaattattaacacctgtactgccagggtgtcttcaggtcactttggaagagatttctcctttccacgagtcacagagttctaggatacattattttcatcttttccattgtccttagatgcagacggtgtgcatctgagcctaaaaggccacaagtcgtctcatctttatctttagaacagcgtcagacccacgttagacaaatgagggttttaatcactgtgacagttcacgtgtgtgtggtgtgtgtgtgtagtttgcgaatgtgtgtagagaggagacaaagatctgaaaggagggtagagagaagacgatggaagcagagggttaaaacgtgtgttctagaaggttatctaactggtggggacagggagcagctagtgggggaaggagatgagttggggaaggaacagatcataatgacaaatacatataaaaatgccacagtggcacgcattggttttggtatgctaacttaaaagttaatcacacagaaaaggaggcaactttattcaagagcccttaattgggccattgaaacagtggggggtgggaagaactgcaggatgtctgctagcggccctcgtgggccaggcagtctgcttctagtataagccagaaaagaagtgtttgtactagtcacctatgaccttcaggcgaaggaagggctgtatttacaccaatcacaacagtgttccatctgcagcagttgcagcagtctctcctagactaccaccaggggacaggccttcaatctggccggagtgggaagggttcctgggtgggggtgggggtgggggagaaagtgtggctctgaggctgcatcttcagaagctggagtagtgttttagaagctacagccgccatgtagctctctggagtgttgaatgtggtttgacagttcttttctctcaaggctgcctgcgcacagaacaagagcctaacagctaacaattaggggaatcaaatcccctcacctccccatatttgtttatttccagaaaacaagcagctgtgcgaacggcaaggcgtcattgatattaattttagctgtgcttttagtcatgctccacacctgcctagccctgtagcacctgtgggctgcctgctgcttacccccgtcagcaatgctagatttgtggattctgcctagcagagccatttacttacgtaatgatctagttatttctacttacctctttgccactatctcttcttctaggtcactttttttttccttcttcttaggccactaggactcccctcagtctcatcttctctaaaactgtttcatttctgccagcttcagattccctcacgttaaagttctagtaacttcgctggtccctgtaggtgctccgctcaggttacctttcacatttatgctattttccctttggcagtcctaaaaggcactgcggattcttccctgactcctggccttaattcttggcagatgattttcctgcaaacgctttagggccatcctttagggctcatctcattctttgcgaagacttcccccttctccccctctccacaagaaagtctctttttaggctgttcactgaactttgtacctctcacgatgtttaatcatagtcagtttcttttcatcggtgtgtgtataccttatccccacgtgttaagatgttacttgaaaatttagacttaatcattcattctttctctcccttaaaaataaacttcccttgacggttcgctagttggatttgcggcggaagtataaacattgaaaaaagtattcaaggtagaggcatcaaaatccctgtgtttatcaggactaggtcaagttgtgcagaataaaacgttacataatacgtaaaaaataatataaaacatacaaagaatatacacgcatatatgcgtattcatcattttgctagaagcttttttctagtattgaaggatacgaaagggtagtcattgctgtttattctaatactgtactaaaaaaaaaaaaaagattgcttatggcccagatatgaagttagagaaactgcaagagctctgaaattgagtccaggccagaaagtccgcgggcaaccgcttccaggtttggaggcgggctaaatgttggaggcaagggaggagactgaactctgcacgcaccgctctggcttcccactccccgaactgggcggacctgttcttgcagcagcccggggctcccgctcgcccccgggcatcgcagcccctgcgcagacagcggttgccgcggaccccgggcccctggggatgcggtgcgtccagcgaaggccaaccggggaaacttggagctggccccgacgggggttcggggcgcgggtgctagccggggtttccaggtgagccgccggaaaacaaccggtcggcccgggcggggcggggcgagggcggagggcacattgcctcatcccgggcattttactggaaactagacacatccggaggcggggcgggaggcagcccaggcgccgctctcaccgggcggagcgcggaggaggaggtcagttcatttaaatagcccggtcccctccgggcgcgcacgtactagtcgctctgccgcagccaaccgcgtagccatccggtggcgcaggtgtctggggaccccgagcgcctagcctgggagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagggctagcgcgctggcttcctggtaaaagaacttgagagcctcggattctcttttcttccatctcataaccttttcccttttcacttctcccccgacctccgaattcaagaacctctgagaaattataacactattatgaggtttttggagctgatggagagagatgtagtttccttcttgtaactctttcagtgagaagcagtggcagagggtaaagcgttgggaactggatttttaagacacccgtattcctaatctatttgtagggatgaatcaaagaaaacccacttttcgggacgtagaggaaagcctggttcagaaaagtgatttagtgttctgcgcttagtttacgatgttggcggttcagaggcctgctcagaattctgattttctctgtgtgcttgagaatggaaaagttacatctagcgaagccctttctttagctgcgggttgtatggtttcctttcttcacgaaccgagttgcataatttgggggggtggggggagggagaaacaggatgcagctgtgggtagatttaaacaccgcctaaattttctcagttgttggagcttctcatcgcaattattttaaagaatgaccccttgctgttccttaacactggctactcataagctttggttgtcttttatttttaaaaagttattttttgatttaaaacactgtgccttaagccacagtgttgcccacagctccctgaaaagcgcggtgtgcgtgctttgacagccctttctgaagtttgtaggcccgtggacatctggctgaacccatcgattgtttctagttcttggtttaccacacaagccatgggagattcctgaaagtgcgttttcttctccctatgacgtgggcatggaagttttaactcttgtcactccagaggagtgctgttagagtctggccattggggtgtttgtgggaattcctgaacttgaatagaaaggctatttaatcattttatttgccctcgtcactgtctctatgtcacacttgtggcacagatagccaaattatgctttgttctccgttcgttttcctctttatgttccaaatatgttcaattcatggacaagaacttgttacatagttgtggcactcagtaaattctaaaactgccttctgaagttctaaggtgaacaggcctgtttccgttttacttagaacgcccatgtacgtaagtgagggggaaatcctgtgtgtgtgtgtgtgtggaaatgtgctaagtgaatttaagcagctttcttggtacaaattaatgaagggaatactaagaaatcttaagtccctattgctgacttaaagtttgccttggtgccttgagaactttagaggaagttaggtgaatggcatacaggtactttataatttctatatgaacataaaagaccttgttttaaaaactacaaatgcctcattctgctccaaggacttctcaaagtcaagaatagttatgtataagtctccgatcttggctaaagctctgttcctatttcatgagtaaatagtagtgagagacagagaggctttctttgttgggcccaaggatcctctgccacatttgagagtgctttaattccttagggtgcctggttggaggatcagccaacacagacccccttgagaagtactcgatatagataataggaatccattgacccaggatgttggaaaggctttgagcatgggaaaactttgcaatttgctgcttgagggctttatccaccaggctgcagtcttggaaggggtgcgggaacagtcgggattcatgtctgtgaagagatgtaattgagacttgtccttctgaacagttgagccccacatgggggttggcaggcagcagagaggcccctttcaaggtgttcgcgtgaagaactcggtgaaggagctcctgctacacatccgaagcaacaagcagaaggcttccggccagcccgtggatgagtttaaggtggcggcttctgctctttgttttgagtgggtgggagactagtccgtgaaggttattgtggtttgctaaccgaggtccagttaagtcccttgtagtctttcataggtgaccgagttcctaggacaggagatagatagctgtctgagtacgctggactccctgcccttggctcagtgccaggtgcgtctgagaaatttaatgagccaacaaaagaaagcagtttgaggacaatgggattccgtgggttcagtacacagagaacattttgattagagaggaatgaatcagatggtcttacttatttcatcctgaccaggattgaataggctaaagtgaaaacagagaagggggaggctgggaggagagagagagaaagagagagagagagagaaagaaaaaatatgagaatgagaatggaggtagcgttctgtcaggatttatatccccagaggcttatggggttctgtagagggtaggagagacagatctccaccgagtgagaaaccatgttgtatgtactaagctggaccctttcccattgcagacacagagtgtgaacattgagcagctgacaggtaagagctccatctatttttttttttttttccataatcttacccgggtcctctttgagtgaaacgattccgtgggggatataaatggaatttgtcaggttgggatgatgacagatcgcgccttctttctttgggaacagacctgaagagtgcagtgtccgcagtggggaaaagaaagggacccgatcctctgtccgatggaccggtttgcaagaggccagctctgttgccttctcacttcgtggtaagcgtctccctgttttcctctgaacactccgtggaactcattctgggatattgttgctattgaaaaaacaaaacgaaacaaaaacatttttgcttcttgggatagaagccaagtcatgaacctagcactgagcctaccccctagcttttggagttcttttaaaagaaatgcttatgagagcttcttgtcccccccctcccccccttctagacatcaccgcaaacgcctacacctggggagagcatggaagatgttcgccacagcgaatccaagctggatagcagcgctgccctgcttcagaatattataaacatcaagaatgagtgcaacccagtttcactaaacactgttcaggttagctggatgagccccacggttccccagaactcgccaagagaccagtgccaggatttccatggaggccaggccttctctccacctcagaaataccaaccgttccaagtcagtggctctccacagatgatggaccaggcgtcaatgtaccagtattcgccacaaacacagaacatgcagcagccgccgccgctgccaccacagcagcaacatcaacagaattatccccacaactcacccctgcagttcagtccttactccagaatgtcccagtctcccaagtatgattccaacctctttgatactcacgagccacagttctgcacgggccaaagttttgtgtctttactgactggcccgggggaacccgagtctcttgctgttcccgttccggctcccaccagcattccaccccaaactgagactcagctgcagaccttcagcctgatgccaagcaatgcctgcgaggccgtcgtcggggtgcacgatgtgggctcgcactctttgggcacgtccctgtcactccagaacatcatgggaagcccgatgaataccacccagctggggaagtcattttttcagtggcaggtagagcaggaagaaagcaaattggcaaatattccccaggaccagttcctcgctagggacggagatggtgacacgtgagtatctttttagttcatgtcctttcacgcttgaaccttattagttggcatgatgatgataattcatatttcaaggaaggctgttctttttatctttttttacccctcaaaagaaattactttttgttttaaattaaaaatatgtactttccgtgaataacctgctgtgaagactaatgtagattatatctttagaggagaaacagttagatcatgactaggcattgataaggagtgaaccagtaggctagatcctatccagtactaattaatgtctgtagagctttgggtaagttacttaaactctccctgcttctagttcttggcacataaacaataatgttttcaggcatagaatttttatcagtattgaaaaaaaacaatagggctgggcagtggtggcacaagcctttaatcccagcacttgggaggcagaggtgggcggatttctgagtttgaggacagcctggtctacagagtaatgagttccaggccagcctgggctacacagagaaaccctgtcttgaaaaaaaaccaaaacaaaagcaaaaaaaaaaaaaaaaaaaaaaaaaaagttttttaaatgctcagcctggtgttcagcattcttatccttttccgtttcagttcaggtagactaccaccatgtcagaagtgccaaatttctcctcctctgtgatgtttcattttgagtgtatcaatgtatcgttaaatagggtgaaggaaatttttctctgatcaacctaatgaagtcagaaacaattcctctttctttcgcctcttcaccaggtttctccatattgctgttgcccaagggaggcgagcgctctcgtatgtccttgcaagaaagatgaacgctcttcacatgctggacattaaggagcacaatggacaggtgagggtgctgcctcggctaagatggagtgctggagtgaggggtagccggtctccagtgcagactgtttaagagcctcaaatcaagagacttctgttaatattaacttggagatattgactttttgccaccattaaccttgaagtcattaatgcttactttgtagttgtttggccaaagattgcgtataattaagccgcaccctaagcttattttagtttcctcatcttgctgtgtttggttgcttattaacagggtttattttctttctgtggacattcctctcagccacagtttagtttcatattccttgttatgatagtgttacaggcttaaaaaaaaccatcttctctccatatgtccacagagtgcctttcaggtggcggtagctgccaatcagcacctcattgtgcaagatctggtaaaccttggtgcccaggtgaacaccacggattgctggggaaggacacctctgcatgtctgtgcggagaagggccactcccaggtgctccaggtaagaaaagaggccagaaagcaggcttctgttatcaaaagatgtgcttggatatgagccgtttcccgtaggctgcttgttaaaacaataatgctttgagttgatttatcccttagcccactagtagatgcctatttgtctgccccacctttggataacaggcgtgtattttataaaccttgcaggccatccagaagggagctgtgaggagcaatcagtttgtggatcttgaggcaacgaactatgatggtaagaggctgatactttattggctaaagcactgcatggaaagtggggtgcatgaaatctaagagcattcagtgtcctaagacagaaagaaaataaagcaagttgttctacaggtaaaaccgcctcggtatatgcggattatcttactaggttttatggagcccgttctgagtgaatcgaggaagcatcctaaggatagttacagggaccaaaagacttggtgggatgcctgacttcctttgtacccttttttcctaggcctgactcccctacattgcgcggtcgtggctcacaatgcggtggtgcacgaactgcagaggaatcggcagtctcattcgcccgaagtgcaggacctcttactaaggaataagagcctggtagacaccattaagtgtctgattcagatgggagccgcagtggaggcaaaggtaacttcacagggaaggtagagctggggtgggggagggggcgtggcagagaaaagtgggcgtggcggaggcctggcttgcaagcgcagattaactcctccccccctttcctcacccccctacccacccaccccgatttttaagttggtggagtgaggggctttatatgtgtagttcagaagctaacctttgaaaagatcttttcatccgctttcttgatttctttttaatctgtggagttatccaaacaaatggatcatttaactgtgaaacgagttaatctttgttttaaatgaagctggaaatcgatggtacattggtttccgttttcatgacggtgcttttttggaatgatttcttagtgcgatctggaatttttaaattttgattttttttaaaaaatatttttataatgagatttttacgtgttttctgtgcgcctgtgtattggtccatgcggaagtcagagaatcacccataggagttggttctttccttccactctgagtcctggcacttagctcagctgtttagaattggtagcatgcaccttaccccctgagccatttctctggccctctgttaaactggaaaatattctttctaaatctggggattatttatggagtatctgctgtgtcctgaagcaccgtgttaaatactttggggattccgatgcccacgtgggtccccatagagcctgctgtcctctcccactttagcaatacatggtggctgccaagtctggcgacataacacatcatcagtggactttgatataaataagaaagtaacactttatatttctacattgttaagggctgctctgtgtatgagtggaatgtgacaagaatcaagtaggaaaattagttgggaatacaagaggaataggagagtccatgtaccctgggctttggggagactgaagaaggaagcgtccgaagtgatctctaaagctgctttagacatttgagagaggagggccaaagcatattgtctaaagcagctgttctcaacctgtaggtcacaacccctttgggggtgagggggtgtcaaaccaccctttctcaggggttccgtattagatatcctgcataacagatatttgcgttatgattcataacattagcaaaatttcagttatgaagtagctaggaaaataacttttggttgagggtcagcataccgtgaggaaccgtattaaagggtcgcagctttgggaaggctgaggaccgctgctctggggcgtggcatctggattttcagtcttcgcctttcttgccttcccaaggatcgtaagagtggccgcacagccctgcacttggcagcggaagaagcaaatctggaactcattcgcctctttttggagttgcccagttgcctgtctttcgtgaatgccaaggtaattttcagaacctcagtgctgccagcgtgggaatgaccttcccacctccacgcctttgagctcctttcctggaatggccctctgcctgacgcatgcgcgcttctgtcctcttgctttcaggcttacaatggaaacaccgccctccatgttgctgccagcctgcagtatcgggtgacacagttggacgcagtccgcctgttgatgaggaagggagctgaccccagtactcggaacttggagaatgaacagcccgtgcatttggtccccgatggcccagtgggagaacaggtgagggccacaggagggagtggaagttcctttaggcccttgcgactgaaatataaagagggaggaagtcgttcagggcaaaggccagctgatgctctgcaggtaggctcgtcagtgtagaatatttgacgtagttcaggcacaagtaaataaatgcctagtgaatatcagtttttataagtctgtctactaactgatcctccataagagatggaaaagaacctacaatatttttaaattatcctgttcttattaagtgtggttatatttcatctttgggggttgaatagttagttacacatgagtaagctcttctctgtaagaacttaatcttttaagaaattatttttggcaaacatcttttttccagagggaatcattgtgttcggcagcattggatagacaattttatacgctattaatcataagttaatttacacaggttagctttttgattccaagctgtcatcagaatcaaaatggcctagtaacttgcccacggaactcttaggaagtttgtggcagttttcatttaaaagttgcaaaacctttttaggcaggtttaacttggagaattaaacctgtatttagagaggacaggaagcgtgaataactaggaaatggcggtctcaagctcagtagtggctgcttcctcgtggtcacacacccagctgtcacacacccagccctgaggctggagtctgaggctcgtccccatccctaaaggtttttacagtgctgccattcttccttctgtattgtgtgtgctgtcacagagaggggcttctcttttccttcctcggtaggcggtggccattggacaggtttcctttcagaaagcagctcgcagcaacagccaccaaaatctcttcctctaattgcttctaatctctcgtgggctgaaaggcagatacacaatttgtctgattgggatacaaaaagtcagtggctctagatgactgtgggggctttcctgagacccggagagctacacacagttgcttggacatttggatatcctggccgctgctctaccacgagtttgacttggctgtgctcctaagttaggggtgcactgtagagggttaatgagaggagtgaaaatctgggagacatataccgcttggagcattggaagtaagttccacgattcctttctcttccagatccgacgtatcctgaaggggaagtccattcagcagcgagcaccaccatactaggtccactggcgtggagcctggttcagcgacactcactgtcagttaggcagtcctgatgtatctgtacatagaccatttgccctgtattggcaaatgtaagttgtttctatgaaacaaacccatttagttcactattatatagtggattatattaaaagaaaagaagacagatatctaattttcttggcagatttgcgtatttcatacccaggtatctgggatctatatatctgaatttgatcttgaatggtaaaattaccttcgataaccagtagctttcaggtagggaaaaaaaaaaagactcatgggaaaagacttgatctgtggcataaagccttgctcatgtagagattgccaggtccagattaggtgggcttgaaacatgaggtgaaaaatgaaagcatttgaaaggggacagaaatttggatgtgaggttgatgtgcactttgctgtcatcgatgcttctttggtcagatgcaggacctggtgtttaataatgctctctctctaggtgagggaggcctcttgataggatgtgatctttgaagctgtatataattctcatttttaccttttaaaatgttgtacatatttgatttgaaccacggacatttgaaatgtgtaagtcaatcaagtagaaaagagctagtgaattgttcaccactttcaaggttgtgcacccacaaagcaacttgtactgtgtaatcgtccagctagagtttttacagataaagcaaatggggaagtgggtcccaacgttgctgtggtagcaggcgggtttctcttgcattggaaacagacacgtttgtaggcatttgcgtattcttgaagagactgttttatgaatcacctcttagatttatgtaatttacctaagttgttgaagtttctgtttctccttaagagaaattacaaaaattcaacattgaagcatagtttcttgttttctgttgtcaaatagtaataatgtgctgtgatgtttatgcttattcataaagatgttttactttttagtgtaatgttagttcttttaacattattttgcttaaatttgataatgcccgacaagaatatattttgctttgatttatacactgattctttgtgacaaatatgacccattaaaaatgccttttaatagactaacttaccttttgtagctaggtactcatgttcttttttaaaagatgccctttggattggattggattgatcatgtttaactcagcgtattttatggatgaaagctaaatacagatatttggcatctctaaggtggaatgagcccactccacacactgataaaattcatgcatagttttaaatgaacattaataaactcatgttgtcttatgtgtttttcttttctagtgccttatttgtgtgtagtttgaagaatactatttttttttccattactaaaaatggactctaggggccttgtgtgtgccaggcaaactctttagctgctgtgctctagtcctttctagcctagaaaaggtattaacaacaaactcagagtcttaacaaacaaaacctttaagttacttacttttggcttttgtgtgtgtgtgtgtgtgtgtttgtttttgagaacatttcctgaaattatatgccctttttaacatccaaaaatggcttgctatattcatgagaagtttacgttccgaaaacacaaagtttagtagtagatgctgttaaactcagaagtttatataataaaaaagacggacaggtcagtggacacagcaaacagtgtagacattatccgagtcatcctgagagggagggatgccagtctctgaacagtgccaagtagtgtttttcccttttcccattattataattgctgcacccgcatcctggttcttgagagtacccgacgacagccatgaattcttggaaagtgtgcctgagtgtgtgctgtatgtacaggaatgacgatccacattgccaccatcttcttgagttcagctatggacaattgtgctaaaagattgtcacagctgagctattgactattaaccttccctcagaaggaggcagcaggaatgtcaatggactctcacctgaatatccaaccattcctcctaattagttgtatttctgctctaatttcaaggtcttaggaaggggctagtctattaggctgcggaagactctggggaagagggttctacctgtgagacatggacaatccatactgggcatacattttttttggtgtaactaatttgggttcatcaatgctcctttcggtaaccccctactcggtctatataaacctgattggtatacttgttggctctccaggggaacttatatggtggttgtcccttcccagagtgaaagtttttagtcagcatatgtgcaatgatgcatacagtatcaggcttagcagccctagaagaacaaggctcataggccaaggctctgtttcacagtttttcttttagataatgtcttgcgcatagattgtaaatgtacctgcttagatagccatcagagtaggaacagaacacactactgaacatgcctacacactgggttctctttaatgagcttatgagtgtcccttaattagtgttcccagcaatcggttctttcacaatctagtgtttaacaaagtgtgtgttgcacatgcataggggataatataaggcaaagatgtaagaggtgtggtatgcagctgggcgtgatagtgcacatctttaatctcagcacccaggaagcaaaggtagttgggtctctgtgtttgaggccagcctggtcgaccctgtcttgaaaagacacagccaaccgatcagaagagaggcatgccatgtactttattgggtagactggttgaagtgccgttgtgagagattccgaaaaggactgtacatctgggaggattcaaggataggggatttgggctagacatggaatagttgatccagatgctcagaaagggaggaggaaagtggaagaaatagaaaacagtgagaccccgggtggtgatctctgtgctgtttggttagaatctaagatagccaggtgcttctacttgtgttctacatgtgactggtaatattctatcacactgagaaagatcctcaaccttcctaggcgcttagcggggaggaagtacagtggtggactctgctgcaatggtatggaaggcagccccacagaggccaagaccgcatcccatactcgttgcttagcgtgtggccaaataggagattcatgaaacactagttaaatgagtgaacaagttcatgctagttgtggttagaaccactggttactgggggaggaagtactgtgaacaagggttcactattaatgaattaaagtctaatatatttagctatgtaattttacatcagtcataggtaaggataaggggccttgttgggctcttaaaaattatcctgtatatcagtatgtccctctttgcaaacaataatagtttggatatagactacagagtccccacaagtcacacaccaatgtttccagctttgttagccaaattagtagcatttaatgtcaggagcggaaaaatttctaaaactcttctagcttttagaaaatattgacttctttttaaattatttactcatttttattttatgtgcattgatattttgtttgcatgtgtgtctgagcattgatgttttacctgcatgtgtgtctgtgagagggtgtaagattccctgaaactggagttaacgacagtcgtaagctgccatgtgggtgctgggaattgaacccaggtcttctggaagagcagttagtgctcttaaccatctcttcagtcccctttccccccaatatcaacttataaataacatcaatggttttcattttttgataggatcaattactctattcttgaatagagtataattattagcagctactttatattgaaagtggcctcagggataaatcaacttcaaagttctgaggtcagtgtataaagtttgagctttatgtatcaaaagatggcctagtcagccatcactggaaagagaggcccattggacacacaaactttatatgcccagtacaggggaacgccagggccaaaaagtgggagtgggtgggtaggggagtggagggggggagggtatgggggacttttgggatagcattggaaatgtaattgaggaaaatacgtaataaaaaaaatatttaaaaaaaaaggaaaaaaaagattgagcttatttagaccagtatcagacacacagttgatagatattctcatggtttttaattgacccttgtgtggcttttcaatgcatcccccctccctgcttgacacagtgtataccttaaagtgtattttatctttgacatagagctcatgctttgatccagatctatttcacgtcattcaccatgcacaaatccagtttcagggttcttcttaaaggtcacactgtacaagggaagtatttccaggaaggttgtagattcctctcatatatatgtatatatacatatatatatatacatatatatatatatatatatatgtatatatatatatgccagtagagttggagcatgataatagcccagtggttgtaaaaaaagaggtttaatttttaactttacaagaaataagttgtcattagttattttgttttctgttttacttatgaataaatgtgctgttttccatgttggatcacagtatctaaagttgctcatgggggaagcaatatggtcataagattaaacactagttttctactcggagcacttgactttgtaaagataacagcaaggtgggtgctcgaaggaggttgcagatgttggaatgtgaagcgttaggcagctggtcctgagtccacatggctcacactccagttgatacacgccgctctcattgagtgacagccttctggctattgttctgcaaatcatgtcttcatcagctttgggagcggtttagatggatcgagcatgtgtttcctgttagaacagcagattagccataagtgggtttgacaggagagacgcatgccaattgggaaataatactagattccttagcttaacagattcaaggctcaagtttgacagctttgtttttaatcagctcattatctctcagtcctcttggcctgccttccttttgctgccaatgcctctcctatagagcttgagttccaagagcttgcatcagtgtggaacctcagggatggtctccaccagtgcccatggctttttctcttctggcactcattcattgctgaggaccatgttcatggagaacagactttcacaactgggttattattttttttaataaaatctttctatctggaattttttttaaagataaacatctgaacttgacttagcaacaacttcaaataaaatgcaatatactatatatatcttggtttaaagggaaacagacctctttagggacccacaaactgatttttttttttttgatatagatccaataaagctgtttattaagacagattgcctttcagtctctttaaattttatgggtaactgttgggttttttttttttcatgtgatatagtaaagatctatacagagaaatttaagtatgcatactatttcttttcctatatattctagccccacagagaataaaatgtagcatgttaaatacaaggggtttaaacaattgacaagtttatctttatggcattttccatttcccaagaggtatcaataggtagttttatttttcttttaaccaaagttctatagactctactacaaaaggcacattatctgttgaattaatttttgtttctattttttgcttgtcattactgcatgccaaggcttttgcatgttttctagattgccacaataatttttttgtttatcttttttgtatgtgagatgagtatgagtaaatgtggagtgtgtgtgtttgtagtgtatacatggttgacactttccttgattgcttttcaatttatccatacaaacaagagtttcctctggctgtagcagaaagaggatgccagagtgattttaagtctgagaaggactcaaccctcaattagtggcttggaggataaaggaaacggcatgtgccatggaacacagtagttcctttaaatgcagagagcaactaggctctcaagtcttctacacacaagggaccaaactctttcaataactgaataatctcaaaagccaatcctcctccacggcccaggtaacactgtttcacattagcattccaggcagataatgtagccaagcccatccagaattctggcctgctcaacttcaagttaaacacaatcggctttttaagctgctaagtttggaagaatggcactcaaaagaaaaacagacaccacaaacaggtaatacagtgttcgagcttgtagtgcgagtttgtgcactcctgttatcctaagactctgaatcagcaagagagatttcccaataagtgggctcgtcgtacaggctagcaggctttgtttatgattcctactgttatccatcagtttcccatggcaggcagaaatcaaaagaaagggaggtctcggtattgccattgtttctaacaccaagtgtgtaagcacttctttgagcagaggaaggtaataggacagcatatgtgacaaccagtactgtcagcccactggtcctactctgaccattcactagtgttatcaggaaggggcaggtagagagtggacactgaccttgccggcagctgtgatgtcagatggtgtgacctgcttatgaaataaatacagatacacacctcagaaactggtctttcaaaaagatggttactcagagttcttagaaagttgagaactgcagttccagccttcttgccacctaaaatcagaaccgatgcacatctctccaggtatgaatatgcaaggcaaatggctagacattcatgtgaaatacctgggtgtaattcataaagaacgtatttcttatagaatttacttctgaaggattcatcatagactcaccatgaagataatgcttccagtttaaagggatgaatgtcctttaaaaatcaacttttttttttaaataaaaaatttggaggggaattcaaacataaggactgtagttacataatttaatttcttgctctatcctttgatagtcattcattccatgtctccctctcaaattcatgaccttgtcatctgtaattgctattcagaaaagtgtacagttcaataatgtgtgcacccatgtaatcaacactcaagtcaagatggaaaacattcccatctccccagaaagtcaccccaccccgcctttgccatcagcccctccacacactgatcaaggtgactattgatctgttactacaatgtagctttgcctctactagcccttaatggaaatgacagcgcatgatatatttactctttctgttcagcatctctcactcaccctcgtgttgttgagtgtcatcagcattgatgcatttattgaggtatatttctattgttgactagttgtgtaaatagcatctgttattcatcttttggtggctgtcttagggttttattgctgcaaggagatgccatgaccacagtgactcttataaaggacaacatttaattggggctggcttacaggtcagaactttagtctgttatcatcatggcaggaagcatggtggcacgcaggaagacatggtactggagaggtagctgagagttctatatttggattcacaggcagcaggaagagagaatgagccacaaggccacccccagtgacatactttctccagcaaggccacaaccactccagcaaggccacatcacctaatagtaccactctctatgggtttatggtccataaaccaccataatggcctttggggtttctttcaattttcagttttggctttcatgaataaagttgctacagatagcctttgtgtgggtgtatgttctcatttcattttggtcaacacccaggtgtggagtttatatttgtgattgtttaattttatcagaaactgctgagctgttttcttttgcaaacctctttatcacttgtcacttccttgtaccatctgagagatttaactttgtccatcctcttgaagagttagcactgctaggcctgtcagtcttagctcatccaaagggatttctagtattactgtattattttatttttcatttttccctaatggctaaggtaattgattattatttgtttattgaccaattgtatatatatgttaaaaaaaagacagttttttttttggtgtttttgtttttgtttttacctcaggctggcttcaaacttattatgtagccaaggatgacatggaacctctgatcatcctttatggcctgagtatggggactattggcccgcagtactatgcctactttgtgtgttgatggggcttgaatccaaggcttcatgtatgctaggcatcagctagatgcaggtgacacttgcctctaatcttagcattcaaaatctgttgggggacaatcacaagttagaggttagcctaggctgcctagatactgagtttgaggccagcctgatttatatagtgagactttgtcttaaaactctataatgatcactgttgctacttagttttaagcgtttaaaatatacttatattctggatatttccattgacaatttatttcaaaaatatctttcagtctgtggcttgcctctccatcatttcttaggaaggtactttgacccattctttctttctcttctggaactttaaataattatagaatttcgaattgtcctagtatgtctgtggtccctactgccatctttggtttaccatgacttatttgttattattgtcattgaacttttcagcctcagacatttcacagttttaaaaatagagtttaaatttctctgctgggatttcctcttttcactcatggggtttatacttcccttagttctcccagcacatgcccttccttcagtaatgtttataatagctaaattcagaagctcaggaataactatccttgcgttccccttttcctggggagcacacctgcttgatttttgttgtttcaggcccagttgtttaactgtgtagacgttaatagtttatgtattgtgtagactctagaatttagtaatctaagcattacctttctctcctctgtagcgcagttactggctgtcttcctggaagttctatatgcttgttctcttgcttcctgaagttttctttggaaagctcaatgctttacaagtcccatctgtttcgcagcaattctatccccaaatttcattttctttgttgacatctagagtggaccttactctagattaggtttcacttcttttctggtatctcagtttggggcttagtgtattaagaaattgcacacaagatttggccacccgcgtccagcagcattgtatggtgttcttgttctttcttttttgttctttgtagttatgacaagccttgggatgtcttgccatgggcatgcttatcttagacccacgccaagaatttgtaaggaagcttccataccacttttggggcattctcttcttcccacttttacataccatccttccttctcagtgttgcatactgcagacactggctgcttcagttctcatcactgacttccgctgacctgtttcctcagttcagtaggactgtgacacttgaagtttgaacttcatcttcctgtggcatatttggaaaattgtacctagcattgtgctctagatccagggcaacctttgggcttaccaagtgaatttttgctttctcagtgttgaatttcccttgtccaatgtttaaaagcctcatgtcgtatctctaactgtagtgtttagagttggagggctagtctaatactagttgctttattatatttggaagtaaaagtttgaaatatatacgtttagagattacatcacaggaacttgagatgtggttggtatgagcttagcgtgagaaaagcctggcttctatcctatgcatattagatttcataatcagataccagatctcataaacaggaatggatttaacaaggatgtattacaaacttttatttgaactgaaaaagaagttttaacatcatgagttcatccaatgtcctataacactggctctattcataggaagtgagtatggtagaatgcagtttctttgtagttcttaaaactgtgtagccagcttctctaagaaactaaaacaaagggtctaatatagcacttacaagaataacttactgtttttgaatactgcatgttttaggtgctatttttaaattttatttctattaactgtaataatatattcttcataatatcatctaatttatccccagttgactgagaattaagtactagtcaatactcaaacatttactagctattgctaatctatttaaatatgaagtcgaagtacaaatagatgaaataattttcttatagtggcatatctggtaggtggcagataaggaaacctgtggaaagcttttgccagtgtcaattcaaaaagtgttgtacacaattaaaaagttttagaaacacaacacatgtgaatttatgaatggaaggtagacctttgtggtatgtgagagcctgtgggcatgtggaagctcctacctttggggtattttcagatgtaattttattttagtcatgaccttcaattggttaacatatgcttcagagccttgcttcaataccagcactacaggtaaacttgttacatgatttcataataggtcactcttcatttttttcaatcatacttgccatcagactaatataactatttactcactagataactttccttatagaccacaagctccatccagcccagcagccagacaccctttctgggatggagtacttagtaagtatttgctaaggggatgactggcaggttctcacccttctcaacttcctataaactcagtgcaacaccgatgatttccttttttttttccctacttaaaaaaaaataacacacacagtaaacattattttaacagaagtttataaatcagatagccactgccacagtcatgatacagaatagtttctatcttcccaccaaacattctctcttgttaactctttctgcttaaactctacatacccagcctttacttaatagcaatcactgagagctggtcgtttagtctgggcttttctctcaatttccattttggtttctctgttctgtatctgttttaatgctggcttgcatgcccactttattaaatgatttaaacatttaaattcattgccatttaaccattcacatggagtcatttgagccaatgacttgaccaccaggaagaagagggaagtgagat

SEQ ID NO: 764 - DNA, 3255 bp, Mus musculus
agttgagccccacatgggggttggcaggcagcagagaggcccctttcaaggtgttcgcgtgaagaactcggtgaaggagctcctgctacacatccgaagcaacaagcagaaggcttccggccagcccgtggatgagtttaagacacagagtgtgaacattgagcagctgacagacctgaagagtgcagtgtccgcagtggggaaaagaaagggacccgatcctctgtccgatggaccggtttgcaagaggccagctctgttgccttctcacttcgtgacatcaccgcaaacgcctacacctggggagagcatggaagatgttcgccacagcgaatccaagctggatagcagcgctgccctgcttcagaatattataaacatcaagaatgagtgcaacccagtttcactaaacactgttcaggttagctggatgagccccacggttccccagaactcgccaagagaccagtgccaggatttccatggaggccaggccttctctccacctcagaaataccaaccgttccaagtcagtggctctccacagatgatggaccaggcgtcaatgtaccagtattcgccacaaacacagaacatgcagcagccgccgccgctgccaccacagcagcaacatcaacagaattatccccacaactcacccctgcagttcagtccttactccagaatgtcccagtctcccaagtatgattccaacctctttgatactcacgagccacagttctgcacgggccaaagttttgtgtctttactgactggcccgggggaacccgagtctcttgctgttcccgttccggctcccaccagcattccaccccaaactgagactcagctgcagaccttcagcctgatgccaagcaatgcctgcgaggccgtcgtcggggtgcacgatgtgggctcgcactctttgggcacgtccctgtcactccagaacatcatgggaagcccgatgaataccacccagctggggaagtcattttttcagtggcaggtagagcaggaagaaagcaaattggcaaatattccccaggaccagttcctcgctagggacggagatggtgacacgtttctccatattgctgttgcccaagggaggcgagcgctctcgtatgtccttgcaagaaagatgaacgctcttcacatgctggacattaaggagcacaatggacagagtgcctttcaggtggcggtagctgccaatcagcacctcattgtgcaagatctggtaaaccttggtgcccaggtgaacaccacggattgctggggaaggacacctctgcatgtctgtgcggagaagggccactcccaggtgctccaggccatccagaagggagctgtgaggagcaatcagtttgtggatcttgaggcaacgaactatgatggcctgactcccctacattgcgcggtcgtggctcacaatgcggtggtgcacgaactgcagaggaatcggcagtctcattcgcccgaagtgcaggacctcttactaaggaataagagcctggtagacaccattaagtgtctgattcagatgggagccgcagtggaggcaaaggatcgtaagagtggccgcacagccctgcacttggcagcggaagaagcaaatctggaactcattcgcctctttttggagttgcccagttgcctgtctttcgtgaatgccaaggcttacaatggaaacaccgccctccatgttgctgccagcctgcagtatcgggtgacacagttggacgcagtccgcctgttgatgaggaagggagctgaccccagtactcggaacttggagaatgaacagcccgtgcatttggtccccgatggcccagtgggagaacagatccgacgtatcctgaaggggaagtccattcagcagcgagcaccaccatactaggtccactggcgtggagcctggttcagcgacactcactgtcagttaggcagtcctgatgtatctgtacatagaccatttgccctgtattggcaaatgtaagttgtttctatgaaacaaacccatttagttcactattatatagtggattatattaaaagaaaagaagacagatatctaattttcttggcagatttgcgtatttcatacccaggtatctgggatctatatatctgaatttgatcttgaatggtaaaattaccttcgataaccagtagctttcaggtagggaaaaaaaaaaagactcatgggaaaagacttgatctgtggcataaagccttgctcatgtagagattgccaggtccagattaggtgggcttgaaacatgaggtgaaaaatgaaagcatttgaaaggggacagaaatttggatgtgaggttgatgtgcactttgctgtcatcgatgcttctttggtcagatgcaggacctggtgtttaataatgctctctctctaggtgagggaggcctcttgataggatgtgatctttgaagctgtatataattctcatttttaccttttaaaatgttgtacatatttgatttgaaccacggacatttgaaatgtgtaagtcaatcaagtagaaaagagctagtgaattgttcaccactttcaaggttgtgcacccacaaagcaacttgtactgtgtaatcgtccagctagagtttttacagataaagcaaatggggaagtgggtcccaacgttgctgtggtagcaggcgggtttctcttgcattggaaacagacacgtttgtaggcatttgcgtattcttgaagagactgttttatgaatcacctcttagatttatgtaatttacctaagttgttgaagtttctgtttctccttaagagaaattacaaaaattcaacattgaagcatagtttcttgttttctgttgtcaaatagtaataatgtgctgtgatgtttatgcttattcataaagatgttttactttttagtgtaatgttagttcttttaacattattttgcttaaatttgataatgcccgacaagaatatattttgctttgatttatacactgattctttgtgacaaatatgacccattaaaaatgccttttaatagactaacttaccttttgtagctaggtactcatgttcttttttaaaagatgccctttggattggattggattgatcatgtttaactcagcgtattttatggatgaaagctaaatacagatatttggcatctctaaggtggaatgagcccactccacacactgataaaattcatgcatagttttaaatgaacattaataaactcatgttgtctt

SEQ ID NO: 765 - protein, 633 aa, Mus musculus
VEPHMGVGRQQRGPFQGVRVKNSVKELLLHIRSNKQKASGQPVDEFKTQSVNIEQLTDLKSAVSAVGKRKGPDPLSDGPVCKRPALLPSHFVTSPQTPTPGESMEDVRHSESKLDSSAALLQNIINIKNECNPVSLNTVQVSWMSPTVPQNSPRDQCQDFHGGQAFSPPQKYQPFQVSGSPQMMDQASMYQYSPQTQNMQQPPPLPPQQQHQQNYPHNSPLQFSPYSRMSQSPKYDSNLFDTHEPQFCTGQSFVSLLTGPGEPESLAVPVPAPTSIPPQTETQLQTFSLMPSNACEAVVGVHDVGSHSLGTSLSLQNIMGSPMNTTQLGKSFFQWQVEQEESKLANIPQDQFLARDGDGDTFLHIAVAQGRRALSYVLARKMNALHMLDIKEHNGQSAFQVAVAANQHLIVQDLVNLGAQVNTTDCWGRTPLHVCAEKGHSQVLQAIQKGAVRSNQFVDLEATNYDGLTPLHCAVVAHNAVVHELQRNRQSHSPEVQDLLLRNKSLVDTIKCLIQMGAAVEAKDRKSGRTALHLAAEEANLELIRLFLELPSCLSFVNAKAYNGNTALHVAASLQYRVTQLDAVRLLMRKGADPSTRNLENEQPVHLVPDGPVGEQIRRILKGKSIQQRAPPY

SEQ ID NO: 766 - DNA, 31724 bp, Homo sapiens
  misc_feature (1)...(31724): n = A,T,C or G
tagtgagctcaatttaagctcaatttaactcaccttccaaatttagccttttctttgggggaaaagaggtttaagtcaaaatataaaggaaaagtataatggttagaagtttcttagctttaggcctttgcagatccatgtaggccaaacctcatacaaaggaatggtgaagggtctttcgtcaaaaattttcttaatttctgtggatcctaaaattcaactataaaatattcagttctttggggttaattgccttcaaaattttttttctccttaaaaagtaaatattaccaggaaaagtaacagttatcatttatttgtagtacaatgtaaattagcttattagttttcttcctgaaaactgagatcctttcccagagcatgtacattttttacagtagaagggtacagggatgggtaattttgaactatgtattactgtctagaatctgcggatttgtgtaggaaagagtgtcacaaagaagaatggagaggaaaaaaggagggagaaaggggagttgggattagaagatactttttggtccttcaccattctgttttaaggcagttcagattttagtgtcctttaaagcaggcaagagttgacagtattcccacattcagtgtttaggaggatgctttcattcatatgtgtggaaatgaaacttttggagttgtcaacaagtcagagaaagcagaagaagccatggaacttgtaatgctctctgcctttttggacaaagctcacctacttcatttttacctcttggtgtctatagtgggtaaagttcatcattataaatagaaaccagaaaacactctcatgagctaagaaccatttacagggtgaaagttaggaaagtgcacttgtttcatgtggatgttttgtgtgagttttgattattactattagaaagtgtggtacacaggtagcccttcagactaacaccaaacatcactccttcatatatatgattttgtatgaaccatatgcattttatagtatgtggatattttctgaaatcaaatggaagaacttttcatttctttagaaatgaaatgttaaaggggaagaaaaatttgttttgttttcagtttaaacacttggatttctgctgggctagaaagatgggatgctgcaaaggtatttcagggtactgtagcattgctgtgattcagggtctgtttataaggcatctgtttattgggatgttcaactgtgtgacctgactttgtgcaaggtgcctctctggctgcccatcaggggacagaccttgtgtacctgctggaaagcagtggagttactttacatagtggacgactcactcacacctagtgggtgctcagaaaatatttgtgaagaggacaaagtggtatatggcatctcctttgatgctttcatataaaaggaagttgcagagagatgactccggggacactattaattttgtcttcacacaatcagtccataatatgcaaagttgtacatactatacatacagtacttaacggggtatcaagtttattctcttagcactgagcaggatgttctgagatgtgcaaaccttttgctaattcatctgtatgatgattaggttactggttggagaaatttcctcaatatggtatactgtgctttgatatcaggtgctaataatttgctgcaaacaggacctagagaattacttttaaagacaaccttttgatctttccagattaaaacatacaaaagaataggttacactcttgtaaggaaaaagcttacagaacttactaactacagctgtctgtgccatagcctggttggtcaggtggcctattgggaagtatataagtgccagtagaactgagttcatatgtctcagaaatagtaattgtttctattacatggataccatatggaccagaatgttcatacagccaggtataagctccacaaagacagagattagtgtttgtctgaggtaccgctgtgccccagtacttagaaaagtacctgacatttataaagcactaccatattgaagaataactagaatttgaaaatatgtggtctgatttactcatctgcattagaaaaatctgttagaataccctgaagtttaaatgtttcttgagatgttgaagtatgttttacattgctatggggataataaattattatttttaaggaaaagcattcaacaaatcaacatataagatgatatctgttttgaaagctcctgaaagattttatgttctttacaaagaattctgggcaaaaggcagctgggtttttatatttacaagatagatgaaaatagttttataataatccaagtgcagagaatgaggagattctaattcaaggggccaaagtatttgttttgatgtctgtacggtattgacataaaataattttggaagcatttccacttgtttctaccatccagttaaatatgtaccaagtaactacctactaagtaacaggtacttggctattgacaagggatacatgtcttgggagcttatagtggaatagaggagacagactcataaatggttaattttagcacatcctaagagctatgatagaagtctgtgtggggactgagaggaaaggcccttagtccagaagtggggttgagagttggggtcaggggaggaagggagggtcaggaaaggctccagaagtgttggatattaagtgagtcttgagtgagtgttgggtattaagtgagcatgagattttggttgaggaagaggagagaagaacagcaagagcaaagtctcagagctgtgggaaactatactcagtttcgtgttactgaaggtaatgaggaagatgaagcttgtgaggaaggcaggacttggacatctgtcattctaagaagactggactccatgctaaaagcagtagagagccactgaaggatttttaaatagtgtagagcaagcttgtccaacctgtggcccatgggctgcatgtggcccaggatggctttgaatgtggcccaacacaaattcataaactctcttaaaacattatgagattcttttgtgatgttttttctttttcttttttcattttcttttcttttcttttttttttttttttagctcttcagctgccattagtgttagtgtattttatgtgtggcccaagacaattcttcttccagtgtggcccagggaagccaaaagattgaacacccctggtgtggaggaattcttagaagaattcctggcattccagcattccattggtatgccgatggcagtctggaggatgggttttaagtgggcaaggctggatgggtgatcatttgcatcaagtaagagataaaggcctgtcttggatagtggaaattagagatggagaagagaggagggtttcagaaccaggtgttcaacaattatgagtccaatctggaacttttgagttgactgataggacattgcctacattcgatccctaaaaattatttaaatctgtacttactaatttatttttaaaaactgtattttctaaaaaaaaaaaaaaaaaaaaaaaaaaacttcatgcaaacagtattgtttcacatctttgcaaatttcttaacatccggttttacagaagacagattttcatatttgcttctgcatttaatttgttgcagttgaccaggtgcaggggtttacgcctgtaatcctagtgacttgggaggctgaggtgggaggatcacttgaagccaggagttccagacaagcctaggcaacacagccagaccccatctctacaaaacatgaaaaataaaaaaaattagccaggcctggtggggcatgcctgtagtcctagctactggggagactgaggtgggaggagagactgagcccaggagttagaggttacaatgagctataatcatgccattgcactccagcctgagtgacagagtgaaaccctgtctcttaaaaaagaaacatgtgtcacaatatcttatgttggtgaaagtataaagaaaatctggtctcatacacaaatgtagttggtaaaggaagaaatagcttaatagtcttttcaggtaatttggatattctaatttaatattataccaaaacaagtggtagttccttaaaggagagatgcaagatggaacctgaaaccatatcaatgaactttttatcttctgatgcattaaaatccattggccacatcttctgatacattaaaatccattggccactttgaatggctctttcacccatgtgtgattttataatgtcttgcattgttcatttggaaattattagttaattgagttatgcaaattttctaaatgttgccacatttcattatataatataaaaaaatcacatttgttaatagcgcatcatcactgggctcatcaaaaaagtcttctagaactaggaagctatcaagctcaaggtgtccaacagaagtttcccaaaattgtaatttttattgaaaaacttgaattttattattggcaacaaatactgttattttccttaacatgacaggctcactttgttcattaaaacacaaaaccaaaccaaaccaaaaactgacaaatacctgagtctgaaacagtttgtcagtcaagtataattggtgttccatgaaaaacagagggcagttcaactcacaactcaaacagtatttgattagaacaaatggcaatgacatactgttcaagctaatagacaagtgcatttccttgagacaattgtcatatttcaggatgcagcacaaacttctatgcatatttcccatcttgccacataaaatattaaaatgatgtatacaagagtcaattaatattgttactgcttcatccaggactttttaggtgaaactggcttttattctttttctttctgcaagtagacagtggtgaagaatacaatgattactagttcattttgttgctgctgccttgatttgttttaaggcaccattagttatacccattgcttttgtaccatcatttcaaatgtaaacacaattgtttcaggataaatgatgagattcgaaaagttattgtacattttgaatgtttcagcattccttgtgtttgttgtcatgcattaaaataaaacacctttgatgactggccggtgctggaaatgaatataaccgaaatagcaagtccagacagtccatagatctatccatttctaaggcaaaagtgcaattttgcagacaaaaccagtttgcagttaagtctttaattcagtgagctgctgcattgttgcaaagtggcagtgctgtgatttcttttgctgacttttcatctagaaaatattcagcaaaataaactctaccaggctttattggtctttcacctatgatgttcatttcttcagccaaagcagtacaataacttatcctgtaagatactggctttttcatctcaagtttgaaaagctgttccaaattgtctttggcttttcaaaagttcattacatctacacttaaaaatccaattctggccgggcacggtggctcacgcctgtaatctcagcactttgggaggctgaggagtgggggatcatgagatcaggagattgagaccatcctggctgacacggtgaaaccccgtctctattaaaaatacaaaaaattagccgggcgtggtggcgggcacctgtaggtccagctacaaagaggctaatgagttcccctaaggnnnnnnnnnnnnnnnnnnnnnnnnnnnnnnnnnnnnnnnnnnnnnnnnnnnnnnnnnnnnnnnnnnnnnnnnnnnnngtcacccaggctggagtgcagttgtatgatcatagcctactgcagccttgacttcttgggctcaagtgatcctcccacttcggcctcccaagtagctgggaccacaggcatgtgccaccatgcccagctaatttttaaattttttattttatgtagagatggggtctcattatattgcccagactggtcttgaacttctgggctcaagcaatacttcctgccatggcctcccaaattgctgggattacaggcgtgagccactgcacccagcccagccctcaattccttttttgaaactctggattattggtctcaagatagtgttacaatgttaattgacaccataaaactaaaaaatgttctattgcataagatacaataaggtaaattattaacatttataaagcctggggaaagatagcgttctcatatttttatttcttctttacagtttcttccagtagctttggattagatttctcccctctatgagttgtcacagaactctctgatgtatcatttcatctttttcagtatctttagatgtagacagtacctctgagcctggagtaaatgaatcctctaatctcgttttttaaagcaaaagatgaggcttcagagtcagttagatgaagatttcaatctcttctttgctttcgatggagcagtgtaactggacaaattctcaaggccccatatttcgtatacagtttttgtgcatcagaaatctcttgagtgtttttgagggttctggttcaaagtgtctcgtaagactatagtcaagatgttggccagagctgcagtcatctgaaggcccgatgtgcagctggagaatctactttcaaagtagctcactcacatggcgggcatattggtgctggctgttggcctcagttgacttttccagacagtgtcctcgtaacatggtggctgtctcccacagcatgagtgttcaaccatatttgattagaacaatggcagcatcctatcattcgacttaatagatcaaactgaatttgtatttcaacatttacataaagcaaagtacatttaaatttttttgtagcgatattaactgtttttgatgtgtatgggagggcttctgggcattgggggttgtggtcttgtcaaacagtactattgctttggcattgcacagaaaacttcgttttgaaacattagtcttttgttgaccatcttggtctagattaagttctccagaggccatgaatttgtggcttgaattttcatatctcatgtaaaatgggaagataattaattaaaacaggaggataattaattttgtaaaaaattactttctacggatttatttgaatgggcatttaaatcctttattatacataaaatattggtgggtagaaaacaaaattcaaatagattttattgagaaactctaatgtattagggttctccagagaaacagaaccaatagggtacatataaatatgtagaaagagatttattatgaaggattggctcacacaattatgcaggccaacaagtcccaccatctgccatccataagctgaagaaccagaagagctggtgatgcagttctaggtcaagcctgaaggcctgagaaccaggtgagctggtggtgtaagtcctagtcagagtctgaaggcccaagaaccaggagtgctgatgtctaagggtaggaaaggatggatgtcccagctcaagaagatagcttcaggctttttgttctattctggccctcagtggattgcagaatgcctgcccgcattggcgaagggggatcttactttactctgtctactgattcaaatgcaaatatctgccagaaacactctcacagacataccccaaaatgatgttgtaccagctgcctgggcatgccttaatccagtcgaattgacacatcaaattaaccatcacactcaacatcttatttggagcatcttttaaatgattttggtttccaaggaattgcaattactgaagtcttgtgttttccacagataaaccaagggatttgttttcttttttattttttaaagttatcaaaaagttggagggagaggcagcaagaagttttagggaaatacacttgtgagaaacaaggaaatacagtcatgcattgcttaacgatgctacattctgagaaatgtgtcgttaagtgattttgtcgttgtttgaacattatggaatgcacttgcacaaacctagatagtctagcctgctagtcacctaggctctgtggtatagtctattgctcctggtctataaacctgcacagcatgttactgtactgaatactgtaggcaactgtaacacagaggtatttgtctatctaaacatatggaaacatagaaaagaaacagtaaaaatatggtattacagtcttacaggaccaccattgtacatggagttcattattgacttaaacatcattttgtggggtatggctgtatttactttggacctacccccaccagggtcttatgccacctactaatactgagtaacaatccaaactcatcgtgtcccccccttcgtcctaaaacccaaacattctgctctgtgatcccttgtgatctggagctggtggccctgttcacctggtcgtggctccaagccatggcctgactggggaccctttcatttctccccccctccaaaagagcgagacctgtgggttctgccctagcaatgctgcccagctctgctttctgtcaatttactttctcctttcccactgtatctgccccagtgcccagtcatttctctcctgggctactgcagtggatcctaatggcctctgggctcctcatcttctctcaactgcttgcagattaattttgcctacctaaaattcatgttttctcaatgtttattaaataaaattccagtgtctcagctgctggaggtgctccacccaaaggcaccaagttatcttttatatttaatgccatcttctcctcttgacaatcgtaaaaggggactatacactctaatatgaaccctctccttaattctttgctcttgttctttctgtaaatgctgtgggccccaatcccacccatcctttaggacctatcttaaatgccaccacccctgcaaagattttcctcctgacctcctttttcctctaccagacctgttgtttctccttttaggtggctcactgaactttgtatccctcgtgttatttaatcataatcggtttatttaaacatagcatgtgtgtacttaaccttatcattcccgcattttttgctagttggacttgaacaaatagttgtataaatccattggaaaaaagtattcaagataggaaaggccaaaattactgtgttagtttatcagatagtgtaaagctatgcagaattttaaaagttatatctacatatactacagcacctacatgtttgtgtattattttgctaagatggctttgttctagtattgaaggatacagaagtgtggcattactttttattcatggctgcacctaaaacattatttgcgtcccagcagataatttgagaacataaaaatgctccaacatctctttcagttcgggatgttgcctaaaaccgtcgacaaacgctatgtttgagaagggaggctacgctggggcgccggaggagacaggcccttaagaaccttccagagatgccttaactgggctaacagctcgccgcgccggggcaggcagaggggtgcggggcgcgctccttccaggacttgccagtccccaagaaccaggccaaccggttccctccactgactcccgcctccctctgcaggcccagccctgcgccgcgcgccctctccccgggcgcccaggcccggcgggggcctagagggcagggatggcccgggcgagggacggggtcccggaggcgggaggcgggaggcgggaggcgggaagcgggaggctggaagccgcgcgctgtcggggtttcccggtgaagggcaggcaaacaaccggtcggtctgggcggagccgggcgggcggggcgagggcggagggcggagggcgcattgcctcatcctgtacattttactggaaatcggacgcatccggaggaggggctgggaggcggcccgggcaccgccaatggccgggccgggcgccggggaggtcggcgagcgctgcggcccgttaaataccctggcagtcccgcgccgcgcccgtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccaggtacccgccggccccgcaccgctgcgtactcggggcgcgcacgcctaggaggttgggagcgggactccccagatggagggtggcccctgcgccctccttagagctaggacgtacgcaccttagccatcaattaccactccccgccttgcccgggccgggcgcctgcctgacctacacgcccttcgccggcccgcggaaccggctccctcccgcgggcctcgggggggcttcagaaaccgctcggccgagctctgactgccgggcgagtgaccaggagatcgctcgctctctaagaagcagctttgttgagtcataattaataaactatgatgagatttggggtctgatgtaggtgtaattttcttcttgtgaatattttagtggaaagctgtagcagaggataagggtttgggaatagcgttaaaggtcatgacttatttctcagtttttatggaatttttcagtaaaaagacttgaccgtcaaagaaaaggaaactgctgttatcaaggtgaagccgggctgaaaaccaactcaagttatgcctttagtttggcgagtttcggaagtctgcccggaatttttgcggtcttgtttttgttgtgtgtgccttaaaaaaaatggataagccatatctagcagagaaagacgtaatgttatctttcatgggctgcgaattggtttcctttcttagtgaaccgagttgcataatttgggggaaaacaggatgcccctgtgggtaggctagaaaaacgcctcgataattgaacgttgagagtaattagcatgattttaaagaacgtctctttccggtgtttcccactcttagccactcctgttttggttgtcatttattttaaaaagtgatatctcattttcattttaagtcatttaaaatcatgcgaaaagcgatttaaaccactgcgtagcagatccagaaagaatatgtgtttaggaccttttcttccccacttggccttcatctggctgaaactgttctgctggtcccttggtttaccacacagccacaggggatttctgaaactgcatttttttctttctgtgacgttggattatgaactgctgtcattccagaaaaatgctgtgttagattctggcaattctggtatctcttgaaatccctaaacttaaaaataaagccaactaatgtttcacttaccctatcattgaactgtttatctcatgtatttatgatagatacagatgttcaaattatgcgttgtttcttgccccatcttatttttgtacacttgatggagcggctgaattattcatttcctgactttgtgaatttgtgttcaacacacatactaagaggttgtgacataatagtgatcagaagtggagtactgtacttgtataccaaatgctaaagtgtatttcaaagtttaaaagtgaaacaagcatatttcctttttacttagaagacctgtgtaagtaattccaaaaacagtcaatgaggggaaatcctgtgtgcatatgtagaaatgtgtttaagctcagtgaatttaagcagcttttttggcacagttgaattgaaggaaataataagacataaatctaagacgttgttaattgtcaggttttcgtacatagagatctttgaaagaagttgttttgtgccttcttaggtaagcggaattgatagactttaaaatttctatgtgaacataaaaccattggtttaaaaagctaaaagtgcatcatttatcacttgctccccaaagtttttccaaagtcaagaataattatagaactatgagagtcaggatggcaaaatctgtcatccattctcatgggtggttagggctgagaaaaaaatgtgatccactctcatgggtggttagagctgagagatagagaggcttaatttgggtttacctattggctctgaggatccttgaccaaatttttatgaactttaatttcttagggtacccagtggagaaaggtatcaggcaacttaggacctttgagcagagctcgggactcacaaggccattgattgaccagagcaagttggaaaggttttgcaatgtgctgcttggggactttatacattaggcaacagctatacttttgggattattaacgtttatgtctgtgaagatatttaaccaggaatatgttttgttttcttttgaacagttgagccccatatgggggttggcaggcagcagagaggcccctttcaaggtgttcgggtaaagaactcagtgaaggaactcctgttgcacatccgaagtcataaacagaaggcttctggccaagctgtggatgattttaaggtgacatctatttttctgttttgagtatagagttggggagaggggttagtctgtcagggttattatgatgacctaggtccagtcatcaagtaagtcacttgaaatttttcataagatgacaaagtccataggacagagaccatatttgtctggtctgttgtatcctccttagcccagtgccagacacctggtaggtgggcaagagaaactcaatgaataaataaatgaaggcaagttcagaggctcaactgaaatggaacattttaactagaaagggaaaaatcaaatggtcttattaatttcatcttgacctgcgttgagctaaggtgaaagtgaaaatgaggaagtcgcaagatagaataaaaattgatatagaaaatcaatattgatagaaaaaccatatcagagatttatggtaagctataaagggtggtagagataagcctacttactgatgtatattaagaggaagtcattttgtatacactaaattggaaacttttttctttatagacacaaggtgtgaacatagaacagttcagaggtaagagttacttgtatttgtaattttttcagggctttggagtaaataatagagtgtaattatgggtaacatttataaaataaaatgatgacagaggctgtattcctttgggtacagaattgaagaacacagtatcatacagtgggaaaaggaaagggcccgattcgttgtctgatggacctgcttgcaaaaggccagctctgttgcattcccaatttttggtaagtatctcaccattttcctctgactatcctttggaaattattcctgggataattttagaaggaagtgagtgtgcaagttgcattttccttctttccagacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgtgagtattcttttatctcatgttcttaattaggtaagccacacttgttggactagtgagcatataatttttctagggtataacaaggtataccttagttagtggttggctaacgaagatgactggtgtagatagaaaccgccactcagtgatagctagtatgtcaagaaagggttttccttcaaaaaattttttggctgaacagataatctgttctaaattgataaaaatatctgtatcttcttgattaattgagtttggaagaccagcgtagactatgtctatagaacagaaacagttagatcatgattagggataaactgtgagttggtttgtagattgatgttaatctgtcctgatgtctttgtggccttgggcaagttatttaacctccttaggtctcagttccttgacgtgtaaaatgataatacctcttgtataggggttttatgagtattaaaaataatagatttaagttgatcagtatggtgcttgacattcttctttttcttatttctgatagcctaacccatcctgttccaactggggtgtattatcaatgtagcagaaaagacaaattatgctttgtaatgtttcatttgagtgtaccaatatataaaaagggggctaaaggaagatttttttttttttttcaaaagaacaacttagtgaaatcagaagtgattcacccgctttcctttccatgttccccaggttccttcatattgctgttgcccaagggagaagggcactttcctatgttcttgcaagaaagatgaatgcacttcacatgctggatattaaagagcacaatggacaggtgaggaccttgacagagtctgaaatggcaaagagggggtcatggtgaagtgaatgatgaccagccttatgtgtagatcatcttagagctcaagatcaagagagtttagttaatattaactttgagatgttgactttttgctaccatcaaccttgaagttattaatgttaactttgtagctgtttgaccaaacactgagagtaataaagccacaccctaggcttactttagtttccttgtcttacagtatctgattgcttattcaaaggatttattttctctctgtgggtttttccctcagtcatagtttagtttcatattccttgttatgataacattgtatgtttaaaatatcttttttcctctggatatccacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggtaagaggcagcaaaccaggcttccatcattgcaaggccagagagatagagttggatattagaagtcggatataggttgcctgttgcaatgatctattttgagttaacttattcatttcttggggattctaataggtatatgcgcagcttatgtagctaacagatgtctgtttttaaaatctgcaggcgattcagaagggagcagtgggaagtaatcagtttgtggatcttgaggcaactaactatgatggtaagcaactgaaactttattagattcagagccacttagggggaaccataaggtctaagggtgctaagtatactaagaaggaaggtaattaaagctaaaatattctgtaggtaaaattagacccaaaaagagacaatattcagattgccttactagttcttgtggagcccatttataggttaagttagaggccatcctcagcatttgtcattatagaaggaccaaaagacctgatgggatgcttgaccactgcttgattatacttttcttctaggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggtaaattcacagaaaaggtttaagatggggtaggggagaaactggttatatagcaaaagaccttgcttccaagtacagattcaaacttctttcttttttttctgaaattaatggtgtgagtagcaatgtatgggtggttaagaagcccagaattttttttttttttgagacagagtctcactgtgtcgcccaggctggaatgcagtggtgcgatcttggctcactgcaacctccgactccctggttcaagcgattctcctgcctcagcctgcccagtagctgggactacaggtgcctaccaccacacccagctaattttttgtatttttagtagagacggggtttcaccatgttagccaggatggtctcgatctcctgacctcgtgatctgcccgcctcggcctcccgaagtgctgggattacaggcgtgagccaccgcgcccggccaagaagcccagattttaacagatcatttcatgtgttttcttgatttgctttaaatccatgaattattatccaaaaggtcatttaggtataaaataaatagtctttgaaaggtaaagaaaatgcttgaaattgatattgtcattttggcttccattttcatacactgagaataaaggtagtgctttttgtaaggatttcttcattgttgtaggatgtggaattcatcttctggtttttaagctggaaaatagtttattcttttaaaattttggttttattcactgagtatatgggggaaaaatgcctaagtcataaaccatttggacccttgaggcttactgactagtaaaataggtgagagatatagctaaatataactctacagggaggctaccaaatctggaaatgtaggtgaatacataataaatggtttactgataggttatgacataggatttaaaaatatttatttttctacattttatggccaccctgtataaaaaggtacattgtgacaagaggcatatagacaaattaataggaaatttaagaggaataaaagattccatttagcttgggattaagcaaggcattttggagaagggagcattcaaagtgagtctctgaagctgaatcagacattcaggagactgggtgaaaagtgtattctgaggcatagtatctggatttttttttttttttttcctccctcttgcctttgacaaggatcgcaaaagtggccgcacagccctgcatttggcagctgaagaagcaaatctggaactcattcgcctctttttggagctgcccagttgcctgtcttttgtgaatgcaaaggtacaccagagttggaatggccttctgtacaccctctcaaagtttttgagctcctttcatgaaatttcccccttcctgatgtctgataattcatttctttgtcttcaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacaggtgagaggcacaggagggagaggaagtattttttggcactgcagtctgaaacagaaagggagatgaggctgtgcagggcgaaggccagctgttgctcttctggtggactctatcagtgtctgtgtctcacggtagctgtcatagcattgtggagttactcttcgtttggaaacagcaattaagaaatttgagggattatccatagactcaaaatggttagaggtcaggtagtattctgtgacacacacttagggttagagtaagtcagaatggtttaaggttcggaaagagaagataccaaggttcctgcagataccaaggaaagagaatcttagtcttgtaatgtatgagccttcaaatattgtggatattaaatgagttgttacatgtggagtgctcacaatagtcccgggtacagagtaagagatcagtgaacatcaatagttagaattatttctatctatgaagtgatactgaacaaaaaatggaaaaattacttatgtaatttcaaacctagaaatattttgttttaaacagcatatttaatgctttactcatcaaatatggttatatattatcattgagtattgaatagtttcatgagtaaactttttagataacaagaacttattctttcaagaacttaaaatgtttttgatggaactcttttcctgggaggaatgagggggattgtggctgtgggtaggtcattacatactttactaatcacaaaataaaatacgtggaatgcagtttagctttttctttgattctgagctgtcattatgaccataatgttatagtagcccctatttatagagctctttgtaatttagaaagaatatttctatagtttgtaaaaagttttcatgtatatcatttaatagttagaagaactttacaagtttcaagtttcaactgagaaaattgatattcagagaggttccaaggaccagaaccatcattaacttgtaaaaggcagagtcctaagcccagtatttgcttctacttcactgtttgtggtgtgcagtcatataactatgctctcagggatcattgagatattaagccatttaactcttcattaaatgttcccagattatctcctttttgctttggtattttgtgtgtgttgggcaggtagaggctcttttccctggcttttattgtcatactgtggtcgtgtgtttccttctagcagctatcagttgtatcccctaccccaatcgcctttcatctaaattgttgcttctaatctgctggaggctgagagatagaaaataaaatttgtcagactgggatgtaaaatgaatcactctgaatgagccgggatcttttctgtgatccatgaagttacgtgtagatgctttaatacttggatatcatgacagctgttttgacttgaatggtattaaggatttacttgtgtgtgtatcataaaatgtgggttttctgttcctgttagttgaggctgacttcaagataagtgagatattataatatgccttaattactgtcttatgttaaatgttctcacaaatagcaagagtaaagattaggaaaagaatataggtgttaagtttatggagattttcaacttcagataatttttagtggagatgttttactttcttgaactcaaagattattataagagatctgaaataagtttaaaaggagtttagtatttttaaaagtcacctcaaaatcttgagaaatattgtgtgtatttcttcgtatacttacaagttaataggagtagtgtagatggtataagaaaggaatgaaactcagaaggaaatacaccacattggccataagaaataaacctcacaaattttatttgtttctcttccagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtcttacatgcattttcttttcctagtgccttatttccctagatagaaaaagtactattgatgattttaaatacctttgagttagttaatttatgttaatttgggttttttggagaacatgtttcctgaaagtatacaagatttaacatcaaaatctatttgctaagtttactaggagaagtctgttaggttttgaaattatcatggaagtttaatagatgctgtcgatcattcacatgtttagatgcttaaaaaaaaaaaaaaaagctaagtgggagcagtgaatcataggaataacagtttggagattaccaggatcatccttagagagatgtaaacctgggaaaggttcttccctttgccagcaagccattttgacgtgtgagaacaaacacatcaatatctgtcagtatgttgttacaattattgcacatatattctagttcttacagctgttttgagaatctggtgaaagctatgaatcctttccctggaaaatgcaaatatatgtatacacacaaatgctgtgtgcaatatttggggcttcacaacctttagaagaccatgactcacaagaatccactttagtttcatttctgcacatacttttcttctttcgtataacaaaatcttgggtaatttgctttgcaaatgcaacttgttaaccagaacagcagaaatgatgtactcccactgaacatagccctacagtgagctttacccaagtgagcttctatgttctctcttaatcccaaattctctcatagttgaaccagtatctagcaagtatgtttgtgtgtgcgtgtgtgtgtgtgcaaagatgtaaataatttgaggctaagacatataagacatttcttagccttaagatgtttacgtgagagacatggcatgtactttattaggtaaactatgttaaatagcatttaaaaagagattcagaagggacatttctttctgactggggaggattcaaggtagagcatttgaactgtatcttctgaatagttgatttggatgttcatataaagggaggagaggcagatgaaagaaacaaacagcatgaaccaaagcataggcgtctgtgggaatagcaggtgattttaatatagttagttagactctggaagtggccaataaggttcatcttgtgttccacctctgactggtaatatttttgagtatcaagttgagaaagatcctcaggctcgtaggggcttcaggagaaggttgctggattgaaccttcaggagaggttgctgtgattggtgcgtgatatctgccacaggaatatgggaaatggctcttgattgaatacatcttaaagcctcacagaagccaagactgtgtgctcattgctgcaacttcagtgcctagcacagtgcctggcacatggaaatagttcataaaatattggttgaatgaacgaatatatgccaatcctggttagagtcactggttttgttgggggaggtgatgttttgagccagagttatactattaattactaatgaattattggctatcatggttctgaatttaattctgccacatgatttcacagtgacatggatgatatgttaatgaaaatgggcatgggcatagttggactcattaaggaaaaaaatcaggcagtctgtctttgcaaaggactgttagtgctgtagtttgatattgactaaggaatccctacaagagtcagagaccaaatcttccagctcaatttgttagtcaaatcagtaacatttaatatcctttctatatttttacttaatcaggacaggaaaatttcctcaaatgtctctgacttttaacaaatgtcaacttaaacatacgaccactaacttccattttctgataacctcagttgttctgtattgaatacgacctcagagagaaatcagcttcagtcactggctaagtttgtgatggttcctctgagatcaggcctgggtacaaggtttgagattacttgtaaccatgctactaggttttggctatacctgctggtgccctggattaatccttgagagaaggggagacactgccttattagtcatcagaggccctgcacctagcacagtatctgacacattgtagacattcaataaatagttcctaagttgaatttaatttcaacactttgtaaaaattttttttcttggcatattttattcttcagtgtataaatatttttattatctacatacagtttatgacttaatccagtacttttatgcttcaagcctttggagtctgtgcagacccagaaacattgcatgggtggcacatttctaggaggggtaagattggttgtttttgtttgtgtgtgtgtttgttttttttgagacggagtctcgctctgtcgcccaggctggagtcagtggcaagatcttggcccactgcggcctccacctcccaggttcaagcaattcttgtgcctcagcctcctgagtagctgaaattacaggcacgcaccaccacacctggctaatgtttttgtatttttaatagagatggggtttcaccatgttggccaggctggtctcgaacttctggtctcaactgatctgcccacctcagcctcccaaagtgctgggattacaggcatgagccatcacgcccagctgattgtagattcctctcaaaatgtgtcttgctttttcctttgtactccttgtcctctggcctgttgtccctgctctctccatcacaccattccccttgcctgtcagctcaagagggtttgggggtgagatagtgcagctgctgagtgccctaggttcaaagtttcagtctttggtcgacattagtatcttatgtgaagcttgttaaacatgcaaatacttaggccccaccccaggtttcctgaatcagaatctccaggattttcagggcttctggcagattatatgtggtgattctaatgcagttttagtctaaattaattaggaaatgcagactttggagagtagctgtggttgggcagtagccatatggtggtaacagaatgggtttctggaatgcgtatggggatgaagtggcaactgatgaagatgtgcagtgtgccaggcacgttggatcctatggtatagaaactagctttgaagatacaatcatgagtcaccttatttttttttcctgctttcagaaatcacttttctaaggtgattctggtgtttaagtttctcaagtatattagtttcctaggactgtctaacaaataaccacaaacttcgtggcttaactcggagaaattcattttgtcatagttctggaggccagaattctgaaaccaaggtgttggcagaaccatgtgccctccaaaggctctaggtggaattcatgccttctattccagcttctagtgactccaggtgttccctgccttgtggcaatataactccagtgtctgctccatctccacatggccttctcctccctgtgcctcctctctgtatatctcttacaaggactcttaccactgaatttaggggccacctgagtaatccaggatgacctcatctcaattttatttatttatttatttttgagggggagtgtgcaatggtgccatcttggctcactacaacctccacctcctggattcaagtagcctcccgagtagctgggattacaggcatgcaccaccacacctggctaattttgtatttttaatagggacggggtttcaccatgttggtcaggctggtctcgaactcctggcctcagattatccgcccactttggcctcccaaagtgctgggattacaggtgtaagccacggcacccgacctttttttttttttttttttgagacggagtctaactctgtcaccgaggctggagtacagtggcacgatctcagttcactgcaacctctgcctcccaggttcaagcaatcctcctgcctcagcctcccaagttgctgggattacaagcgtgctccaccatgtccagctaatttttgtatttttagtaaagacgaggtttcatcattttggccatgacggtctcgaactcctgacctcaagtgatctgtctgcctcggcctcccaaagttctgggattataggcatgagccaccacgcccggcctcagtattctaaattgtacaaagactttttttccaaatgaggtcacattcacaggttctgaggattaggatgtggacatatctttgggcagccttaacttaaaacttactacaccaggaaagaggatttataataatttctgttatcattatttctcttaaaaaatgagtaagattaatatttccttttttaaaaaatcattttatcatggtaagaacattctattttcttacgaaattgtaaagtgtacaataatagggacaatgttgtacaatagatctctagaacttatgaatatttctttctgagcaatcctatagcctgtcttcagaatctatggtatcttttacatattattattgatctaatgtatggtaaaatatctctatttcatttattagctataatactaaacattgaccaggcaactcatttaccattgataaactttaagagaaacaaaaatatttattgagctgtaactaaaaaattatgataatgattaaaagagctttaagtatcctaaacttccaacaaagcttttataattgtctcttgtcattttgctccctggtacacatgtgaatgaatctgctgctcttcaccttggatcacactacctagagctgtgtgagaagcaacatgatcccaaatcaaattaaaatcctatgctttacggcatctgatcttggaatgataacagtagaggagttagtcactgaaaactgcaaatgtttaaaagtcaagggtcaaatccagtttcatacaataacaattgattccactttgctaaaactcaattgaaatagactgttttaactctagatattatctttttaagtgataggattctggcttttgctccagaaataaagatttcagcagctctgggaacttggtagttggatccagcatgtgtttacctgttggatcagcatagttcctgtaggcttgacaatcgggacaaatttcagattgtgaaacaacactagattccttagcttaattgatctggggtttaagtttcaaattactatttatttttattaactcaattcatggtatcttaattcacatggcctgctctccctatttgcagccaaacatctctcaggtagtactttaatttcaagtgattgtgtaagactgtagggtacttcctgattggccttcgtggaagccccaggtgtcgactggtctggaggcgaactgctattttcttccagcactctagggttagttttggtgtttgcctcagtgggagtgtgtccagtgagagtctgcttttctgaattggtgccagaggtgttttttttttttacattagatatcatttttcttttgtctttaaaaaaggtatccttttctttttgctcccaagaagtattccttccagaatattttaaaattttcaaaaaattctcctttttaggctctcacagatatggaagaattggtcgtcttcaggatagcaattttgtctggtgtaacttcttacaccaggaaattcaaaatatatcatttgggatatatttgaatatatcccaatatatattttgaaaaatatatcaaaggaaaattcaaaatatatcatttgggaaaacaagtaagcatttggatggtgcctctactcaaaatattcctggaaaatttttttaaagataaatttttagccaggtgtggtggcacatgcctgtagtgtctgctacttggaggctgaggtgggaggactgtttgggcctccagtgttccgggctgcagtgagccatccatgatcctgccaatgtggtgtaataagaagatgtatagacagaagtttaatttacacaggttattaatttctatacacattctaatcatacaggctaatgaggtacgtcatttaaagtgcaggatttatagacagctgacaagtttttcttttatgacattattctatttccctatctatataaatcaatcagttttgtttcttccctcagctaaagttatatcaaatttgttatcaaggtcaaaatgtctattaatcagttaatagggtagctaaaaaaagtctgttaattttttttttttctattttctccgccaccacccacatctaggttttcaaggctttattcttggattaccacaatagacaggaacctgactttttattatggaaacattcaaacacacatacaagtaggcagaatagtatattgaacacatacatctatcatgaaacttcatcaattataaacattttgccatttttgtttcctcttgcccccatattttgttctagaataagttaaagcccactccaagcattatagattgtcagtaagagtcgctaacagataagtaacttgtgtccccagtaaatagctttctaattattcttcctccaatcttcctgcttttcttaccaatctcaaaatttccactacttggcatactgttaaagaaacagagaaagtttttcaaaggctcaatgctgcctgttgaatcagatgcaaactcttgtcctggtttacaaagctatgttgaccttagcttgaccctgcctgtctaatctcatctcatttttccccagtgggctatcaggtgggtctcttcactgtatcagctgatgctctgtttattcctgtctcttgtcatgtcctcacctccccaaattctgtgcatcctagaaagccctgcttgggtgccactttctctattaagctttttccagctcttactgactgctcctttccctgaactcctgggattaaaacacaattcctctaactttcatatctggtattttctgtcatattccagacttaattattgcaatcaggaaagtgagctctgaatctgaattttctcttccttgcttccttttttcctttcttccaacccttctctctcctctctccttccttccttccttctctttctttcctttctttctgctcccctgtccccctccccctccccttcttccctccctctcccctcccctctctttgtcacactctatcatccaggctggagtgcagtgcatgatcatagctcactgcagctttgacctcccggggtcaagtgattctccctcctcagcctcctgagtagctgggactacaggtgcacactaccatgcccggctaatttattcttgttgtaaagatgggggtctcactatattgcccaggccagactcctggcctcaaccaatgctcccttttcagcctcccaaagtgctgagattacaggtgtgtgccactgcagcatttactttttaaatacaactttaaaatgtctgggtgagtggtatttttgaggacacgaagaaggtgagtggtgctggatagaatctagcattggaatcgtaggcagaattctaagatggtcctagggctatctttgcctcagatgttactcctgtgattctgttaggttacattgcaaaagtgattttgcaaaggtaaataaagtaattattaaccagctgaccttaagatagggaaactactcatctaatcacacgggccctttaaaagcggagtgttttctttggctggaggcagaagaggaaatcttagagattccaagcctgagaaggactcaacccgcaattactggctttgaggatggagcaagggggcaatgagccaaggaatacaggtattttgtaaatatccaaacagaaaatggaatctcaggcctacatccacagggaattgacttctgccaacaacctgattaagcttagaagcagattcttgctcagagcctccagataagagcccagccctgctgacaccttgagtttggcgttgtgttacttcatgcagagtcaagccaaccccgcccagactctgacctgctgaactgtgagataacacatgggtggtgttctgagctgctaaatttaggggtaatttgttacacagcaatagaaagttaatacaatatataacacagggtttgagcttatagtgcaattttatgcatttcctgctattttaattaaggctccaaatcagcaagagaggttttccaataaatgggggcactggtcttaggatgtgtggtcattacacaggctagcagtgtctttagtttatgatatctcacttttgtccagcacttccccattccagatgggaaaatttctttttttctttttctttttttttttttttttgagacggcgtctcgccctgtcactcaggctggagtgcagtgacatgatcgcggctcactgcaacctccacatcctgggttcaagcaattcttctgcctcagcctccctagtagccggaaccacacgtgcatgccaccatgcccggctaatttttgtagtttttagtagagatggtgtttcatcaagttggccaggctgatcttgaactcctgacctcgtgatccacctgccttggcctcccaaagtgctgggattacaggcatgagccaccgtgcccggcctggaaaatttcaaggaaaggaaagtgtagcttccctattgccagtgttttcaaaagaatctataaaagggtcctggagcaggagaaggtgattaggacagcatatctgaccagtagtagcatcagcttactgtgttgccagactctagccatttacctctactgtgagaggggggcatattttgtagggcagcggtctccaacctttttggcccagggaccagtttcatggaagacagtttttccatggatgggctgtgggtgggtggatgatttcaggatgaaactgttccacctcagatcatcaggcattagattcacataaggaggacacaacctagattccttgcatgcacagttcacaatagggttcacggttctgtgagaatctaatgccagaggctgatctgacaggaggcagaggtcaggcggtaatgctggctcgcccatcgctggtaccggttcatggcgctggagttggggaaccctgctgtagggaaagaaccccttagctctgcagcagccacgatttcagatggtacaacttgtttaaaataaatagacacactcacttcagagactggtcaagaaatagttgccgagagctcttggaaccaagatgagaacttacattacagtttcttctgcagcctaggatcacagatgacgggcaggggctttattagtttaaccggcatctatttctccagtcgtgcacacagaaatgaatgaatgattagacattcatttggggtgcctttgtgtgattcataaataacttgttccttataaaatttattgctgaatgactcattaaagaattatgatgaagataataaggctcctaatttaaagggttatgcaagtgttcttttaaaaatcaactttgcgaggtgtaattaatgcataaattttaagtgtacagtttaacaaatgtatacacctatgtaaccaccacccagtcaagatacagaacatttttgacatcccagaaatttccttcatgcccctttgcagtcaatctctccttccacacagctattgatctgatttctattatattattgtagattagtttttgcctcttcaaaaacgtcgtataaatagaatcatacagtctgtactattttcttattttctgggtttctttcactcagcatgatttttttttttttttttttttttgagacggagtctcgctctgtcgcccaggctggagttcagtggcgcgatctcggctcacagcaagctccgcgtcccgggttcacgccatttttctgcctcagcctcccgagtagctgggactgcaggcgccggccaccatgcctgcctaatttttttttttttttgtatttttagtagagacgggtttcaccctgttagctaggatggtctctatctcctgacctcgtgatccacctgccttggcctcccaaagtgctgggattacaggcatgagctaccgcgcccggcctctgcatgatatttttgagattaatccacattggtgcattgatcactaaagtatatttctattgctgagtagaattccattgcactaataacacaatttgttaaccattcacatattagtgggcatttcgattgtttccagtttgggactattattgaataaagttgatatgaacagtatttgtgtggacatatgttctcatttaattttaaattcttaggagtgaagtacctggttcatataag

SEQ ID NO: 767 - DNA, 4135 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtcttacatgcattttcttttcctagtgccttatttccctagatagaaaaagtactattgatgattttaaatacctttgagttagttaatttatgttaatttgggttttttggagaacatgtttcctgaaagtatacaagatttaacatcaaaatctatttgctaagtttactaggagaagtctgttaggttttgaaattatcatggaagtttaatagatgctgtcgatcattcacatgtttagatgcttaaaaaaaaaaaaaaaagctaagt

SEQ ID NO: 768 - protein, 718 aa, Homo sapiens
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 769 - DNA, 50781 bp, Mus musculus
  misc_feature (1)...(50781): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgttatgtctggggtggtcccttgggcatgggcccctggtaagtagctctgcgtgtagaaatgtgtgtagtgattgtgcaggagttcttccttttcgcatctctccggaagcatcgatgtgctgatgatgctttcaaatatacagtccagatgcggtggcatttgtaagatctcaagtacttagccgatctagatgagaaggggtggggaaggtattaaaacctcataggtcaagaaaaagcaggaggtatctcaaacattaacagagccttggagctgtttgtgttaaatcttcctgggccttctaggttgactagggaatccattcaacaaagacgctctccagtctggggtggaggcagcagcttaggttctacaccacacacagctccttctggaccagggtagagagggggattcaggctggggatggaaaacttgtaggcccattaaatggttggtttttgttttctgttttttttgtttcttgatttttggttttttggtttttttcaagacagggtttctctgtgtagcctgagtctgtctggctagagcttcttagctttgtaaggaatcacttctagctccacaggctgtgttagttcatgctctgctgttatgataaatacccgagggggtgggggttacatggttttttgtttttgtttttcgagacagggtttctctgtatagccctggctgtcctggaactcactctgtatgccaggctggcctcgaactcagaaatccacctgcctctgcctcctgagtgcagggattaaaggcgtatgccaccacgcccggctcattacatggttttaactgaagactttgggggaggggcgactgagcagctgggttaagtttgctgagccgcattttcactgatggactcttctgagttggccttttgggatctgatcttcacccctgtccataacagccccagtgtgcgacacaagctcctggtggaggatgcgcccgctgattcagcccggcttcccctcttctgggaaaccagattatgtggagccatcagacagcacctgctcctgaaaggaagtggaacacactttattggcacagccaagatgaagaatggcttgaaatctgttttacaaataaacttgcacataaattgtccatttctcggcttggaaacctgcttttttttctttcttcttcttcttcctttttttttttttttcccacgtttgaggannnnnnnnnnnnnnnnnnnnctatctacaaaaagaaagaaagaaacaagatttacttacaaataagaacagaacactaactctcaatggactaggagaataaatacatctgtgtgcaccgtttatatgtaaaacattttggctcagaaaagacagggtacatatttgcatgctcaggccaatgcagtgttatgtctggggtggtcccttgggcatgggcccctggaaagtagctctgcgtgtagcaatgtgtgtagtgattgtgcaggagttcttccttttcgcatctctccggagcatcgatgtgctgatgatgctttcaaatatacagtccagatgcggtggcatttgtaagatctcaagtacttagccgatctggatgagaaggggtggggaaggtattaaaacctcataggtcaaggaaaagcaggaggtatctcaaacattaacagagccttggagctgtttgtgttaaatcttcctgggccttccaggttgactagggaatccattcaacaaagacgctctccagtctggggtggaggcagcagcttaggttctacaccacacacagctccttctggaccagggtagagagggggattcaggctggggatggaaaacttgtaggcccattaaatggttggtttttgttttctggtttttttttttgtttgtttgtttcttgatttttggtttttgttgtttttcaagacagggtttctctgtgtagccctggctgtcctggaactcactctgtatgccaggctggcctcgaactcagaaatccacctgcctctgcctcctgagtgcagggattaaaggcgtatgccaccacgcccggctcattacatggttttaactgaagactttgggggaggggcgactgagcagctgggttaagtttgctgagccgcattttcactgatggactcttctgagttggccttttgggatctgatcttcacccctgtccataacagccccagtgtgcgacacaagctcctggtggaggatgcgcccgctgattcagcccggcttcccctcttctgggaaaccagattatgtggagccatcagacagcacctgctcctgaaaggaagtggaacacactttattggcacagccaagatgaagaatggcttgaaatctgttttacaaataaacttgcacataaattgtccattctcggcttggaaacctgcttttttttctttcttcttcttcttcttcttttttttttttttccacgtttgaggagctgtcagaggtccctaataaacactgagtcttatttagtttactggatatgtaattcttcttttctttggaaataattatttttcaagcaagtgcagcagaaatataaccaataaacatctagctatgacagcataaacaacctttatagcaaacccatacatcgagcgctccaataaaagtacctatgctaagaagggagctacaaaattggctgtcttgtccccagacagagctccttctcctgaggatccagagactgcttttagctactttctacttctgtgctacagaaatgtctatggggtggctggcaggcaggcagtccggctgccaaaatggccgtgggctaaggagaaggagtctgggctccgggtcgggtcaatgtacagtgtatctacatggtttggtaaaacctgtctccctaggtccattgtggagtaaaattccccataggactctggaggggccatgtgaggccctcagcctttggccaccctcgttagttcaggctagatgttacatatgggatggacagctatacctgtgcatggaacaagaatagcctctctaggagactcctaccttgggattctgcccatggctgggtcaacctgatcctaacctttccaggactctggaagggggaagatttgttcaggtctttcccacctaagagctcaggctgcctctcagtgtgcccaaattggtgggcagtatgggggttggggcctgggggttggtggtgagacaaaaccttgctgggccaagtgggctccatgcttctcctggggagctgtgtgttgcacaagtccccagtagacttgcagggctcattggggctcatttatgcttttatggtagctcacaagatgttatcgcagcttgagaactgaaattaaaatatgtatccttcaggtgcaaatcctgtactaacagctttaccgctgctcagcggggggctccattaatctcgcaccagtgaaattcctaaggaaattaattccctccagttggggttattctcaactggtctttgggggcggagtaattggaatttaagagtctctcttaaaagaagggaaaccttggccattttacttgagtggcagcccttttcagtgccacactttcccctcccccgactcccccatatccctttatgattctcgattctctaggtagggtttacagatttctatccacggaagggagctggactttgagacttcatttcagccgaccaggtatggtccttggcagaatggtttgtttgtggcctcacagtcatgtgcgtgctgagtaagatctggccataggaatgcatgacaaatcattaaaagctggtggttaaaatactgtactaacaagagtaactaaaaagagcctggctgtttaggagcagtaactaccagctgtcactgtccagcccagccaaccccccccccacccccgccccaacacagttgaaggctgagtgacagctcagtgggtaaggtgctcagaggttgccttgtaagcttgagggcataaattctagatgcctagaacccacttgaaaaaaaaagatggctgtggtggccggtttgtaatcccggtggtggggatagagatggggagacatacatctagatccttggggctcactctcaagtcagcctagcacacttggagatttccaggtcagtgaggctttgtgtcagaaacacacacacacacacacacacacacacacacacacacacacacacacgcgcgcgcgcatgcatatgtaccacagttgattgcaaacacaagatggagttctctggctgcctcctcactcctgggcaaggactctagctctctagccggaatcccaggtcctgcttgtttctatgctccagaaatacctcacagtgccacagtgctcctgggggcagcttcattgtctcaatctgcaggttagaagcagctgctttgctgggagggctgtttctagccaggcaaatcccacagcacaggatagcatcttaccagagggggttggaggttcaggtgtcacattctctcaggtaggaatcccagctcctaaaaaggcatcaggcaaaagtgagtgttgtacccagaataactctccagggacataggcccagatcagctccaatctcttgctttcctatgttgatttttccacctgcacagagaaaagccgagtgtcctttacaaaagtaacctctagttggggttactgttgctgtgataaaacaccatgaccaaagcaaagttggagaagaaagggtttgtttaactcagttctatatcactgttcatccctgaaggaagtcaggacaggaactcaaacaagacaggatcctggaggcaggatctgatgcagagaccatggaggggtgctgcttattggcttgttcaacatggcttgctcaatgtgctttctttttgtttgtttgtttttcgagacacagtttctctgtatagccctggctgtcctggagctcactttgtagaccaggctggcctcgaactcagaaatcctcctgcctctgcctccagagtgctggaattaaaggcatgtgccaccacgcccagcttcaatgtgctttcttatagaacccaggaccaccagcatagggatggtaccacccacaatgggctgaactctcccccattaatcactaagaaaatgctctacaggctcgctcagagcctgattttatgggaacttttttttttttaatttttcgagacagggtttctctgtatagccccggctgtcctggaactcactctgtagaccaggctggccttgaactcagaaatttgcctgcctctgcctctcaagtgctaggattaaaggtgtgtgccaccaccactgcctggccacattagctttctttcctttctctcttttttttttttaagatttatttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtctgaagacagctacagtgtacttacacataccaataaataaatcttaaaaaaaaaaagaactctacaacacatctcctctctgaattacaattttactaacttcatgtgacagaggcagtctgaattctttgaaggcaggaagaagcagatacagagcagtggttctcaaccttccttatgctgcgaccctttaatacagttcttcatgctgtagtgactccctaaccataaaagtattccactgccacatcataactgtgaatttgctacagttgtgagttataacataagtatctgatatggaggatatctgatatgtgagcccaaacaagtcaaaccccacaggtggggaactaatgggttaaagaatgaagggcctcccattagcaccccagctctcattcttgcctagcaagctctcacactttggggagctttgggcagacctttctctatgtcacattcagctatatagtttatatacttaaatatagcaatcagagtgggtgtcttagttagggttttactgctgtgaacagacaccatgaccaaggcaagtcttataaaaacaacatttaattgggcctggcttacaggttcagaggttcagtccattatcgttaaggtgggagcatgacagtatccaggcaggcatgacacaagcagagctgagagttctatgtcttcatccaaaggctgctagtggaagactgacttccagtcaactagtgggagggtcttaaacccacacccacagtgacacacctactccaactaggtcacacctattccaacaaggccacacctccaaatggtgccacgccctggtgcaagaatatacaaaccatcccagtgggtatccagtctttattttatttcttattcttttatgaaggcaagggttcatactgaagcccaggccctctttttttgtgcattttacctccaaagagttctctacagtctttgttttcagtcaacctactctttattcaaagatgtagattcatatatacttaatatgaaaaagaaaaatgctgggtctggaagcacatgcctgtaagcccaggacttggatggtggaggcagggggatcaggagagcacgacaaacttcagctacacagcaaattggaggtcagcttgtgccacttaagaatgtatttcaataaaaacaataatacatttattaccaactaggtacacatagtaggtaagtttattatcaactaggtggtacatacatataagtccaacattttggaggtagaagcaagcaggtcgtgagttcaaggccagtcttggcttcataatcaactctaggccgtcacggcctacatgaaaacttgtttcaaaatataaaggatgtgtgtgtcgagacagagataatgtgtgtactgtctcccaatgataaaaccttgtgtcttagttagggttttactgctgtgaacagacaccatgaccaagtcaattctttttttttttaaagatttatttatttatttattatatgtaagtacactgtagctgtcttcagacacaccagaagagggcatcagatctcattaaggatggttgtgagccaccatgtggttgctaggatttgaactcaggacctttggaagagcggtcagtgctcttaaccgccgagccatctctccagccccgaccaagtcaattcttataaaggacaacatttaattggggctggcttacaggttcagaggttcagtccattatcaccaaggtgggagcatagcagcatccaggcagatgtggggctggaggagctgagagttccaccacttgttccaaaggcagccaggaggagactggcttccagggagctaggatgagggccttaaagcacacacccacagtgacacacctactccaatagggccacaccttctaatagtgccactccctgggctgagcatatacaacccatcgcaccttgcaaacctgtaatacaatactataatcaggatgttaatgtccgcgtgtgaccctgatgtctttctgaggtttctatggctttattggtattggcgtatgtttattttcttacagtcctaagtttggggttctgccccccccccccccagccaagaagcagaacaatttgtcctgttgcatttggagcactgtgatccacatttttagtaggggtgtttctcaagatgtgtgtgacacagcttccagggcttttgtaatcataggagcagggctgccaataggatacaggagtggccaccgcaagcaactctcctgtgttctttaaaatggctcagtgagcagaggtaaaaggacatatttaattcccaatcgatcgaaaatatttcaatctgtaatctgttactgttactcaggctggcctggaactcactgtagagcccaggctggactcaaacttaaggaacttcctgccttagcatgggaaagagtgtggagaagataccactggcgagtcactgcccgtacagggaagcttctagtaagagggtcatggaggctgggcctgggtgggaaggtgcaggaactctaaaaaggagcctaacggttcttagaggcaatggggcgagccatttaggtcttgtgtcaaggctgcaacggctaacaggtgtcacagagttgtactgaaggttgattatggggttctgagggcacctctagaagagttcgagtttcctccaggactgaggtacaaggactatcagggttgtgctcagacactattgttgttttagtcttaagacttcctagttcacctttatgcagcttcatgtgagatttcagcttgccaatgttctattctgacttcactctaatttacaatacacacatacttacatcccttcctattacaggtttctgagctccagagctacaacagccaggggccaaggcatctagctagttagcacaccaatacaaagcaaggaggctccgctagcccaacctagagcctcccagttctcccagtccgagggcgtgaccttcagtgccggagggcgtggcatagtgtgtcaggggtgggcccccgatctcagcgggcgtggcttccccgtgcgcagcctcctcgcgtgtccgtccggccctatcgagcctccggcgctcgactgctggtgtctggcggagacagcatggcggcgggggcggccgaggcaggcgaggcagccgtggcagtggtggaagtcggctctgcccagcagtttgaagagctactgcgcctcaaaaccaagtacgcgggggcggcgagagggcccggggaccagagggcggcgggccggggggtcacgggacttgggggcggcttcccaacgcggcacgtccggagctgagctcgtggtccaacggcggccctacttgggccgcggcggtagcccctcctagggaagcggcccgcggcggcccgcgtgcacaatggacctgccctccggagacccgcatgtggcgcctcctgaaggaagccttggctggcgaccagcctgcaggcccagctagggtcccgggctttcctgaaccaccagccggctaagggagggtctgcggcggccgggtgcgcgcgcctcgcctttggccaagccttcctgaggccagccctggggatgcgtgggaaaccaggacctcggcgctctaggatgctgccctgccttgatctgcatgcagagtggcgagggaggggtttcagggtccactgccggggatccccaacctctccttagccccttatgtgcttgtaatcctggggcaagtttcctaacctccccttcggcttcctcccgggtgaatggaccggttgtgttaaagctctgttgtgtggttggcgtaccggaagctctctccactaatgtgggggccttggtatcctcactgagcagagtgggcaggtggcagattgactggctgacatctgctactccatacagtatggaggagaattacaatagctcattcagaggctggcagtgtagctagtgcttaatacacaagaaaccctgagttcaacttctagcaccgaaaacaacaactcatcttcatcaacaacaaaaccagtcctttccagccctttcgcatttcaggtttacttgattttaaatttttttccccccaaagaaaagaaaaagggagaatgagagtaacattatgtagaagctgacttctgatggatccagccaggtcgtttaccaggcgtttcggaggacgtcagagatggcctcctgaagtgatgagggcttgtgtggacatgtcctgaaaagcttgaacttaaatcgtctgagaagattcttttatgtgtgtgtgtttcacatgcttagtttgtctttatgtttcatgtgttaaacaggccttagtgggtaaaagttagcatgccatttattctgcaagttcaaggtcagtttgatcttcatagtgagtttcaggctagccagaggtatataaggagaccctattgtaaaaaatcaggaaacaaacatttctttcctctcaaggggggtggggggcaagacaagaacagcaacaaaccgcaaacccatctgcatgtattcttgtcactggtgtctgcctgagatgactcgggagacagtgttcccgtctgcagtgactgttcagaatgggtcatgggaaatgctgtgtgacacctggggagtgacacctggggaaggataggaagccatcaagaatactaaatacgggctggcgagatggctcagtgggtaagagcacccgactgctcttccaaaggtccgaagttcaaatcccagcaaccacatggtggctcacaaccacccataatgagacctgatgccctcttctggagtgtctgaagacagctacagtgtacagtgtatttataataaataaataaatctttaaaaaaaaaaaaagaatactaaatagcacttgtgggtgcagccatttccatgtcaaggcttttcagggttggtgtgggttgaagtctacttttttgttttattattattttttcatcattttatgtgtattgctgtatcgcctgcaagcagctgtccaccacaagcatgcagtgccctcagaggctagaagagggcgttggctcccctgggattgcagttacagattgttgtggcccctgtgtaggtgctaggaatggaactccctagtcttctgtaagagcacttagtgtgctcttaatcattgagccatctgtccagccccaaaattttctttttatattaaaattctaacgtatttacgtacttgtaactttttctatatatatttttatatatgaaagttcttatgtctatgtaagttttatgtttatgtaagttactgaaatctcagtttctgtctatatagtgggggtgggaaatgggtaccagagtttgtgcccattcataaaccactttattcataaacacacacatacacccacacacacacacacacacacacacacacacacagagtctagagtatggtagcgcttagcattggtagtataatttgcaagtgaataactggagtatggagcactacagtagaacagcaaatgattattggctctaatggttccattgatggagaaatgagactcattatgtctgctaaaatattgagatattctggggtgtagtgtagctcagtggtggggtgtgtgttcaaagctctaggtttgagcaccagtgcagggtgtaagggagccatgttaatgagtatttcaactccatctttctgtaaacgttgtcctagaacaatgcattggacatattggcctgtctgttatgaggcagagactggttccatacagtacacaagagggtgacatccctgttatatgtgcagttggcattccatgcttaagtggaaaataagagctaggcatgtaaacataagaatatcttgggcagtaaataatcattcgcattaaacacatgcagtggtgttatcaaagcactttcttgtctgatcttctaccaacccaggactctttatagttgtgggtgttcaaagcattcaaagccatgttagtgccattggagcaaaactcagctctgtgtgcatactttcttcttcctcctgcccttctttttgaagccaggactcataatggaggctggcctggaaccctagatgtagctgaggaagcccttgagctcctgatcctctgcctgtacttgtgagtgctgtggttagaggcaggcatcagcacacctcgctctcctcttttgtttttcacacttgggctcatactgggaacaaagcctggtctcttgttttaatttaattattattattatttttaactctgctggaattaagcccagggcctgaggcataccagactctgccatgagttatatctctatccaccgactgtaatttttaaaagcaagccaatattgtcagcatttacttatgccattaaaacttctttgcaagccaggcgtggtggcgcatgcctttaatcccagcactcgggaggcagaggcaggcggatttctgagttcgaggccagcctggtctacaaagtgagtgccaggacagccagggctacacagagaaaccctgtctcgaaaaaccaaaaaaaaaaaaaccaaaaaacttctttgcaaatttctaaggtactttaaatatttagaattacttttaatattttaaaagtactttgttttggttgtttgaaagctgttgtgacatgagttgttttgggatttttttgggtgttttctgtagtattaggaagatacccatcttcctaaatctttgtattttaattcttagagtaaatacctgtgggtgtggacgtcgtgggaggtcttgtttctaatctctaccgcagggtaagaaggcgcttcttccacttccttttagaaatcctgacttttgaaaagagtacccgcctcgtgtgcagcagcagagcctagtgggtttacttgtcttggaagcaggctcttgaactcctggagcccctcagaccgctcatctgtcagcggggcttgccttgttcttggatatgtatacattgcagtttctgtcctcccttccttccttaggctcctttgctcctgcagtgaatagtagtgattttcaccttggcaggagctatagtcaccaaaagaccttttgctgtttgagtcatgaatgcagtgatgccagtttcagtctttggaatcttaatttttcaagcagtttattacaggccattctgttcaatttctgtcacgttctctaaacaactgtattaagttgtatttgttcataggctgtcatgctcacggagtacaggtgtgtgggtttgttcagtgattcaatgctagacatgttctcaagctaaaaacacctttttaaaaattgagtatcttgatttaatcatgtcagaatgaaaactgtactgcatgagggcagccaagtcttccctcttgtgctgctgctagctaccctcaacactataaactgtcttggctatcatggtattccccctttccctatgagattcctttaatctagcaactttggcttggcttgttttccagacctgactgtgtggttgtgtgtatctctagaaaagctgcttgggggtgggtataggggactttcgggatagcatttgaaatgtaaatgaagaaaatatctaataaaaaattgaaaaaaaatagaaaagctggttttgttgttgtttgttatttttgagacagggttactctgtgtagccttggctgtcctgcttctgcctcccaagtctgccaccactgaccagcaccctctcccctcaatagttgacttgtgtttcatttttggagtgtagggtgctttgttctatctgtgggcatttgggtaaattatagactgcttgggtgttccctgacaaggtcttgttaatttgcttttcttcttgggaagaggtccttggatgctctcttggatgctctgctggccttgggacctctcttggatgctctgctggcctggggggtgtggtcagatcctgcacaggcttatgagggagggtttcagtattctgtaggctgtaactctgttcacggttcccagacaactttaaggagcctgagaaatgttgtctagctgaatgggtgactgagaggcagcattgcttggcagagcagttgctatcagctgaggcccaagtattcttcaaagatctgccagatacaggtctgtctggtacagattgtaagtacgatgtgacctttcttgccgtaggtggatcctcctgtttgccttttgtagtctctcaaatggctttctcttatcgtttctaactagttagtctctgcctttcatagctgtctgcctcccttccatgaccccagccctaccatttttgaggtggtcctactgactcaggatggtcttgaactgactggacccagtctggcttagaactgctcgttcttccacccagctggggttccacgcatgtagctccacactgggcctccatttctgtttcagtgtgtcatctagctttatacttgagcaaacccaggctctcagggaccttctttctcagccctccccacccctactttgtacatgtcatttaatctgctcttaattctttggctctggactggaaggcactgttctctttgctctggctgcctttcccctttcctaacttcttggaaaccttgcacctacagctgcctcagattttcaaccctgtctgcactggcattgttcctgcacgatacaagcatctggggattgatttcttgcaccggagttaagctgaacgcggtgctcttggattcttctgtgtagtccagatctcttgaggttgatttctgtggtggccacttctagtcagctccctgtgcagctgtgggctcctcctgctgctgctgctcctcatttatttatttatttatttatttatttatttatttatttatttatttatttatttatttattatatgtaagtgcactgtagctgtcttcagacaccccagaagagggcattggatctcattatggatggttgtgagccaccgtgtggttgctgggagctcaggaccttcggaagagcagtcgggctcgtaaccgctgagccacctctgcagccccaggcttctgcttctttggcagttggccttgttcactgtttgttgccactttagtggtgtaacctctcccttgccattatcttgacttctgggaaactgatcttaaactcctgaagctgtccctctttcctctgtccctctatctggcctgatgcgatgttgatgagacccagaaacatggacctccaggttcctctgtcccttctgtgacatggttggctctgtgtctctagatttccagatctatagagagctgaggctctctgcacttgagccctggccctaatattccggcagccttcctttcctcctagtatgacactcactgtcagtgtttaagccagaacttgcagtcaacctttgagggttaccctttcctgccccttctggctgtagccttcctcaccccatatgtgtctcttgtgggtaggctcccacttctcatctgtgcttttttttcttttgttttgtttttttatttatatgtgtttttgtgtgtgcccatgtatatgtgtgcaggtgcatgtgggtgcctgaggaggccagaaccttggagctggtgttgagatgtttgtgaactgtgtgacctgcacgagtgatggggctgaccgtgggtccttgtgataggtagagcagcaagtgctgccctgctgagatctccccagccctctatcatttcttattccactccttgctggtaggtagaaaagtttgcatctttttccatagaacacatttttatgtgtttcccccccaccttggaggagggttttacgtgaaattagaattctgtaaattcaagtttcagttaaattagaggtggtttcaaacataggtctttgtgaacagttttgtatgaaaataattaagattgttaacattgcccaggaatctagtgactccaccgtcagcccacatggagggttctctggtaacataactgcaacagacatctatgagcagtgatcgtagtcctgctgtcctctgccttatctgttaagacttttttgctcttctgccgttacagttgtgtccctttgtcacaatattatgtgagattaatattaataatgtatcttcaatcatttctcagcagcagcttgcttgtacagaaattcagtctccactttcatcatgggtctgaaaatataatcgacatgtctgttagttgatatggatggacatttagaagcacttactagggcttagtcttgatttaagaaatcccatcgacttgactgtttatccagacagtctgaagactggccgtgatgctgcacactgcagtggaattctttgttttctaggtagaagaatttgatctacacctgtatttgcttccaggatcattttaataaaaaatatgttttttgatttacaggtcactccttgtggttcatttctgggcaccatgggctccacagtgtgtacagatgaacgatgtcatggcagagttagctaaagaacaccctcatgtttcatttgtgaaggtattattcattttcagtcttatgtcttttattaatatctgacttatgagatagacaagattttattttattttattttatttttttttaaagatttatttatttattatatgtaagtacactgtagctgtcttcagacattccagaagagggagtcagatctcattacagatggttgtgagccaccatgtggttgctgggatttgaactctggaccttcggaagagcagtcgggtgctcttacccactgagccatctcaccagccctagacaagattttataatgtaaaggaagaagctgtgaaatcccagtacttgaactttgtgttgaattctgttatatttgcagcaagctattttgacagatcttttggtttgatttttgtttgtttgtttgtttttccgagtcagggtttctctgtatagccgtggctgtcctggaactcactttgtagaccaggctggcctcgaactcagaaatccacctgcctctgcctcccgagtgctgggattaaaggcgtgcacaggcttttgacagatcttttgatgttgcatttctcacatagtttaaaaaaaaaaatcgctacagaatgggcaaaggacagaagtgtttgagaggacaaacagaccagataattccctggataattttggcgtgatagcagttgatgaacattgagaaggtagtatgttgcgaaacgcttctagaaagtgcatgtaaacaggccgctggggtcagttctgcccgcctctcctgtgcactgagccctgctttactcaagacttggtttctacgttgcctgttgtgtttccagactaggctttaagagggattggagcgctgtgctggaggttagcaggatttgcttttatgcacatgtaattctagtcactcgggaagtcttactgctttaggtttggaaaaaagtgaaatatatgttgagaataatgaattattgggaagggagggatactctctgtattcaaaagtgttaattcttagagttgatttatttactttgagacagggtctcactgcacaggttggcctcaagatgtctgtcagttgcctcccaagtgctggagtcagtggcttgtgccttttatccagtgctgaatccttaggatttaaaacaaaacaagccgggcgtggtggcacacgcctttaatcccagcactcgagcactcgggaggcagaggcaggcgtatttctgagttcgaggccagcctggtctacatagtgagttccaggacagccagggctacacagagaaaccctgcctcaaaaaaccaaaaaaaaaaaaaaaaaaaaccaaaaaacaaaaaacaaaacaaaacaaaaacaaaaacccaaaaaccttcattttaaaactaaaaattgtgagttcaaaatacatgttgacagatagacccatgtatgaggttagaaaccatgtgaagctttgggttgcctgtaggtcagatttctgacgtttcctaaatcctttgcatggtagtgattacattccctgatagtatttgcatagacagaatttgtgtgctttgaattggtactgtattctgatggctcaaaatgccaagtagtatcgcagggtggacaccgagaagattcacgccgtgtctttgccaacccttgtccgtccctataagtaaccagttgtattcattttgtatgaattttctcagtgtttctttatgcagatagcacaaatatgaatataatagttagctttttaaaatttaaggacttacttaaaattctgatgaaatgcataatgtaaccctagaaggtaaccctaaaatgtccagtataaataatagaagggggcattaaaactgcatgtttggtcagtgataaaagataatgactacaagtgaaatgaatgattaaacacttcaatcatagaattagccaggctcatggtaattgtcccatgtctgctttcatacgtatcctgttactggtttaggtaacacgctgttctcagctgccatctgaatgacttatttaaagtcactatagaattgcttctcacattggtaccagacttggcaggagatttgaagttgttcaagtgcttaaatgtagcagggagccaagagttgtaggtgtgctactgctggattgtcggggatacctgagcctgactgtttgaggagttggcagcactgtttttgttaagcaggagttctggaaatttctggagtaacgcagtgatggggtagaatttttatatcttttctttttgagttaggagtctcactagtcttgaactcttgaattcaagccagacttcggcttcagcctcttgtagctggcacctcaagaatggtctactatacctacgtttctttcatttgattatttaaaaaaggtgtattagtttggctttttttttttttttggtctttcaatagagggtttctctgtgtatccttggctgtcctataactcactgtgcagaccaggctggcctcgaactcatagagatctacctgcctctgccccctcaaggtgctaggactgggcatgtgccaccactgaccggctagtttggctttttacttatttatttatttttgtttttttgtttttcgagacagggtttctctgtatagccctggttgtcctggaactcacgctgtagaccagactgtcctagaactcagaaatcctcctgcctctgcctcccgagtgctggaattaaaggtgtgcaccaccactccagcttagtttggcatttttgacttgtgaaatgaagtgattgttccagtctttgttagtagagacacaaagtcatttaaataagtgattttcttttaaatgcatatttttggtttgcatgtaaattattattactactacttcttcattttcttcctcttcctcctcctcctcttatcttgaaacagaaccttatatatcctcggctggcttggaacttactatgtagccatggatgactttgagattttgatcctcctgcctttgtctcactagtgatgggactgtagtgtgtcccatcatgccccagttatatggtgttgagaatcaaatcagggcttcctgcaggctaggccagtactgtaccagctcagctatacccctagcctagaagatgatcttgagtaaggttttttaaattggttataactaccaagaactagttttctaattactaagataccagcagctcagacaagccagccacacatctggtaagagttgtgcagcttgttcctaccaggaccgaacgctgacaggcaaggcttttgcactctccactgagacccttgttctccaacgtgtgacgtggctgtaagatgccacctctaatgggctgggcccttccctgcctcagctgctgccatatccagttagatcctggaatgcgggtttttctgtacgctcttgcatctctaaccactgtgaggaagcacacgaattacttccactggtaaatgccttacaaagagattcaggcttacttagaatagagtgaaatagctaattaaaatattacgtgctttttcttttcaaaatacatagtcagatctcttcctaaaatggaagtacactttattgatctgtggatgttgatgtgtctgggtaggtggaaggatgaatttatgatttttctgcctcagcctcctggatactaaatagacttgtgtaccatgctgatgggaatacatatttgccaattatacagtagaatctttcagattatgatgtttgggagtgagagatagtaggaaagagatagaaattccacgcctttgtcagtgagggaaaggtgggaaaaaagtcagaccctgtttgtaggaaatgtatcctcccctcctgcatatctcatttgctgtgtgtcatagttgcagtcctaatgctgtgatgatatactctggcagaaacaacttaagggagaaaggtttatttagctcataatcccaggtccatcatagcagggaagtcagctgtagcaactggaggcagcggctcagattacagtcatattcctaagagaacaacacatgctattgctcggctcacttctcctcttacacagcccgggatcccttgccaagggatcggcaccccatcccccgttgggatagtctcttcacagtcatgcctagaagccagtctctcagggttaacactgcccatcattgacagtttcatgtcagtataaactttctcagagatcagagtcagctgtttagggagagttttatgatgttgctctggtcagtattattatattgtatggtgcattggtttctcaccctgtgggtcgaaacgggttctttgggagttgaaggaccctttcacagggtgtcacttaagaccatcagtaaacacagataattacattatgattcataatagtagcaaaattatagttacgaagtagcaatgaaaataattttatgtgagcataacatgaggaagtgtattcaagggcgcagggttaggaggttgagaaccgctggtatggtggttgctgtgctgagagagggcatggaggagttacaaagttacagtgctgtgctttgcacccctgcaccatccttgtgctgttggggactgtactcaggacttcacagttacgttaggcaagtgcttacattgcattaggttacattgagctctactgtaggaatcatcatggctcagcagttaagagtactggatacccttgctagggacctggtttcagttcccagcacctacacagtgactcataactgtctgtaactgcagttccaggccatcctgtaggcaccaggcatggtacctacacgtatacttatacatatgcgtatacatatgcgtatacgcaggtaatcactcatacacatatgatcaaagtacataaatcttaaaaaaaaacaggttttttgtaatatctgagaaagccaagcgtcataaagatagtttatgctactttgcagatgtctgcacaattgctctgtataaaacaactgagacggtagtgctggccaataccaggagtaaataagtgaatcagtgcaccaacccccaggcgttatctagcttagagtaactctcagctgtgtgccatttctagcatgtccctgacctgtaaaatgaagtctgagagtgaggaccctgctgggcttgttggcgcgcacctctaatcccagcatcaggtagacggatctggagttctgccttcagaggttctgagtttgagtctatttgttctaaggcagccaagactacatagggaacccctatctcatacctccccaaatgagtgagaccccctccgcccaccctccatgttctcctgttaccccttctcacaggcacaccatgagaaggctctgaagggctcagttccccgcagagacaatgtgaagatgcagtgtgggtaaaccagcccagtccctaaagtgcagtctttcttctgactgtagcagtagaaagctgcatgtggcataatgacagcagcacagattttattttcaggcttcatttctgagcagcgtcatttctctgaatttgactatgtcacccatgtcaccttttacgtgagccaggcttgtccagggaaacagccagtgggacatggagatgcgataagtaagatttgttttaggaaggaatctgctcacgcattgaagagctttagaagtctcttgaagctggagaagcagggctgctgctgtgtggtctgccggagacctgtgacccaaggagctgatggtgcagagcttgagctccagagcaggagcacaaagacgcagtaattggggctcttactccaggggaggagacagctgtgccagcctgagaagagagcgggaactcacttttcctttgtcgtttttgttctgctgaggccttatgctgttgggtggtgctcttggggtttgaggacaggtgagtccttccttgcttggtctgcctcttgctgggtggcactcttagagctatgtccacaatgatttacaggttggttatcaagttcattcatctcgtagaagggttctggtatggagctggtgttcatgaaaggtagctttgagctcttgtacatacatgaaggtcatttaaaagtatttcctgttttcattactaagaccattatactctattagagtcatatattcaaagaatttgagtgctgcaaagattcctttctgtgatgctaggggtcgtagggccacaggcatgctagagaaatcctgggagcctctaccccagctctacaaaggttttaagacatcagatggtgatgttttggagaactttatggctgtagtgggaatcccatcacctcttctgtgtgtttgtgtgtccccgttacctctatgaggaagagctagtcttctggaagcttatctgagggggggcacttttagtcgatccttaggcaagaatggcagcagaaatggagtgaacatatgtaggcctatgttaagagttagggtgttgtctgttgtggtggaggaacatgtttctaggtgttgctcagatgtattgcaagtagggtctctttctgagcagcgctcagctagtcagagttgaagaagagagtgaactgctgggtgacatcataaccaccattggtcttactatggaactgtgcctacggaaaaaaatagcacatacatttctaaagctgtccattcaaaatgtttgtgtcggactggtctctctttaagtactcttgaaaaatagaaacaattaagaacacttttgtagaaggcactaaaagtatccttacaaaaaaagcctgagaaaaggtgagaccctgggtcaggccttatgagactgcagcaggacagtgcctctgcctgccaggacatcacaggtagcctgactagtatagcagagacaaaaatcacatttcaagcccagtggaaatctttccctcttagagaaattcagtatatatatttttaaacacatttaacaatataatttatcaataagttttatttcctataggtataatgtgaatacaagtttttattggtttcaaagtttatattaaattgacagtcctatgagagaaaaatataatatatctttgttttccctcaaagtatatttataaagacccacgtaaatattttacagtaattgtgttctaattatctggaaattgtgtttctaaatctgctctaaacctatgtgccagataccaccacatcataccatgaggggccccaaggaaatggtcagaccaaatgcagtcatcttagtcgaaatgagtttacatgtttgaatagactggagggcaagcaagcaacccagcagactgtttgcatagtgtccagcagccatgcaggggttaaaagtaaaatttatcagacatcaatagtttattgaagaaatactcctttttgcttcataatttgcagaaagctgcaactgtcagtcatgatgtactgcctcttgaaattagtcaatagagcaaacagccagcattgctgtgggcagaaaataagcactgtaatcatgacataactggggtcagtgatttatggatttcaatatagtagtagctgcatatgattgaaaatttactaggtcactagtgcaccaaaaattttattcacagcctccaggcatcttttgaaatgtgcaacaaaataaaaacctctgaacctgttttgacactgcagactccgtggatgacatgccagcccagtgagtctcatttaaatgtaaatgtgtcataaacttttgtcctgtagtcttaaaataccatggacttgaagggacagtgcatgtgaaactgatttacatatcaaagtagaaaaagggccagtaataatgaagcttggattcttttatttttcaagctggaagccgaagctgttcctgaagtatctgaaaaatatgaaattagctctgtccccaccttcctgttcttcaaggtaaggatgaaagaggcgccagagatggtccatcaggaggctcctgggactgtatgttttggttcttttatcctttcctaacctccttggttgctcctggccttgtacctttctctggtactctctcttttttttgcaccgatgaagatcatgctggttgcttgccatgggcagtgggcagcccacagctagaactggagcctcccgaccagtcttctcctgcagactcatactctctgacccaggttcgaagtgggttattgaggacatgtgcctggatgtgaggagacatctggctggttctagttgattaatgactccttgggaatcgagtgcaaatctgtgcttcagggcacccacgggtattattaccacttaccacagctctccagaacttcatttgtgttcagtaggtctattcaagctgcgattactttgagatgcctgcttccccagcatgctccaaaatgagtgtttctaagtgagaagcagtgcaagcagttgctaatcataccctctcactgtcgctcacagggatgcctttaaaatgggctttaggtactttctataaccttggagtctaaagtgtagatgaaggtgaagaaatgccactttattctaaatgacatttcaaacttcagaattctcagaaagtcgaccggttagatggtgcacatgccccagagttgaccaaaaaagtccagcgacacgtgtctagcggagcctttcctcctagtactaatgaacatcttaaagaagacctcagccttcgcctgaaaaagctgactcacgctgccccctgcatgctgttcatgaagggaacacctcaagaaccacgctgtggtaagaagccgatcctgatgattggaacagaatgtccttgcctgcatgggtgctgttgatgtgtagagttaggctggtcactccctgtgtcatgccagtcatctagctgtcagtgtctgtatacagaggacatgggagccggagggagtgggagggagccagagggagcgggtctttggaagtaactgggttcgagttttctctgtttcctgtcagagtcatcaggtacaaagataacttgctcatgtggtagttgagctgggggagggattaggttccagctatctgtcatattgcgtctctattaatgggtctttggcctatataggttttttaaaaaggtgtgtgtgtgtgtgcgtgtgtgtgtgtgtgcgtgtgtatgtctttgtgtgtatatgtgtctctttgtatgtgagcatagcatgtaggcccaagaggctagaagatgatgttggattctctagagctgcaagtagaggcggttgtgagcttcccaacatgtgtgctgagagtgaacaactagtacaagcactcttaacctctgggtcatccctgcagcccagtctgtcagggtgtgcatgtggttgtgcgtgtgcgcatgccagagaggacatgggaggttctttgtcagtttccacccatcatttgaagcaatgtctggaacctgctaggctggcaaggcccagtcatattcctgtctccatcctctgggagctggagttaaaattgtgtactgactcaggggttggttgttatgtgcacgctgggatataactccggtcttgagggttgtgtcgaagcacttttctctcctgagcatctctggcttgtgtactttgctctgaacagttttctttcttggcagcctctttctcatctttttgtttagatttcataatttaacagcttgagggctttctcattggggcctgagcctgctctgtcttcctgcttcccgtcttgttgcgtgatgccatttttcatccactgctgtcacttccagtggatagctgtcagtagattacagatcactgagtctggcttatcgttccgcgcactctgagcgtgagggtgcgtgtactttcacccttaagtaagctctgtaatcatctgccccttaccccctggaattgagcttatgttgttttctttttactgtgtctactacaacattattatgctacataattgggtttttaatgcctttgatgattgtgttgagactctaagggtgtttatttatttcagctgcactagaggggtttattaagatgggtgactggcagtagagttggggatgctgttgacagggttactgtgtccagtgtgactggagagagctgtgctgccatctgagtgggctctacgcttccttcctctctctctctctctctctctctctctctttctctgtgtgtgtggtcaggaaacagtttatttcattaacagtaaaggatcttgttatgttctattaaaaagatgaagaagtgatgtgattccttctcgcttcctttctgtctgaaaggttgcccgggcagtgtccttttgagtcagccttcctgggtctgcccttgagtgaagtagtgacagggagcagatatggtgcttttttgttactttatttttatttattttttaaatttattttatgtatgtgagtacaccatcactgtatttacacacatcagaagagggcatcagatcccattacagctgttctgagccaccatgtggttgctgggaattgaactcaggacctctggaagagcagtcagtgctcccaaccactgacccatctctccagcccctgatactttatttttaatgagggttggaattattgccctctctggtgcttcatcttgtctagatgaggacgtttcttattccagtctaaagggcaataggaaggcctgtaaaatagtaaaagcctccatggcaggttatacatagcaaactgtctatgcagtaccctagtcttttttgaaactcaacagtaccactctgtaaatctctgctgataagctagtgatattggcaggaggcaaaattggttggcatagtgttaccaggcagcagaggtggggtgcttgtgtcacttgctggcttcagccctgccattgaagttggccctgctcaggaactaggtacaagctaggtactagaagtaccttggctttcagctgctctggagggtgctggctggggcttgttaccgaaggtctttcagtgcaggggctttctaatatttcaaacatcagtggcaaacagaagtagtcatttttagaaattaacttttaggttcgtatacattggactgagagaggatctttacccctcccccatgctatctcaagcctcgtccagttccagctggttctctcccttcctttgcagctctctgctgctctcctgttgcctgtgtttcaccctctgcttcccttgtcagagctagcgcctcttttcctccttctcagaattgtgacattccctatgcatgtggatgcgtgtgcgtgtgcgcgcgcacacacacacacacacacacacacacacacacacacacatacacacacatacacacacacacgcacacacgcacacacacacatacacacacacacacgcgcacacacatacatacacacacacgcacatacacacacgcgcacatacacacacatacacacacatacacacacgcgcacatacacacacacacacacacacacacgcacatacacacatatgcgcacacacacacacacacacacacgcacatacacacacatgcgcacacacacacacaggtgctcatatacaattttaaatctagtttctgcatacaaaagaaaatatgttacttgtctttctgaatttggcttatttagaaatagtgtatttccctaaactgaatttctgacctattgaggttttttatgttgtgacaaccagactacaaatagaataaaaaaaaatttagatattttagagcaatgaaaaacaagatatttaggcatttagataatgaaaaaaaggtagaatgttagatgcataaagatttagctgctagttcttctagttcttcttgggtgccgcctttttgttttctaacagttctgcaccttttcccctgatacttagtttctttttacgtgtcttccttcctggtacatagagcaaaggtgtgtggcttcacttctgttcttgcttgctgagctgcctagtatggaacgatctctgttccatattgacactccagtgaagagtgtgtgctagccccttcataaaacacaggtcatctctgaaatcaagtcctttctcagatgcagcaggggtgattttgagagcactctgccactcaaactgctttgctcctggctcagcatctgttgtggagcaggggtacacttgcatttgaatcggtggccctggccttggtttgtgttacccagaaaactttaacatttgtactccatatccaagaaagtgggaaaccgtttccagagcctgtctgttctagagcagtagaggctacagctgccccttctgctctctggattccgtctgcagagtttatggcgacttagaagcacagccccgggtcgcctgtcttctggcttctcagaaggataggaagagagcttgcttactttcgaggaggttttcagaatcattgaggttccttagcagggtaatgaggtttttgggggactcccagctattgtgggtaaagctctggtagatgtttgccgtgggagctttgggagtcggatgcaaagcacaagtgtagaaatactcttagggtcttttaggtagttattaaatgtggcagttaggcttattactcatgtcacaagtggaaatgactgcacatagaaatggtgattttgtggtaaatgagatttttttttttaaacttttaagtgcttctgttacatgcttgcatttttcttcaggagtgtataaatattttgttattagaataaagccttattactactttatccttaagcataacatttccagtctgccactttaacccttaaaaatgaaaccctaccaatcaatctttctagtctgcatgtaatggcctaaagccaaaataaagccttttctcagccagttacagtagaaacgagctaatatgttgggaacagaataaccatcagcagtcagccgttagctgtttactaatgaactcccagatgagtgaaagcattcaggaacagtgtttgacttgaggctgtgcatgaacacacacttcagcttgtgtgctgcacactctcctcgtgcttcatctcagccactgcagagctgcagagagcgttcggagctcagctcgaggcccatgttcttaatagtaagtgtacttttgggtgacgtcaggtaagaccattgcagctcatcttatactgaatttcatgatttgtttttatttgaaaataactgctgatgtggggaaatcttaaaggaagagtagtttacattccagtggattaagagtatctttcaaagaaaggtgaagtgagaaagaggaaagtggtttggacttggaggtgctaattgataagaatttgcagctgggaagaaaagtgaccttttctcagcctggacagataggttcataagactgatgtgaaccctggcagaagatggcttcaccaaactctaaactcctgggacagatttgtcactatagtgtaccttcaaagggaatcatcatcctgcacactaaagggaatgtaaataatttcaacaaaggctgaggtggagtcacatcagcctgtaggtgattcatgtaacaacaaagagagtgtgaacactggctgctgacttcacccaaagagagcacttgtgattctgagtgccatccatcctgctcagacagaggtggagatgagaagcgcctgcagaagtgtgtacacaggctccctggtgtggtggaaggactgcacttaggtctcactgtagtcaagcagtggttaaaacagctgtttcaggctcctggtcagtttcttgaagggagagggagcagccatagagagctttgtcattgtcagggtggagcctgtggtgggttttcatggttctgctctttgactaatgctgtgtccccaattaaagggcagctttgataaacacacacactttgctgtaattatgctctgtgtgagactctgggtcaaacgaatttttagcatttacttttgtcttaaattatccagttatactgattcaatcactgtgcaggtgaggtgggcatttctgtcccctggacaatgggtggcaatcactgtgcaggtgaggtgggcatttctgtcccctggacactgggtggcaatcactgtgcgggcgaggtggcatttctgtcccctggacaatgggtggtaatcactgtgtgggggaggtggcatttctgtcccctggacactgggtggtaatcactgtgtgggcgagtgggcatttctgtcccctggacactgggtggtacgtgagagatgctgagtctctactccttgttctgttgcaggtttcagcaagcagatggtggaaatccttcacaaacacaatattcagttcagcagctttgatatcttctcagatgaagaagttcgacaggggctcaaaacgtactctaattggcccacctatcctcagctctatgtttctggagagctaataggaggacttgacataattaaggttagattcttataaagacagttcagagcacactttcctaaaagtgctgtaataaattgaaagcacatattttgtattgtatctcggggtttactaatgaactcagtatttctgatcgacgtttgtcagtgtcgcacagtgggggtggtcaggtggtttatgtagtcacagtgtgcttctttcaggagctggaagcatcagaagagctggacacgatctgtcccaaagcacccaagttagaggaaaggtgagtgatgggaacccggcagcagggtgctctgtgcatcttagcagtctatacatcctgttagtgtgctgttctttctgagtagacaccaaacatttacttagtgtttagttagtatttgggtcataatgtggtgttcctcagtacctagttttgcaaactctggatgctctcgtttggactggagatgttttacctgatttagcaattatgaagagtaagtagacttggtgctgtagaaatgttactttcagtgggtcagcgtcctatttggttcttgctcttttgtatgagcatagcacctctgtgtttttgtgtgcagctcagtccctaaatgtggtaagagtttaatgggaaaagctagggttctcagaggctttcctgagtcatagtcacaaaactcaggcagactctggagctgtgaaaccatctttctatttatgagagagtacagcctgctttagaagtcgtgtagaaatggtggattttgttgtagagggatatatgaaggaggttctgttgtaataaatgtgaatttattagttcacgtttttatattaattaattaaacataatttatcttgaaatgcatcagagctcaacaactgttagttgggccttgagtttgtaatttgcttgctctttcacattttgagaatttctacaaatatttaataaagattgtttgtctgtacttaatccaagtactccttaggagcagtattctatagatgtcatgctggccaatgccattggtctgcacccttttgtagtggtgagaagatcatggtgttgtggataccacacggacccttttgtggtctttatcatggcccatgatatcccccccggctgtgctgcttctaggatggttctgtatctcatcccccagattgtccttgctgctgttgccatgtcttaaagtgctgtttacagctctccccgcttcaggcatgcacagatacatacagcatagagttgtatgtttcaggtagtaatctaaagagctcttctctagtgacatgatgagtatttagacagccgagtggcctgtgatgcatggatctaggtggttagatcctctggtgagtgggcttggcctctgggattggcatacctgaccagcgtcagcttgcttctacacgattttgactcgtgctgcctccacagatgagaagagagaagagaaaaatgatacgacccattatctgtacactgattttttttctaaagatttgtgactaaactttgttccaaacttaggttattaacaatcctgatagagagcaagttagattgcgctttttgacaggtgacatataaagttaaaatgagaagtgttgatttttcctggttagtggtgggtggaggactaagattttgctttcttaggctcactgccctgctctggtgtgaagagcattatgcacatcgtgatgggaagcgctcactgcttcatttggggaactggtagatggctcgctatacaggccccccatcgaataattccttgctgaattggttattattatttttttagtactacaagttgatgggcttaaattgcaacttgaaagaacattcgttgccttaaaaagccatattatgttttacagtggctcagggagagaatgaaataaaggaaagtgtcaatgtttttgcttgtttagtaccactcaaagctgtgagccgtcatcctgctatccctcagatatgcctgctactcaggaagcagagcagaagtggtgtttaataattgagctgagccattttatatcaattttctctcttcaggctcaaagtgctgaccaataaagcttccgtgatgctctttatgaaaggaaacaaacaggtaaagaactcaaaaacagttttatttgtaatttcttttgatgttaacatctgcagcaaggggacagttaagcctttttttctagtttagctaatgaagctgtagtagtatcaggaagttatccaggccttaattggtgcttatggagatcaaacaaagtaatctccattttgcttgactttaccatcagcatctcagcagggtgcatgtctttctgctgccaaactttgtcagctgaagtggtcaacgctgctagcgctcagccagtaccttttgtgaggctgtggactgtgggcagatgtccgccctggttctttgaggctgtggactgtgggcagatgtccgccctggttctttgaggctgtggactgtgggcagatgtccgccctggtagtcccgaggtagtccttaggtccagaaagtgagaagtaaccctggcagtggtcctcgtgctccgaggtgacatgattgcttcttggggtccgatggacgtaggtactgagctagtttggtaggtccccttgcactcattaagtggtgaaagctgactctctcctgttagattggtaatttcaaaaagctagtcctgtcatttctcttacattttgctgttaacagttgtttcagctgtttaacttcaggcaggcaaagctgtgcagtttgctttcctctcaggataaggagactaaatctcagaagggtgaggcagtggagtgaggaagctgcccaggtacaagccaccctgggcaggcaacgccacagaggcccctgccgtcattgtgcctttttgtgaatggatctgttaatgccataggactgttttaacatcaggttgtcgtaaaggttgccatggtatcaacacagtgaaggccattagttaaaacaactaattagttaatgtagctagtgtgatgaagtaatgaggaagacattaatataaatttagcctgtagataccactgtgttaggacctagactgtaactggggcaatgcacagtgttaattaatgacttacagtaatgatgaagcgcactcttgctctgccactgttgaaagcagactttgattctccacatttcttgtgcctgtctaggaagaatttgtatgtcttggaaatggtgtcctgggagctcttaagttgttgtgtattgtcagccttttctcccaggatagctggggcttggggatctacccaggaataaagccgaggatttcaatcacttccagtagctgatgccacagcgccaagatctggcttaaccgcgttctgactctttgcttagagcaagaaaaaggctggtggttctgtgtagatgatctacgttttatttaggggaccatcctgaccacaaagattttaagctgctgcatgtcactcaacttaaaaggttaaagccaaagtcagtctgaaggttgtgtgggatgatgtcagaggggtggaagaagcacaggagccgggtccacagagaggtcggggtgctgactagagcattcgaagtggccacactcactgggtctgtggaaaaaaaatgtacttttttttttttaaattcaggaagcaaaatgtggattcagcaaacaaattctggaaatactgaatagtactgggtatgtaaatcttgtgttccattctgctcctgatacttcacagttttaatgtttaaacatatttgcacaatacttatttattgacacacatttctaatttttatagtgtattttgaatgctttaacttggaccaaaaaggacttttctggcccttgttctcaccatgcataaaaaagtacagggagacaatcacataattagcatttttctgaagccttggctttcagagctaggaagatggctcagtggtttagtgtgttctgctctttaagaagttgagagttggttcccagcatccatatcaggcatctcaaagctgcctgtaactcaggtcctggaggacccgaagcctcggcctgctttgtgtggagtatggtgaactgtttaagtctctgctcctgtgttggagctgctgggctagagatgtccggtgggggctccctgattgatttttgtgcttaaaaccaaatccatctgtgtggagctgtttagtacatgttcttttggacattttttcaaatgtttgatttctcttgtttcatgattgcttttcaaattacagtatgtgttctgatcatactttgaatagatagcctgttctctgaagttgcagatctgaagttgcagggtggaaggcagttatgtagcacagtttgaatatgacctttaaaaagtggctcttccttttaaagcaggattggggtccagcaagctggggtagagggtgtaggtgctcatcccccaagactggtgctctgcgtgtgagccacatagtggaggagagctgactgcttctacaagttgtcctctgactgacacacagatgtcttggtcttctactgtgcctgagagaaatctgtcacgtcccactgtagctagtcttgtccattgaaagactgagtgatttttgtcttagaacgacaagcctgagagtaaagatcgtccccatggctttacagcaggcttcctagaggaagtgtgttagcgatggactgcttttcttgactgtattaaaaacactatatagattttatggttttgtttaaaatgaacacctaataaaaatgctttctccttttgcagggttgaatatgaaacttttgatatactggaagatgaagaagtaagatataggttttctgtttctctctctcctttttttggtttttgttttttgtttttccaagacagggtttttctgtgtagccctggctgtcctggaacacactttgtagaccaggctggcctcgaactcagaaatccacctgcctctgcctcccaagtactgggattaaaggcgtgcgccaccacgcccggctaggttttctgttttatcccatgttttagctttgttcacagggtctgatgggaaggattcaggatttctgttgttcctttaggtgcgtcagggattaaaaacgttctcaaattggccaacctaccctcagctgtatgtgagaggggatcttgttggaggattggatattgtcaaggtaagagcttttcactgctgttctcaagaattgacatacttgttatgtttaagcatccagctggggtggtgtggggctcctcctctccagcctgtcagtgtaggtgcgcgtctcatgcttcctcctgctcagctgccaggcagagggaaacgctctagctgagtgtccagatgacctcagaggacctgctgtgctaactactgcacagcttccttccctgttttcttgtctgtcagtccatctttacctggttcccgaaactttaggttttcttgtatcttccgtatttagatctttttatctccatcctttggggcccaacttcttttgtaaatgtgtatttctcctgctgggaacatttctctgctctaaaattcttactgcatttttattttttgttagttgtaattgtttctctgggtcattttccttttcccttaaccacccttaacgtgcaggcgtgaggatgaagactaggagatcatggtctgtctcggccttcccagttctgagattacgggtatgagccatcaaagccggccctacattattacttcaaatccttcctgatgctctgtttattttaggaacttggtaaatggttattagacagttaaaaaacttacttcttttgtcttttaaatgggcctggcatttccttttagtttttcaagacagaatttctctgtgtagccttggctgtcctggaactccttctgtagtccaaactggcttctaactcagagattgcctacctctgcctcttgagtggagacataccccgccaatacctggcaatggacctgacattttgaaatgtgctacaaggtggtcttatctactagtaactaactgtgtttattagctgtgttggttgctgtaaactgcagctttcatgacccttctctaccccactgctctccaccttgcccagtgtgttgagggtgtaaccagcagatgttggggcagctcctcctccaggcaggatagtgccctctggccttctgattgtttctctgagttttaagtggaaaaaaaaatgtaaaacatagttaacattatacaataaaagctttaaaaacaggctttcttaatatggacaaactctggaccagctaaccatcaatgaactcaggtgtaaaggcacagggcaggctttatttcctgtcaagtgcaaagtttgatggcactttgacaacaaggtatgggcaagaataaggtagagatgtagttttcttagtaaatggtcgcattcatggagaaaagaaagcactgcagcttttaggagccctgaagcaacaagctaagtgcgcacttgctcctttcatatctgggtgcacacatatcatatgcaggtagacattaagtcacaaactgtctttagatccgagatgttcttgagcttgttcttgtctgaacgattcacgggccatgcctgagccagataaagggtcttaggaggccaggaagtcggtgacaccttttgggaactgtatgactgtatgattcctgttcagaacacatgctgcaagttggtgctgctgctcctacattgtgaacattgtgtcacagtttgggggactgtcactttgtgttttctgcagggtgcagcttttcatctgttcattagtacacattccatagggtaattctgattggcttctgttagagcactggtactttttgttgacttagtaactcaatgacttgctcagtctgagaccctggaaaaggcacccctgacaggctgcagatgggctgaggagccattagacttggggcccttggctgagggtgtgtgagctagagaagatgtgtgagctgcctgcccacagaggagagggaagctctccaggggtctcagagggaagaattcttcctccgtagagttcacccacttcccaccatagcttagctgtaaatctgtgacgcagcagagtgctcgcttgtgtaggaagaccgtgaaagacccgatgctactgaagtctacctgattgatgagttacggctgcctgggcctagtgcttttgtggtcactgatctatctactggtttagaacccttttaactttgtcctgacattgtttgccagctcttcctcccatttgtgagttctgtatttgcagattcaaccactgaagataaaaaaaatatgtttatgtgttttaatttatagaagcaagacttgggagtatgtacatgcctttaatcccaacatttgacacacaaaggcaggaagatttccgtaagttggctgcttagtgagttctaggacacccagagattccatatcaaaacaatgttttttagtctgtagtgacatggagtgagaggtccctgcaggtgttacgtcaggaggagaaacaaacccggagagggagaatgagactttcgtcagcctggctcaaacttcgggaatctgacgccaggcagtttatggccaacatagttaatcccaatataaattagaaaaaagtttcccaatacaatataattcccagtgcaaaagaaactcaactcaaagtccatgaggtttcttccagctggataggttatagacatagcaacctctattagctaagggcctaaggaaggatcttgcctggatggtgaggaggctctttgggccgtcagccacctctgggcctggctgtgggagcttggaggagcctctgactttacaggtagtgtaagggtcacttaagctattagatgtcctcagtcttagatgtagaagcttcatgaagcttggtctgaatcagcagatcctgcagatcacctaaagcctcctcttctcagcttctggatgtaagaacaggtttacatatttccctttgaaatgatagtcctgtgtgcttagcattcccagcttcctggagatctgtggatgctcctaacaatgtaccagcgttttccttgtcattatttccaagcaacatttacattatagtttagcatgggagtggtgtgcactgtgtcttctacatattatcatctgtaaggaatgagcccgaagtcagtctccatgaatataataaaaaggtgactctatttagttttaaaataaattctaacctacaatttatgttcagttttacttgtgcagagagaggagggcaaagagagacttgaattagggccttggctgttaggccagtgttctactcctgcaccttgttttctatcttatggtgtaagaatgctggcatgttgaaagcctgtaggtttaattgagtgtgtgtccttttggtgtcaggtacaggtaaaaacctcgttgcttaggtgctttttcctttgtgtgaccatatactttctctcatgcatnnnnnnnnnnnnnnnnnnnnctccctccctccctccctccctccctccctctctctctctctctctctctctctctctctctttaatttttaggaactgaaagacaacggtgaattgctgcctatactgaaaggagaaaattagtgaacataagcatggtgtccaaggactgcaagaagtaactaattaccttggaacagttgatgatttggtcctgagaagtggactaacagtagagatacaacacactcagccatgctcgatgcgcttcaaaaggtgtgctgaagaaacatgctacgttctctacgaagcagagaaggcaataaactcttcagactcagctaaaaatgattgcgtgtagaatgtctctgtagtgatgcttgtgtgtagcatgtctgtgtaaacttataatcgctgtcactaattcctttaaatccctttcttaacacatggacctcctgtagcacttagggaaggcctcttacaagcagtgtgctttagtgctcagctaactcctgtaccagtccaatagctcccctcactggccagaggacgcctcacagcctggaaaatgcaacccaaaagtttatcctgcagaaagccagatgttgtaccaatatccagaagagggagcagtagcgaccaaaggggaagcacccttcagtcttcattgcaatgaatatactaattttgccttccaataggcagagaatattctaaaagtcatggaaaatttaaatgtagtttttccaccctgacttgttccagtaagctttgctgcacaagcctttcttaggatttctgacttcacagctgtgggatctgggtattggctgcctgtgggatgttcttaaatgatcatggcctgctgatctgggctgtgaggcattgcgcagtgaaaaggaaagcagtgtttgccggtaagtgggatgaaagcggccaaggtcggagtgtgaatccagcctctgtagaactcggggactgctgctgccttgtagcctgggtcctgttgcttaaggtggagggatcgaaacagcacaagcttagaggtggttggggcctggcttcctagggttaggatgcctatgagggcctttagggaaaacaagactcttcatttccactgagagaaaaccattgagtaggtaaaacttttacattcgtgtagatgtaaatatctccttgagttcttatcaaggcttcctgtgtgcctcatggaggtctgaccatattcgttacttcccctgttgctgagctaaaacactgggaccaaggcagtttatagaagaaagttacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatctgtaggaagactggctttctttggtctcgcaaacggtaaattatttgtacaaggcctttgccatttttattttttttttttgtctgccagtgcctcctgtcctattccattatcctcaccccttatgctttgtgttccagtttcttttctgttgtgagagaacaccctgacagaaataacttcagtagggaagccaaggcaggaaccagaagcagcaaggacagggtgaaaatgaatgcattgaagtccatagcttctagagtcggctctgttgcctgcattgaagtccacgcaggttctagagtggctctgttgcctgcattgaagtccacgcaggttctagagtggctctgttgcctgcattgaagtccacgcaggttctagagtggctctgttgcctgcattgaagtccacgcaggttctagagtggctctgttgcctgcattgaagtccatgcaggttctagagtggctctgttgcctgcattgaagtccacgcaggttctagagtggctctgttgcctgcattgaagtcccgcaggttctagagtggctctgttgcctgcattgaagtcccgcaggttctagagtggctttgttgcctgcatctgccacacctattcatttcctgagggaaggcagcagggtgtggatgtttattgggtgtctgttggggagactcccaagtgtgctgtgtggagttcagcaagtttggatatgtctgaatacacgaaggccccaaatgggacaccagtgccacctcttccaaggccaaggggacattccagaagagggagtggaagcaccatgaagtcagagataatgcagtcaggagggtgggaggcagggcatggatgggaagaagggtgagaggaggagggaatgagggcaacattgtcagaagttaaaactcatccccagaacagtgtaacatgctcaaagcgaatggttcgtggggcggtgcacatacagcacctgtcctgacaattgaagctgaggctcaaagcttaagattttctgggcttggtgacacatttgtaacctggaaggatcaggaggtagatggaggcaagtcagcctgacatgagactgtctcaaaaggtaaaaagcaaaggccggggagatggcacaggacgtcagagcgcatactgctttccgagaacccatgtctggtgtctcagaactgcgtctgtcatatgagggcagttgtgtgtataattatacataaacaagtgtacatacctgcaatcaagacggccatatgcacaaaattgaaaatgaaaaattgtaggagtaaagaaagccaaaaatggggccaggcggtagtagtgcacacctttaatcccagcacttgggaggcagaagcaggcagatttctgagttggaggccagcctgatctacagagttccaggacagccagggctacacagaaaccctgtctcgaaaaagaagaaaagaaaaaagggaaaaaaaaaaagccaaaaatgcttaatatttcaacatggaagaagatttcatttctgattaaattttgaaatcatttttcttaaaaatggaaaactgggatgcttgcaaattcaagcatctctgaataaaaatgacttagttccttgcaagcacattcccccttttactgcacatgtctggtgttacaggagcaagcagccccagctgagaggatgctctagctaagtcttcatagctgcactgcacagctgttcagatttgaagggctcctggtaagctgcttttagggtctttaatgggccggacatagacccttgtcccaaacctgcaggaggaatattggtgtgcataaggtcccctgcagtggtccatgcttttagatttatttattgtatgtgcatgtgtgttttgtctgcatgtgtatctgggtgagtactatgtgtgtgcttggtgcctgtggaggtcagaagagggtgtcagattccctggaactggatgtagggatgcttgcaagcatcatatgaatgctgggaaccaagcccatggcttcagcaagaacaagttttcttcaccacggagccatcttttcagcactctgttatgttctagtgggggcagcatagccttactgcctctgccttctatgtgtgccatcgggtctagcagcagctgccattcaagccaggcccatgtccagccctgggctatgcctgaagcactgtgcattctataggagagctgtgccatctagcgggaaagggaaaacttctggtttctgaatggggtgtgtgtgtgtgtgtgtgtgtgtgtgtgtgtacctgtgtcaggagtaggatggctttttaaaagctccatgacctggcatattctgactctgaatgtgcttttctgtgctgccccactctcatcgaaatggctaccagtgactaattgttaaacacacctaatagttctttataaagtcacactgatttcgaagaagttgcagttttcccacatggacactagatggggagcttgcctgaattatgatcatgacccgggtgtgggtgatgttcatctggggagaagagagggttggttggtaatttggggcgttaaattagtttttatgctaccaggccaagttttttttttttttcctttccccaaaagcaatggccatagcatgctgaaaaagctagaagaaaattggaagccttcagaagcctaccgtctaccccacccacatattaaaacattctttttctgttttatcaagaagtgtctccctctgtagctgccaagtcgtgtcagaagggtcgtatccacaaatcatgaacacaaggtgtacagtgcctgctacacaaggtgtacaccacactacagaggacagcgggttccaggctggtcttggatgaaggcctaggcttaggggtggtggccacaggacagcctggcaccagtgttctgtcccagtgtgtactctgtggcacagacagtaaatgcacttggacataagtatgcacacgaggaagagggcattggaggacactggggagtaatggcgggtgttgcccctcctgacacccacagccgagacctgatgtctggagttccctggaggtcctcttcagggctgttcttgtccatctcctgagaaggagcctctgattcctgtggagcttgcacgcatcatctgctgtgtgagctgtggccccttgttcaggtagcaggaaggacgcatctctaaaggtagaatggaaatggagttctctcccagcatcctcttcgcttgtggatttctttttattcttctctcatctattacgtcccagcaacagtttcccctccctctcttccctcagcctcttcccatccctcctgctgtacctctcccccgggtccccctcccctcagaaaagagcagacctctcagggaatcaaccaaacatggcacaacaagctgtatcataagaccaggcacataccatcacatcaaggctgggcaaggcaacctagtaaggggagggggaagagtcccacaagtaggcaaaagagtcagggacagtccccactcccactgttaggagtgccacaagaacaccaagcgacccagtcatagtatatatgtagactgtaagtcagacccctacagtctccatgatctctgtgaggcccatgagtccctgccatttgcttctgtggactggtctcgtggtgtgtccctgacccttctggttctttcctccaaactgtcattccccctcctcaacaggactccccatgctctgcctaaagtttggctgtggtactctgtgtctgctccatcagttgccgatgaagtctcgctggtctcttcaggcaggacaaactgtaggtagaaggttttgtggctgggttggttcacttgctgtctggatgcgctgtacagagtcatgaattaggacagcccgagcatgggtgttttcttgctgtctggtgtgcacagtgatttttttttttttttacatgaatcacaggtctcaagttttatttcctttcattcccctcttcttctactaagtaattctaatcttagaattttagaagtctctatctctatatggagaatagaaatcataacatgggccaaaggttaagaacaaaaacagaataagaagggatagtagacagatttaggcaggaacccttctagtgaagcttgagggtctgggcatgatgtaggtatacgtggatcagatctctggctggaactgttgagatgtcttttgtggtacccggcttgttcgctgtagccaattgtgaccagccttctttctgcaccacctgcaagccttttaacttagcatatagattattattacaacaacatgtaggtttaagacagtgatgggcatggggaaggagcaccaaatctgcaccagtctcttagaattctattcatcttttctatctgtcctgagctttggagcctgtatgcacaatgtaacgtctaatcaatccccaatatcttggccagtccctgatttacctgggcaacaaaggcaggtccattattggacctgattaccttgggtatcccaaacctcgggaagatttcttctaggatcttcttggctatcacattggccgtctcagtccttcaaccgggagactactgccatccatgtaccagctcgaactctcaggccaaggctgatctgatccttcagataatttcttctgccagaacgtcagcgcagtgatgagtaggtgaagtcttgggcagtagggtatcaagattgaggacagcaggtggagcgaaggtcactcgttcagtcaacaaaaagctctgataatgtgtcacaggagcattggtcgtcatccatcagtcagggggctttcagataattctttcaagagtgtggggtgccactatagttatttgctgtcccagagtgagcttatcagcatctttgacaagcagagctatggcagcaatagctttcaggcaagaaaactacctgctggcaacagggtctaacttcttggataggtaagccactgcctttttcaaagtcctaaagtctgagtaaggactcctctggcgacccctggtctctcttccacataaagagtgaaaggcttggttaggtcaggcaaaggctggccatcagtagggcctttttcatttctttaaaggctttctggtgatctgaggtccacacaaacacctccccttccttggttagggggtacaacgggcaactaaagttgctaacccaggtatccagagcctgcagaaaccagtggtgcccaagaattttttttacttgccttggtgtagttggggtggggatctgagttacagtcttttttctggctttctttagccactacttccggtcttgaagggtgtatcccaaataagtaacttcagtctgacacagccgagcctttttagctgaggcttggtcttctgctgcccaggtttcctgtctagatcctgtcttttctttctctcctaccactgtggccaagtttctagtcaaatttctttcttgtctacgatccctcctgttttctctttcttctgcctctcgccccccccccctcctcgcaatatgccttctctgcctcttactggttctactctaaatatttctcattcagagtatctctctcatctcagacctctaatctccttcatctctattttcactgtctctcctgagtctgctggagctttgctcttccttacaatctaagctcacttttttctagacctctatacacttttgtcagagcctggtgattagacttgtaggtactccttacctgggacagaagttttaagtgggcagatgtctccctcgggccaactcagggaggggggaaaaggcggcagagggcgactctagttggcccctctccagcaggcatcacggcctaggaagccaggcggggccggcatggggccccgcaggcctcgcccctctttcttttcttgcctatcccgcaggcggtgaaatgtgtggtggtggtggggcccggcaccccgggaaaacctccacatcggtgttcccccctgggccatggtttcccacgtggcgcagcactgctgctgccgaagccgggagttctcagtcccgccctgcggctgcgtgcggctgtgccgagttgtttttcttacctatcactgacaaattctgtcctaacgtcagtccaagtccacagttggcaccacacacacagtctgtcccatgacgaaaaccaccaacacaaacaagacagcaacagagaaaaaaaacccaccagtatctaagcacattcgttcctcactctgccagatgacagtcagacctttctggactgtccctcacccttggaacatcttccagaggttgcagctttcggggcctctggacgtctccctcccgtggctactgggtccttacggcccacagtggcagctgccagaatacagaataccagaactggggaaccaggctgtgggactcgaacccacaatcccagaactgtaaaccaagacacgaggtgggacctgaacccacaatctcacaactgaaaaaccaagacatgaggtgggacttgaacccacgatctcagaaccgtaaaactaaggcatgaattcataaaccaagacacaaactcacaatcccagaactgaaaaaccaagacacaaactcacaatctcagaactgaaaaaccaagacacaaactcacaatctcagatctgaaaaaccaaggcacaaattcacaaaccaagacacaaattcagcggtgccacacttagacaacagacaacatgtaagacacacagaaacaaacatacctccaaggggtctttcggggttcctgggtgtcacacagatctcggtgggacctccaaatgaaagaacccagtggggaaacccccactcaattcccgatttggcgtgcacccaagaatcacgctccgggtcgaaacgtatctcacgcaggagacagtggattcgacctgcacagtgattcttaaacacagcacaagaatgcttaacttgtataaggcacacttgtctagcatagcctctgtgggaatgaacggtgggaatactgcactgagtgggtctagcttggtctgcgtgcccccttcacactcttcctttggtgtgggatgagcaggacacggactgtgagtgggtgggttgcttccggtatcttggtgaaaggggagggttagtataaacaagacacgcatctcaccaaagtcgcaagctctggggctgccgtgctcaggatgttcttgctctctgcaacatcactgccacttgatagggagatgtggttgttgagctgacacctctgccgggtgtagcctgtggtttcttcacaccctttgaccaccgtcggccttgatcctggagtactgtaactgtcgtgtctctcaagatacacaagtgagctgttgactcctcacatcctgggggtagggtgaggaggggccttaggagccaggagacccagggccaaatcccagctataccacttaccctgtgaccttgttgggtcttgctctggacctgagcttccatgcatcatggtgcactaggattctatactgggatatggtcctactgccatcaagaaagctctgctaccaagctgctgcacctatggtgaatctagaagtgagacaggaggttgggggcgacagcatcagagtcctctgcgtgcacagcctggggatgctcaggccacaggcaaagattcttcccatcatgtgtcatggtggagaatgggctagcctgctgggatcttctgtggctctctccctacacctgaccaaggagttcatggactctgcatttgactgtcagtgccacttgtcatgggggaagccttgttcagggatccttcctgacagagcacactttatacctatagctggtttaaaacagccaacacacatggtattgtcaggcagtgacccaagcactcaattcatcgggagtcactgctgtctcaacactacggtagaggggggaataggttaaacaaactgcacaaggtcacagtacttggtgtagctgggatttgaccctagatctccagccatgcttccaattgacctcgtatccccgacaggatgtggagttatagtccaattatgtagcttgagggggaggacagttgtagttctcaagggtccaggtcaatggtaggtagaggatgagaggggctggatcttcttcattggcataagagaagccaaagctgaggataactctacagaaggtggggtgtgcacttccagcagccgggagcataggcttgagttcccaaacacaggaccaaacagatgatccctgaccaggcacctcgacagatagctactacatgaattagaaagtaaccctctgggtgctagtttcccccagcgctgattggcacctcctttgagttttgatctacattctttctcctcaaggccttggtatgcacaagggaggatgcacagctgcaagaaaccagcattgcctgtggtttgaaggtctgcagagatgagtgcatgccccattaacacagcctgctcctggagcagtaagttgggaaatgggccactctggagggctcatccccacactgttggatccccgatggtccagggatgtccaattgctccctgtgtggctgcctagctggcccagttctagcctagttctgagatgttagtgtcaggacaaggttggatcccggcctgactgactggagtccctgtccttgactgttgaaggcccttggtgtccagacacggcttgggggagcggtcactcctcaaccccaaggcgggtaatggtaggcaatgcgggctttcctgtgctaactcagcttctctgtccccgatgtctacttgtaactttgcaggaactagcctggtatcctctgtagctggtcaccactggtctatgaatgtcacaat

SEQ ID NO: 770 - DNA, 1242 bp, Mus musculus
ctgctggtgtctggcggagacagcatggcggcgggggcggccgaggcaggcgaggcagccgtggcagtggtggaagtcggctctgcccagcagtttgaagagctactgcgcctcaaaaccaagtcactccttgtggttcatttctgggcaccatgggctccacagtgtgtacagatgaacgatgtcatggcagagttagctaaagaacaccctcatgtttcatttgtgaagctggaagccgaagctgttcctgaagtatctgaaaaatatgaaattagctctgtccccaccttcctgttcttcaagaattctcagaaagtcgaccggttagatggtgcacatgccccagagttgaccaaaaaagtccagcgacacgtgtctagcggagcctttcctcctagtactaatgaacatcttaaagaagacctcagccttcgcctgaaaaagctgactcacgctgccccctgcatgctgttcatgaagggaacacctcaagaaccacgctgtggtttcagcaagcagatggtggaaatccttcacaaacacaatattcagttcagcagctttgatatcttctcagatgaagaagttcgacaggggctcaaaacgtactctaattggcccacctatcctcagctctatgtttctggagagctaataggaggacttgacataattaaggagctggaagcatcagaagagctggacacgatctgtcccaaagcacccaagttagaggaaaggctcaaagtgctgaccaataaagcttccgtgatgctctttatgaaaggaaacaaacaggaagcaaaatgtggattcagcaaacaaattctggaaatactgaatagtactggggttgaatatgaaacttttgatatactggaagatgaagaagtgcgtcagggattaaaaacgttctcaaattggccaacctaccctcagctgtatgtgagaggggatcttgttggaggattggatattgtcaaggaactgaaagacaacggtgaattgctgcctatactgaaaggagaaaattagtgaacataagcatggtgtccaaggactgcaagaagtaactaattaccttggaacagttgatgatttggtcctgagaagtggactaacagtagagatacaacacactcagccatgctcgatgcgcttcaaaaggtgtgctgaagaaacatgctacgttctctacgaagcagagaaggcaataaactcttcagactcagctaaaaa

SEQ ID NO: 771 - protein, 345 aa, Mus musculus
LLVSGGDSMAAGAAEAGEAAVAVVEVGSAQQFEELLRLKTKSLLVVHFWAPWAPQCVQMNDVMAELAKEHPHVSFVKLEAEAVPEVSEKYEISSVPTFLFFKNSQKVDRLDGAHAPELTKKVQRHVSSGAFPPSTNEHLKEDLSLRLKKLTHAAPCMLFMKGTPQEPRCGFSKQMVEILHKHNIQFSSFDIFSDEEVRQGLKTYSNWPTYPQLYVSGELIGGLDIIKELEASEELDTICPKAPKLEERLKVLTNKASVMLFMKGNKQEAKCGFSKQILEILNSTGVEYETFDILEDEEVRQGLKTFSNWPTYPQLYVRGDLVGGLDIVKELKDNGELLPILKGEN

SEQ ID NO: 772 - DNA, 68255 bp, Homo sapiens
catttagagtagctctcgggcacgctggcaggggggctcccagagctgagtgagcaaggggtgcattgagaagcaggcgttctgccccgaccggcccacctcactctccgcagagggaggcatttgtggtgggccaatgtgcatgcagccccaggctggacaactccagaagaaactcaagaacacaaatgtagatgattaaccaaaatagtctgttccatcttcctgcactggggggaaatgcctcttgtattttagaggagagagagaatgggaaggaagccactgcaggtgtggcagacattggaggactcaggtcaagtataaaactgctgtggccacggatttaactaagtttcaaccaagtagctttccaggttgggtgacatctgctacatgctagaactagctgtggagtctgtgctttggccccagtttggagtccagaactattagcatgtatcaccgagttgtgtttgtaagggttgtgtgtatttttagtgcttcccagagctttctaccctgatcgccttccacaggtagaagcggctgactgtacctggtacctggggccactccagaggtcccctctgggaggtgatgcctctgtgcacaagcagcctgtgcaagaatgtcaaggtcagcggaagagagggcacacgccctccaaggaggtggtgtgggttgggactcagtgtcctggaagggacctccttcaggcaagagctcttggagtcagacggcacgaaagaacctgagtatagaacttctcaggtctctaaggaattacatctgattctataagaatcagaagtttgttggccaggtgcagtggctcacatctgtaatcccagcacttggagaggctaaggcaggaagatcacttgagctcaggagttggagaccagcctgggcaatatagtgagacctcatctctattaaaaaaaaaaaaaaaaagtttgtgacaccaaggaaagctcatctgggtccttagtttcttagatatgaaacatgaactacaaataacagcagaaaattaactccatctggacttggaggataaatacacatatgcacacacatgcacacaatactatttacatataaaacattgtgactcaaacggagagaaaatgcagctgcatgtaaacatctgtggtgattaggtatacccactcagtgaccaacaaattgcattcagtgtgtctggggtgatcgcctcaggaactgggccttcggttagtaacgatgctttggaagcatgtatgccagtcataacatgtggagggcttttcctctctccctccctgtgttaacatgctttcatatggctagtacagtcttgataaatcttgcaggatctcaaatagcctagtgaaacgggaagagaagaaggtgttaaaagtttgcaggtcaggggaaaagcacgtgttttgggtgagtcggtggagcctccacaaatacagcatcggtttgtgtgaattctcagctgtggtttctcaggttgaataaagccactcaacaaaggctgctgtttctccagcctgaagaggcacttatgccacctacagcctggaatctggcactacaattcgcgcccaagtccctggctcatcctaggtgggagattagaatctatgtagggaatggaaaatgggcaggcattccagggtgagtttttcttcccccccgataaattgtaaacaaacaattacaaacatgtttgaaaattgttttaactagtttttagagattgcaatagctgggttgggatttatgaactacatttcttataaatacatttcttctagagaacttcttgtgggacgtaatcacttttcccctctgtatagcagccccacaactcaacccaaagctaggttaggctactgggtacacacttacccagatagtcttagcttcttaggggaaaccagattactgtgaagccatcagataagacatacttctgaaaagaaatggaatgtatttttattggcagagtcaagatgaagtatgttttgaaatctgttttacaaataaacttacacataaattgtccatccactacttggaaatcttttttcgtgtttgaggagctgtcagaggtctctaataaacagtgagtcttatttagtttactggatatgtaattcttcttttctttgaaaataattatttttcaagcaagtgcagcaaaaatacaaccaataaaaatctagctatgacagcataaacaacctttatggcatgcatatacatagacttcttccaataaaagcagttcctggcaagaaagggaacagaaaattggctgatgtgttcccagataagttctggactcttaagggctgagagaagagtcctcacagcccatctccaactccccatcccagaccggtccttggttagcgtgagggaggcaggtccccattgccagagtggcttgggctaaggagaagggacgggctgctgtcaacttggagtcaggggagccccttcccaaggcccgttcttggggccaggaagtctgctggacagaggctgaacccccctgcaggctccggaggagcgggtgggagaccggccactgttcaggctccccattcttggtccaggccaattgtccccgcgggagggcggtgccacggtgggtgacagggctgggggcggggtaggggtcgacttaagataatctggtccaggggttctgctctgggctgggtcgacccggctcgcggggaggctgtttgccctgggccttcccatccccgcgccttcccatccccgcgcccacgccgcacccaggcgagcaacgtggagggtcggcgcggggctgctcccggggagcctggggttgcaagttctcagcagacgtgcgggtgctcatttatgctttttatagtagctggagaagatgttatcgcagcttgagaacagaaattaaaatatgtatccttcaggtgcaaatctactgtacttacagttttaccgtttctctgcaggggggctccattaatcttgtaagagtgaaattcctaaggaaattaattccctccagttggggttattctcaactggtctttgggggcggagtaattggaatttaagagtcgctcttaaaagaaaggaaacgttggccattttactcgaataacactttctaatgccaggctttactctttaaaacacctcctccttctttctctccctgcacctctttgtgtttctgggcttcccttggtagggtttacaaagacccccaccaggtgggacctcccctcccagttttcctgaggctgaccccacattcctttccacgtgggttatttgtggccccccacccccccttctcccactgcgcagcctgaggaccacgggaccacaggagggaatgaggcatcatgaaaagttcatggctaaatcatttccttgcctgtttaggagcagtaaatgtttgttgtcatcacccagcaaaataattacacctcaatttctctctctctctctctctctctctcacacacacacacacacacacacaccctttaaaatacaggcaattcataggcaagaggtgaagttttttttgctgccaggaaagtccaggaaagcatcttccactggagcttcaggtctccaaggcctaagcttcagtccccaggcccagagccccaggcccttattcttcaggctatgggaaccccaccaccaccaccaagacggaatagaacttggctaaatggctaaatgcaggtgtggtggcacacgcctgtagtcccagctgcttgggaggctgagggagaagaattgcttgaacccgggaggcggaggttgcagtgagccgagatcatgccactccactccagcctgggcgtcagaacgagattccgtctcaaaaaaaaaaaaaaaaaaaaaaaccatggctaaatgatgcttatatacagggtcagtagaatattagcggccaggaggaacccgtgggcacatggccacaatcagccacagtccttgcttttcagcttaatggggcttaagggaaaggccaggtccagcgcattctaggccaggtccagcgcattctgtgccagcccaagccaatttaatagggtcatggccagtttttccctgtgggccctaacatggtcatagggagagaggatggactttccagggcactgttcggggcagtgagtcctggcgatgtccctcctctgctgtgggttgggcagtttccttagctatacagtgggtcatgggcagtgtgggtcccacatcatcagcttaatggggtgctgaatgatcaatacagatgtttacctttgggggcttttaatagctgaaaagtgccatctaccagtgggcacctgtgtatcccatagctccccaaaacctggctcagctcagggcagagcctagtagtctgctgtccatgtcagaatatcagagctcctagagctgggaggaggtcatctgctgcccctaggcctcttgatatcaacagtgacaacatgggctcaggaaacagaagcctagaatgaggcctcagctacaacctcagaagcaaaagtttttctctgatcttctcttgccctcctgtccctgcccctcattctcctctgaggctagccagagaaactagaatccctcttcccttaggcacatcatagaaaccagtacccctttcccccaaataattactctaactccctgccccccaacacccgaaaatccaaaattctccgtgctacctaatacaccatatcctatagcaaggtcagctaaataagctgaccccacctttcccgtgtaaaaacaaagaacccaacaccccaccttttctctgtaaaaactggccatgggccagacatagtggctatgcctgttatcccaacactttgggagaccaaggcaggtggatcacttgaggtcaggagctcaagaccagcctggccaatgtggtaaaaccccatctctactgaaaatacaaaaaattagcctggtgtggtggcgcatgcctgtaatcatagctactcgggaagctgaggcaggagaattacttgaacccgggaggtggaggttgcagtgagccgagatcatgccactgcaccccagcctgggtggcagagcgagaccccatctcaaaaataagcaaacaaaaaaactggccaaaaagaaatgttctcacctaccttgcttgagtgtagttcataagacctcattccacagagggtcttgctcctttacccagaaggaaggaggctgcacagaggccaggaagaatctgaacaccagaccagccttgctgggttctcccagtcagttcttttcaaagacaaaacacaaagtcacatttattagagttgtccacagtcagcaatggtgaccttcttgctggtcttgccatttctggaccctcatgccttctttcatcttgccaaagaccacatgctcgccatgcaaccactgagtcttggcagtgcagatgccaaactgggaaccgtacgtgttggtccagcatttgccttggacaacatgccgggacctgtatgcttcaggctacagttttcatcatcaaatttctccctgtagatggacttgccaccagcgccattacggcgtgtgaagccaccaccctaacacataagccctggaataattctgtgaaagcaggaaccctcatgacaaaatcctttccctccagtgctcagagcatgcaagtgttctgctgtctttggaatcttgtctgcaaacagctcgaagggctgtttgatggccccagggcttgccattgacggccatgttgaagaacatggtgggattgaccatggctggtagcagggggttctggggggcgtcagcatctgcaaagcccccagtgagttctgctagcataagagcatacccattttgtccaatcgtatttctacataactgtccatacttcgttgaacctaagcatacaaatggacagttttccctgtatctttgagtcttcacgtgtcacgtgaaactgtgatcaaataaatttgtttatcttttctcctattaatctgccttttgtcagtgattttcagcaaaccatcagagggctaaggagaagctttcctgtggcccctacaataataaactacaaaaagggcagaaatggaagtgttatccaggagttttcatagcattttttttagagtctgctctgcaactggtttgtgccactttcagcaaattccatttaaaagaaaaatcagcgggccgggggcggtggctcacgcctgtaatcccagcactttgggaggccgaggtgggcggatcacgaggtcgggagatcgagaccatcctggctaacacggtgaaaccccatctctactaaaaatacaaaaaattagccgggcgtggtggcaggcgcctctattcctagctactcgggaggctgaggtaggagaatggcatgaacccgggaggcggagcttgcagtgagctcagatcgcgctactgcactccagtctgggtgacagagcaagactccgtctcaaaaaataaaaaataaaagaaaaatcagcatttataaaacagccacatttgaggggtgattactgcttttttttttgaaaaggattcactatagcacatttcccctgtgcaatacaatttcattattttttaaatgtcaaaagcagtctatgctattagaaaacaagcaaatgacacaaagaagtgtgtaagtcaaagtgaagggcctccctttagctctcctctgtttctgccctctggaggcaagctctgataataatttggggagcatccttctggagacccttttctatgagccattcactgatatagttatatgttttatttacattcaattctacttaaaaatgataatcacaggccgggcacagtggctcacacctgcaatcccagcactttgggaagccgaggcgggcggatcacctgaggtcaggagttcgagaccagcctgaccaacatggagaaactccgtctctactaaaaatacaaaattaggcgggcgtggtggcacacacctgtaatcccagctacttgggaggctgaggcaggagaatcgcttgaacccgggaggtggaggttgcggtgagccgacatcacgccattgcactccagcctggccaacaggagcaaaactccatctcaaagaaaagaaaagaaaaaaagtgataaccagaatgtgtatcttgttttatgacatggtatctttttctttttttttgacatggtgtcttttttccctcctattgcattcttttcatagtaaactttaaagtcttatttacatggtttttaactaaactttttagtttaaaacaactgtagattcacatgcagttgtgagaaataatacagatcctgtgtacactttcttccgatgacaacaccttgcaaaactgtaatactgcaaccaggatgttgatatttataaacaatcgactgatctttttcagattttcccagttttacttgtactcgtgcgcgcgtgcatgcgtgtgtgtgtgtgtgtgcgttgtttgtttttgtttttgagacagggtcttgctctgtcgcccaggttagtgggcagtagcagtggcaggatcatggctcactgcagcctccaactcccaggctcaagtgatcttctcacctcagcctctcacctacctgggcccacaagtgtgagccaccatgcctgactcatatatatatatatatttttgtagagaccgggtcttcctatgttgcccggctggtctccaactcctcggctcaagtgatcctcctgtctggggtttccaaattgttgggattacaggtgtgagtcagagcacccagccaagttctatacaattttatcatgtttagtttgtgttctcaccaccacaggcaagatacaaaatggttcctcatcactctcctgttgcattttaaataacacaatttaccgtgttcaataccatgtatttctccaggtgaggtatacatgtgacaggctccaaaaggcttttaatcaccacagtagtgctgcccaagaaaattcaagggccacgaatgaaagttgcctatgaaattagacatttctcaggagccaaaggtaaaagagaccaatttaaataatatatttcagaaaaccgaatatatccaaatatcctcatttcaacatgtaatcaatataaaaagtatgaatgatatgctacttttctcgtacgaagtctttgcaatccagtgagcccagtcctctggcagctgttagcatggactgagtacctcctatgtgtctgactctgatccaggcactgagacacagatcagctcctgccctttaagaacacaggccaatggaggacaagcacagttctacaacatgagacaggccacggtagaagcaagcaaaggaggcctgggaacacctggctagtagggaaggctctgtgggggcttggcctcaaagcccagggacagcagggggaccagtcagaaggagccccaagtgtctgggtgggagcgatggtgttccctgagatgggaaccaagaggagaggcactttggagggaaggcccagtgtggtttggggatatccaataaaagatggcccctcctcaaagttagtggatgctaggctctgggatgcaggggagggttctgggcttgctattgaggtttccctggaggttgatgtcactgggggcatggagattactcaggccagaaggtgtgtgggaagcatggggtgtggggtacagagtacaccacatggagagccaacatcagggggattcccaagggagaaagacaagccagggatcatccaaggaggcaagacgggaggagtgcagggatctgtggacccacccagccccttctgttctgaggttacaatgggtgatggctctgtggggctgcaatgagtggtggcacgcgcggagggccaggggaggagggacatgctgtgggctccgggttcaggtcccaggactgaattggaagcaccctgtctgtgttgaagttcaagatctaccacttctgttcccagacctcccagttcttcctcacctttatgcaatttcatttttgataatttcagcttcctaaatgtacacatctgacttcactttcactcacatgtctcacccccacccctccaccggccccttctattacagacccaggagacacaggaagtgcaaggaaggtctggagccccaaaagccaggagcctcaggagtcaggtgtcctgacagccaggaaccctgacacccaggagccctggcacccaggaaccccaacagccagaagcctctaccaccaggagccctgacagcaaggaaccccgacacccaggagcccctactacagccaggaagccaggaaccctaacaccaggagccctgacacccagtcaccccgacagccaggaagccaacagcaagaagcctctaccaccaggagccctgacagcaaggaaccctgacacccaggagcccctgctatagccaggaaccctaacacccaggagcccctacagtcaggaaccccgacacccaggggtcccgacagccaggaaccccgacacccaggggtcccgacagccaggggccattacggccaggagccccgacagccagggacctcgacggccagaatccactacatccagaagcccttataaccgggaacctccatagccaggagcccctacagccaggagccccttcagccagggagccccgaaagccaggagccccgacagccaggaaccataacagccatgaaccccgggagccaggaggcccgcagcggagtgcccagacttggcagggtcagagccccccagcgggatccagagcccgccgccgaggccccttttgggatttctcaggctcggcagcctcagcgcaggcaggggcggggctttccctcgcgcagccgctcagctccccgtggccccgcccacatccggccgccggcactggattgcttctgtctggcggcggcagcatggcggcgggggcggctgaggcagctgtagcggccgtggaggaggtcggctcagccgggcagtttgaggagctgctgcgcctcaaagccaagtaagcggggcggcgagcggtaggagtgaggagccggagcgggagcggccgcgagaccgggccggtgtggggcggcgggtggcccagcctggcttcttggtgcccggctcccttcggcctcgggggaccgggcccggcgccacccgtagactcccccgagcctccgcgtgagtggcccgagccgcaggttccccgccccggaacagcgagcagggcgcgaggctcgcctggaagccccggccccagccctggctccgaccccgacggctgtccaagcccgggggacgcgaccttcccggcctctggcctgggcggccccgccgcgggacggaggcggtggtgactcagccgtgccgcagtggcggggcgggggacggggcggcgccgagaccccggccctccgcgccacggagcgggacccacggctgcgggctccacctttcctgtgcccgccgggagggagcggcaggctcggcgtcggcccattgctcttcagcctcccttcaggaacgcccctgtcgcaggaagagcggcgagggaaggccccgttgcattagctaggcctggctgccttttgaagtcagcctttaaagtttgttggacagcaggtagcctcagtcttcagacttaacctgttgccggagacagagatttcctgttccatgaactggtgtagtgagagtctgttcagatttggcgccggtgtccaggtcttcaatccctgggaagactacaaaaggagatccagaggaatgcatagaaagcgttttctgggtggactagaagctctgaactgcaagcatgcttacgagtaaatgcttactagcgtgcgtgcctgcagggaaaggtctgcacgtggactctccgtgataataccacctcacattgtagactactccaaggactgagttgttctcttagttgtattattagcggttgttatgggaactcttatgtcggattgcctgggatccagtcccaccgcagccactcagtagccatgtaacccctgggcacgtttcatgcccaagcctcagtttcccgacggtgacatagattagcacctgttagtacctcagggttgttgtgagggttaaatgagatgacgtatgtaaaatacaaataatacaatgcctagtatgcaggaagcactcagtagatgttggcacttagtatttcagtaggaagtagaatggttcatggaattcacaggcaaaaagctttgttttgttttgtttttgagacagggtctggctctgtcacccaggctgcagtgtagtggagcgatcacggctccctgcagcctccgcctcccaggctcaagtgatcgacccacctcatcctcccgagtagctgggaccacaggtgctcaccaccacgcccgtctaatttttatttttttttatagagacgaggtctcgccatgttgcccagcctcgtctcgaccttctggactcgagcgatctgccctcctcagcctcccaaagggttgggattacaggtgtgagctaccacgtccggccagaaatgcttattgatctaaattttgttttgtttgttttcgagacaggctgttgctctgttgcccaggctgagtgcagtggcgtgatctcggctcactgcagcctctacctcctgggttcaagcgatcctcccacctcagcctcctgagtatctgggactacacgtgcggtccaccacgctgggctaatttgtgtatttttcgtagaggcagggtttcctcatgttgcccaggctggtctctggaactcctgagctcaagtgattcgcctgcctcggccttgtaaagtatcgggattacaggcttgagcccccgtgacctgccctgttgatctaaattgagtgaaattttgccgactgaatttgaattagaggcaagtagtactctgattttgcaatggagagtgcaggtgagatggggtgttgcctttggaaatggggaggggtgcgagttactgactaatggttagaaatgctttatgggggtgatgaaattaaagtgttatttaaacagctctttaggcatttcaggtttacctgggaaattgttacggaaaaaagcaggggttggggagggacatgtgacatttactcactgatggaagctgggctctgactcatccagtacagatcagcacaatcacaggagtcaccagaagtggcctcttgaaatgagcaggtcttgtgtggacctgccctaagtaaacgttttgaatttaccatcacctgaaaggctgttttgtctgttttacatgtttgttttaaatgcttcatgttttaaaaagtccttaaactatcaaaatgaataaaagtgtttttttttttttttttttttgggggggagacagagtctctctctgttgcccaggctggagtagagtgcagtgacacaatcttggctcactgcaacctctgcctcacgggttcaaatgattctcctgcctcagccttctgagtagctgggattacaggtgcccgccaccacgcctggctaatttttgcatttttagtagagatgggtttcaccatgttggccaggctggtcttgaactcctgaccttaggtgatgggcccgcttcccagcgtgctgggattacaggcatgagccactgcgcccggccaaaatggataaaagtttaaatgtaagtaccatttggatgttgtatccttgccgctggcctgtacttgaaatggcccaggaaacaatgtgcactttccttagtgactagttcaaacggacacgtgataaatgatgtgtggcatctggggaaggagcacatttctgcagcttttttggtgaagatggagacatttaagaatattaggccgggcgcggtggctcacgcctgtaatcccagcactttgggaggccgaggtgggtggatcacgaggtcaggagatcgagaccatcctggctaacacggtgaaaccccgtctttactaaagaaaatacaaaaaattagccaggcatggtggcaggtgcctgtagtcccagttactcgggaagctgaggcaggcgaatggcatgaacctgggaggcggagcttgcagtgagccaagatcgtggcactgcactccagcctggacgacagacgaagactccatctcaaaaaaaaaaaaaccaaaaaaagaatatcatggtggcttacaccagcaaacccagcactttgggaggatggcttgaggccaggagtttgagagtagcttgaacaacatagaacccatctctacaaaaaataaaaaaagtagccaggcatggtgatgcatgcctgtagtccccagctactcaggaggctgaggtgggaggattgtttgagcccaggagttccaagctgcggtgagctatgatcctgccactgtactccagcctgggtgacagagtgagaccctgtctcaaaaaacaaaaagtgcccgaattttagtacttgtgttgatgtaataattttaaatctactttccaaatcatcgcttctccaattttaaaatttgacatgaattgaaatttttttcttttaagtagttgaatcagatatttacataagttgctgaaatctcagctggtttgtacaatggggttattaatatccatttgcagagtaagcaggtttagtatatgatatgtttaataagcagtagctggtatctgcagatgaatgtagtagcagaatactataataattgaaaaacaactatttgctgatgaagagctgaagtttattacattgtctaaagttacattagtcaggatttgaatgtggtttttgtctgatggtttttctccaacaatgctccaggcatatggggctatccattaagatggaaagaatactgtaacatgtaatccaaaaggggataacgtttatatttgtttcagatatagtatgtccttataatattggacattatgtgcttaattgagaaatggaaggtaagcattaaataggagaatattgtggataatttcaactaacaatatcatgttttaatgttttcaaatgttttatatttttgtttcatcttctcaacatcccagagtgttggttattgctgttttacagatgtggaagttaaattactcttcaaaaccatgttagtaataatgaaactgaaatgaattcagtttctatggcatactttcttcttttcttttttacttatttgggctcatactattataaagtttggtaacctactttaatttttgaaaaatgtagttatattagtattttcctgtggcgttgaaagttctttgaaaatttgatttgtaatggctttatgttttcttatgaccatttaaaaactattattgagcatcagaaatttttctgatttgctacgtaaagtagtgggaaaatatccatgtacagaaaatctttgtctcttaattacttccttaggattgatacttatgtgtaagaaatttctgaaaggtcccaatttaatttttaccagcaggacatgaaagtacttctcgtcatcctttttatcattgaatattatgatttaaacagtccttttgttggctgggcacggtggctcatgactgtaatcccagcactttgagaggcgaatgcaggcagattgattgcttgagcccaggagtttgagaccagcctggtcattggccaaagcccaactttacaaagaacaaaatatgcctgtagtctgggaggctgaggtgggaggatcacctgagcccaggaagtcgaggctgcacttgccttgcactccagactgggcattagagtaagaccctgtctcaaaaaaagaaaaaaaaaattttttttttggtcaatttggtggaaaatggtatcccagctttaaaaagaaattgaagtattacatacagtaacaatgcacagatcttaatcgtcagatgtggtgaattttcacaattgtatacacaccgataaccaccattcacaggaagaatatagaacccaggaagttttccatcccctttagcccagctactgatttcttactgtcactgtagatgagttttccctgctcttggactttgtgtgagtagaatcatacagttctttgtctgtgttatcttttgctcacatattttcaagcttcatttgtgtcattgctcatgtctgtggttggttcctttttactggtaagttacattctgttgtatgaatgtctatcactttctcctgttggcggacatttggctaatttccagttttgatttattatgtatagggctgctgtgagcattcttgcatgaggcctctgtgaacctctgttttgttcttgccatccttaggcaatggacaaaaaagcttccctggatcctcttcattgctggaggctatggtgggcagaggctcctgagggagggttttgaggggtcaggcctgtgttctagttttagggccagaattcagttccagggccccagacaactgcaaggaagactgaaaaatgtaatctagctgaatgcacaggaggaagatgaaacagtgcttgattgaaacagcacagtctctgccgtggacctgaggccccacctactcaaccattgaagctgctgagttgtgctggatgcaaattaacatccggtgactaggggctcctacaatgtgtccttccctgccttaggtgggtcttcatttggagcttcctgctttccttgtgtgcctgtggacactctcccttcatcagtcctaccagtggtcttgccctctgttttcctatgctttgataaatgaccttgcttcccacctgagagaaaacaggatttcaggtagcatctccccaagccctccttccactctcacctctcccaacacttaccatttatttgtagccttacccattcttaattccttggctcctgactcagaggagactgccttcttcttcttcaaggtaagctcttctctgctctggatttcccctctcctgcctcttctgagtccttgcatcctcagctgtcttgtgtctacggcccttccctctccatttgcactatcccctagtaaaataaacatataaggattttcttgtattaaaaaggcccatcccttgattttgtctttttctctgcctgtacagatctcttagagtacatctctgcttcctcatcttcacttcagtcctcagtggactgcagtctgacctgtgcttctgctattccattgaaggtactctctctgttagttgccctttcctgttgcattggatgattgtcactccctcttgacactcttctcttgacttctatgtgacccttcaatcttccagtaccgcctaggaccccttaatcttccagtaccgcctaggaccccttctctgctttactacataagttccttctcctccatctgtcctaacttaatgttgataagccccctgaggcgctgacctcgggtctcctctgtgtccctctgtaaccctttgcggtgtggtgctggcactgttcctttcttgattcccaaatctgtatatcaagtgcagacttcttccctgagctctagacatcatactaacaacccattaaacttcctttcctcaggttggcagcttctgcactatgatttgaggcatagtgccaccactagccatcagtctctaagccagaacttggagccagctgtagactgccttatctgtcaccaaatcctgccccttctaccttcgaaatcctcatgctgctctttgcttctgctttcctgacactttattgtaggcttattctcttctcgctggtattatttgatcagtttttacagtttgttattcctttccttacccataggttagttgtccttggttctttttgccatggaacatatttctgttcgtgatttttcagatttttttgggaggtggtattatatttgaacagaattccataaaactgaaggattttttagttggatatgaccatagatatctttgccaagataattttgtgtgaaaactaactaaaatagatactgagttattaatatattctgtgtgttcatactataaatgtttagaattttttttttttaaatgggtcttgctctgttgcccacactggagtgtagtggtatgatcatggctcactacagcctcgaccccctgggctcaagtaatccttccaccttagtctgccagaatgctgagtacaggcatgagccaccttgcctggcctagaaaaatcttttttttttttttgaggcagagtcttgctctgccatccaggctgcagtgcagtggtgtgatctcagctcactgtaacctctgccttctgggttcaaacaattcttctgcctcagcctcctgagtagctgggattacaggcatgcaccaacacacccggctaattttttgtgcttttagtagagttggggtttcaccacattagccaggctggtctcgaactgccgacctcaagtgatctgcctgcctcggcctcccaaagtgctgggattacaggtgtgagccactgctctgggtctagaaaaatcttttgtagcataatattaaaaagtataaaaaaaagtctttgtgaaaagcagttctattcttttcctcgttttgcactggcatgccttcattttcaacacttactgctgtttctatggtcacggttatgtctctccatcactataccacatttaaaaagtaaataatgatattattagtaatgtgtctacaaccatttttcacaaacattgtgccattaatacagaaattcagtttccactttgcccaggggtctgaaaatatggttgatttgcctggctttttttttttttttttcgtttactttaagttctgggatacatatgcagaatgtgcaggtttcttacataggtatgcatgtgccatggtggtttgctgcacctatcaacccatcatctaggttttaagccctgcatgcattaggtatttgtcctaatgctttctctccccttgccccccaccccctgacaggccctggtatgtgatgttcccctccctgtgtccgtgtggtttcattgttcacctcccacttatgaatgagaacatgcaatgtttgtttttctgttcctgtgttagtttactgagaatggtggcttccagcttcatccatgtccctgcaaaggacatgaactcattcctttttatgactgcatagtattccatggtatatatgtgccacatttcctttatccagtctgtcattgacaggcatttgggttggttccaagtctttgatattgtaaatagtgctgcaataacataatgtgtgcatgtgtctttatagtagaatgatttataatcttttgggtatatacccagtaatgggattgctgggtcaaatggtatttctggttctagatccttgaggaattgccacactgtcttccacaatggttgaactaatttacactcccaccaacagtgatttacatgacttttaattgaggtggatgaatattcagatctacttcaaatgggcttcacttgaaatatcattgaattgaaaatttatctgaaagagtctcaagaccttgcagagtgcttttatgttccagtgttgtatacaacaaaattctagcaatatgaaaaacttcagacggttcttttaaagctttcttttttttctttttggtaatttatatcagtatttgtgtatttccaaaattggtataattttaaataaatgcatttaattgatttacaggtccctccttgtggtccatttctgggcaccatgggctccacagtgtgcacagatgaacgaagttatggcagagttagctaaagaactccctcaagtttcatttgtgaaggtatttatatttcaatgtcatgtcttttgtgaatttaattctgatttatgggttagattagggctgggtgcggtagctcacacctgtaatcccagcactttgggaggctgaggcgggcagatcacctgagttcaggagtttgagaccagcccagccaacatagtgaaaccctgtctctactaaaatacaaaaattagctgggcgtggtggcgggtgcctataatcccagctatgtgggaggctgaggcaggagaatcttttgaacccgggaggcagagattgcagtgagccgagattgtgccactgcactccagcctgggtgacagagcgagacgctgtctctaaataaataaataaataaaataaaaaattagattttattaactaatataaagatggagtggtatggaattccaaatatgtataattggtgtgggatctgttatttttgcacatcattcttaaaaatcttaaaataattttgcattttttttttttttgagacagagtcttgttctgtcgcccaggctggagtgcagctccagctcactgcaacctctgcctccccggtttaagcgattttcctgcctaagcctcccgagtagctgggactacaggcacatgccaccacacccagctaattttttgtatttttagtagagatggggtttcaccatcttagccaggatagtcttggtctcttgacctcgtgatctgctcaccttggcctcccaaagtactgtgattaggcgtgagccaccacgcctggccaaatgtacacttttccttgatcatcctcgggtgtgaggcatgactaccaaatgtcaaggtggctgtgggctggagttttggagagcacaggcagacaaattagttccctgtgggtaactgtggttttaaggcatttaaaatagtaacacaaattatgtcattgaaaagctaggtgtgctgtagaaaataattcaggaaggggtatgtaaatgctgctagggaccagggaacaggaagttgctatcttggtttagatgaaggcagacctccgggagaaggtgaaagtctttctaacctgttcagaatgtagaggaagatggaagccagtcagtctcttccttgcctcttttgtttttcactctggttatgtgtactcctacattcctgctgtctctcttgagtggatgagtgctaggaaagctgtagttttgactgtggattaactcaattggtttagcacgttaaagatattattcaggacttagtactggtttaggcagcagggccaaaatatgtgttgagagtcttagaaatgaattatcaggaggggaggtgcaccttgtattcccaagcctgaatccttaagatttaaaaaacaaatgaaaaaccaaagtcttattttttaaaacaagaatctgtgagttcagagtacatgttacccaatatactcatatatgggattaaaaataacatcaactgtattggtctgtatgcctctttctatgtaaactgaaaacacagaattttgacagggtaattcattcgtatagtaggtgataaaattttcaggaggcttctgtataaataagtttgctttgaataggcattatactcagttggctcaaaattccaaacagtgtagaaagatgtccgttgagaaggcccaccccgttcctctgttgtcacccttgtgtcccaccacataagtaactgcttgtattaattttgtatgaatccttctagtgtttctttatgcaaatagggcagatgtgaatatagtgattagctttttaaaatttaaggacttatttaaaattccaatgaaatgtataatgtaactgtagagtgtaaccctaaaatgtccaatataaataatagaagggggcattaaaactgcatgtttggtcagtgataaaagataatgattacaagtgaaatgaatgattaaacatttcaatcataagattaatcaagatgatggtaattgttctaagtctgcttttatgtgtatcatgttactggtttaggtaacacattgttcttagctgctatctgaatgatttatttaaagtgactatagaattacttctcacattggtaccagacttggcagtgagattttaagttgttcaagtgcttaagtatctctgtgagccaaaggttggaggagccctcagcgattttgggttgtgggggatacctgagcctgactgcacctgccactcatgaggatgatgacagcgtaagattggtcattcttccaggagtcatcactttccagaaattcactctataacatagtttttctttgattagccatcattaagggcaaaggtactttccatggcatttgtaaggcagctaattaaaaggcacttgccggacaatagtaagcaaaagagaagtagaatgagagatcatcgttctttcccagtaagagaggcgtgcaggctgggcgcctcggctcacacctgtaatcccaacacctcttgaggctgaggtgggaggattgcttgaggccaggaattcaaaaccagcctgatgcacatagcaaaaccatctctacaaaagaaaaactaaaaaagttagctgtgcatgttggtgtgcacctgtagtcccagttacttgggaggataaagcagaggattccttgagcccaggaggtctcaaggcggtcacaccactggacgtagagtgataccatgtctcaaaaaaaaggaggaatgtagttcattttaaaacagctttctttttgttaatgagagtttttggaaagttctagagtatgaactaatgttcttctgcttcatcttgtgtctatttgatttcttagtcttttttttggagacaaggtctcactcttattgcccaggctgtagtgcagtgatcttggctcactgcagcctctacctcccaggctcaagcaatttctccaccttagcctcccgaatagctgggactataggtgtacacccctgcccagctaatttttgtattttttgtagcgatacggtttcaccatgttgctcaggctggtcttgaactcatgggctcaagcagtctgcctaccttggcctcccaaagtgctcagattatagatgtgagccactttgcccttcagtcttttttttttttttttttttttttttaatgatgaaatggtttggcatttttggcttgtgaagtaaagggatcagttcatttttgtgactgggatttataaaatcattaaataagtgatcatacactagatatttttaaacagattgtaaacttttgtgactatcaacaatttcttattttgtaggagctggtaaaaatagagttagaagagttagtcacccatttttggtcagagtagttagtttgtgctctttggaattgaatgctgaaagacaaggttttcatatttattgcatctgaatccctcattctctgtattgatgatatggtcgtaaagtgtatttggggtggggcacagtggctcacacctgtaatcccagcactttgggaggtgtgagtgggaggattgttcaaggacaggagttcgagaccagcctgggcaacatagggagacttcatctctacagaataaaaatttaaaaaactagctgtgtacacctgttgccccagctacttgggaggctgtggtgggaggattgcttaagtccaggagttagaggctgcagtgagctatgattgtgccactatactccagcttgggtgacagagtgagaccttgtctcttaaaaaaaaattaaaaagtgcatctgtactccttttgggtgctgtgtttataatgggtggtgttccatttacctgagtcactgccatgtctagtgggctcttctgggctccgtcctgagtttgtcacacctcctagggcccagaggagatgatgtggtatttctatcactaaaaggagttcaagaccagcttgagtaacatggtgaaaccctgtctccactaaaaatacaaaatttagccaggcatgatggcgcatgcctgtaatcccagctactcgggaggccgaggcaggagaatcatttcaacccaggaggtggaggttgcagtgacccgagatcgcgctactgcactccggcctgcgtgacagagcaagactccgtctcaaaaaaaaaaaacaaaacaggaaaagtcttagagaaaccttgtgtttattcagaataaaatgaaatagttaaaatgttttagtgccttttattttcaaattacatagtcagtatcttctctcatactgattcttgtttgtatctttacccaaaataggagtacacctttgtcatttaattaattgtttgatataatcttccaaaatatggtatctggcagaggggggtgggagagaggaagaatagcacaaggctttgttgggtgcctgctgctggttgtatttgagatccaaatcaactattttgtatgaaatcgtagctattttttcctgtagcttttttttttttggtctctgtgccattggttgcttggatcaggaaatgccctatatttttgtctatattgtcatttaattccttttttcattgcctccttgactagatggtgagatacttgacatggggacctttacctcatcaggttttcattagtaaaaaaaaaaaaaaaaaatagggccgggcatggtggctcacgcttgtaatcccagcactttgggaggccgaggcgggtggatcacgaggtcaggagattgagaccatcctggctaacacggtgaaaccccatctctactaaaaatacaaaaaaaatcagccagctgtggtgggacatgcctctattcccagctagtcgggaggctgaggcaggagaattgcttgaacccaggaggcggaggttgcagtgagttgagaccacaccactgcattccagcctggataacagagcaagactccatctcaaaaaaaaaaaaaaaagaaagaaagaaaaagaaaaaaatgactttcctttgttcgaatggctcttgctttccatgcaagcctccctgatcccacttccagcttactgctcccatcctgctaggccatagtatactcattttaccatatcatgtacttcagtgcaaacattctcaaagtcagacttaccagctagctggttggtgagattttatactattgtatttcatttgacattaattttgtttatatagtagctgctgtacttgcattttattttcattgtaatttaaaatatacgatcaagggtatggaggagttacgtatttaaatgtatttttgcttcttgaaaaacaagaatctttattcttattttgaaagtgcgactatcttaaagatacagattgcactgttgaatttctaaagatctgtacaatcattataaatgtaaatgtagtttatgtttaatttctgagtgtataattactgtatgtaaacagatagtgttgggcaatcttccgaagggtaccaactagctgtataaccaggtgcatgctaactagtggaattaaaatttttcagtggcagagaatgttggccaatttatttggcatcttaagagagcatatgttggatttcattctacaggaaggaactctaaaaatgcgtctcagataattctggtagaattgttttttttttttttttgagacagagtctcactgtgtcgcccaggctggagtgcaatggcgtgaactcagctcactgcaacctctgcctcctgggttcaaggaattctcctgcctcagcctcctgagtagctgggattacaggtgtgtgccaccactcctggctaatttttgtatttttagtagagacggggtttcaccgtgttggccaggctggtttcgaactcatgacctcgtgatccgcctgcctcggcctcccaaagtgctgggattacaggcatgagccatcgtgcccggctctggtagaattgttaaatcttaaaaagactgtaggtttttatctgtgctatcttggtaattaaaaaaacccaaaattaacatggttttattagctgtttctgggctaagtttggtgaaagtatttaaagaagttatcaaaacttttttttaaaattattattatactttaaattctagggtacatgtgcacaatgtgcaggttcgttacataggtatacatgtgccatgttggtttgctgtacccatcaactcatcatttacattaggtatttctcctaacgctatccctccctcagccccccaccctccaacaggccccggtgtgtgatgttcccctccctgtgtccatgtgttctcattgttcagctcccacttatgagtgagaacatgtggtgtttggttttctgtccttgtgattgtttgctgaaaatgctggtttccagcttcatccatgtccctgtaaaggacatgaactcatcctttttttatggctgcattatattccgtgatgtatatgtgccacattttctttatccagtctattattgttggtttaaagtctgttttatcagagaccaggattgcaacccctgctttttttgctttccatttgcttggtagatcttcctccatccctttattttgagcctatgtttgtctttgcacatgagatgggtctcctgaatacagcacaccgatgggtcttgactctgtccaatttgccaggctgtgtcttttagtcttttaattggggcatttagcccacttacatttaaggttaattttgttgtgtgtgaattttttttttttttgagacggagtctcactctattgcccaggctggagtgcagtgatgcgatcggttcactgcaacttccgccttccaggttcaagcgattctcctgcctcagcctcctgagtagctgggattacaggcacctgccaccatacccagctaatttttgtatttttagtagagacagggtttcaccgtgttggccaggctggtctcaaactcctgacctcaaatgatccacctgcctcaacctcccgaagtgctggaattacaggcatgaaccactacacccagtctgttacatgtgaatttgattctgtcattatgatgctaactggtaattttgcccgttcgttaatgcagtttcttcatagtgtcgatggtgtttcaccatttggcctgtttttgcagtggctggtactggttgttcctttccatgtttagtgcttccttcaggagctcttgtaaggcaggcctggtggtgacagaatctctcagcattttcttgtctttaaatgattttatttctccttcacttatgaagcttagtttggctggatatgaaattctgggttgaaaattctttaagaatgttgaatattggcccccactctcttctggcttgtagggtttctgccgagagatctgctgttagtctgatagccttccctttgtgggtaacccaacctttctctctggctgcccttaacattttttccttaatttcaaccttggtgaatctgacagttatatgtcttggggtcgctcttcttgaggagtatatttgtggtggtctgtgtatttcctgaatttgaatgttggcctgccctgctaggttgggtaagttctcctggataatatcctgaagagtgtttcctaacttggttccattctccctgtcactttcaggtacaccaatcaaacgtagatttggtcttttcacatagtctcatatttcttggaggctttgttcgtttcttttcactcttttttgctctaatcttgtcttctcactttatttcattaatttgatcttccatcactgatatccttttttccgcttgatcgaatcggctattgaagcttgtgtatgcttcacgcagttctcatactgtggttttcagctccatcaggtcatttaagctcttctctacattgattagttagccacttgtctaacttttttcaaggtttttagcttccttgcaatgagttagaacatgctcctttagctaggagaagtttgttattaccgatcttctgaatcctgcttctgtcaacttgttgaactcattctctgtccagttttattcccttgctggcaaggagttgcgttcctttggaggagaagagacgttctggtttttggaattttcagcctttctgctctggtttctccccatctttgtggttttatctacctttggtctttgatgttggtgacatttggatggggtttctgtgtggatatcctttttgttgatgttgatgctattcctttctgtttgttagttttctttctaacgggcccctcagctgcaggtctgttggagtttgctggaggtccactccagaccctgtttgtctgggtatcaccagcagaggctgcagaacagcaaatattgctgcctgatccttcctctggaagcttcgttccagcggggcacctgtctgcatgaggtgtctgtcggcccctactgggaggtgtctcccagtgaggctatacgggggtcagggacccacttgaggaggcagtttgtctgttatcggatcttgaatgccatgctgggagaaccacctgctctcttcagagctgtcaggcagggacgtttaagtctgtagaagccttttgttcagatatgccctgcccccagaggtggaatctagagaggcagcaggccttgctgagctgtggtgggcttcacccagtttgagcttccctgccactttgtttacactgtgagcatagaactgcctactcaagcctcagcaatggcctactcaagcctcagcaatggcggacgcccctcccctagccaagcttcagtgtcctaggtcgatctcagactgctgcgctggcagcgagcaaggctccatgggtgtgggactcaccgagccaggcacgggagggaatctcctggtctgccagttgcaaagactgtgggtaaagcgtagtatttgggcagaagtgtaccattccttcaggtacaatcactcatggcttcccttggctaggaaagggaaatcctccaaccccttgcgcttcctgggtgaggtgacgccctgccctactttggctcgccctccatgggctgcacccactgtccaaccagtcccaataagatgaacccggtatctcagttggaaatggagaagtcactcatcttctgcattgatctcgctgggagctgcagactagagctgttcctatttggccatcttggaagcgatctcagcctaaactatcaaaactgttaatttaaatttctgttttgaaatttatatttggctgtttgacaaagattctgattttgaaatactatttttttttttttaatatcacacatcacagagtagaaggaagcctcttttggaggtttagccaaatgttcctgaatagcaggtttaagtgttctctccttagtcttgcagctcagtgccatcattggtaagtggccatccccattcttggcttaggtatagtgaccacctttgtttaatattcggtcaaaatttatcaaacactaaatgccgcacagtagtctaggcactgaggatacagaacattaagggtcacagacaacaaatagtagacatatatgttatcaaggtaattttaggtagtaataagttctgcaaaagaaagaaataggctatgaaaatgggaactgggataggtgggatactttatttagattgggctggaagggtgtatctaaggaagagagatctttcttttttttttaagagataaggtctcgctctgtcacccaggccagggtgcagtggtgtgatcatagctcactgcagccccaaacttccgagctcaagcattcttcccaccttggcctcccaaagtgctgggattacaggtgtgagctactgtgccagcagggccatttgaaaaatggaaaggagccagccattgggagagctaggaagagcttttaaccaaagtgcagagtgtcaaagcaaaaggctagtggggctggagggtggtgagagtgtgatgtgaggttggagtggcaggcaggggtcagtgaccttgtggggaacgataacattcaggtcttattccaagtgcaatagcaatgacacagttccattcctgtcataagtcagttactctggctggagaatggtttgaagcgggaagggtgcagaatagaagcaggtaccccagttaggaggctcctaggccaggtgagagatgaaatgatgtcatggtctgagtgggattatattttggaagggagcccagaacacctgttgatggagtaggtgtgagagtgagagaaatggattaatcaaggttgtctcctttttgattttaggaactggatggattttgtgagatagagatgccttgtgggaggagcaggtttagtgagaggtgtttgatagagctctgagtgcaggtgttgagtgtatagtctggaggtgaggggagaggcctgggctgggaagaagttgggagttgtaatagcagcgtcatttagagccataggatcggatgagcccactccaggagaatgagtgtggataggcatagaagaggactcagaaccaaggctggcacatgccggtgttcaggggctgccagagatgacagaaacggacactgagtttgagcatttagggagggcagaggaaacatggagagccaagtggaaggtgttgcaggaaggtggttgtggtcactgttactgaaggatactgaagggtcagtggaatgaggacagggcagcagccatgaagtggaacatggtgtagggaggcgcttggctccagagacacactgtctgcctacatcactcaacaggtttgtaattgtcctagtccatttgtgctactataacagaataccttagactgagtaatttttaagcaacagatttattgctcacagttctagaggctgggaaatccaagatcaaagcaccagcagattcagtgtctggcaagggcttgctctctgttcccaagatggcaccttgttgccgtgtcctcacttggcagcaggagaagaagggcaaaaacagactagccagcctcaaacccttttataatggcactgttcccatccatgagggcatagccgtcttggcctaatcacctcccaaaggcccctcttaattgctatcacctttgatgttaatttccagcatatgaatttaggagggacatatacattcaaatcatggcagtgatctaggccaagttatggaacctctttaagttccagtttcttctgtaaaatggatgttaaagacggtgcctgttgttgtaaggattaagtgagtctatacgtgtgaggattaagtgagtctatacgtgtgaggattaagtgagtctatacgtgaagcacacttagaatagtatctggcccagaataaattgtagctattcgccgttactgtcacagtggcatccgatgacccctgctcaataaaagtagaatagagagaggattccccatctctggatttacctgatgcctcccttgcgctttctttccttctccatagacacatagcaggtgggactggtcccaaggtttggattcttggtataggaagcaagtggttcccacttgaggcattttgcctggattctgttttggaaatgttcatgtttggttggtcctgaagtcttgtataaatcctactttgacatgtaatctttatttttgattgtagtagtagaaaaaattaaccatagtatagtgaaaaaagcacaggttttatagtcaaacaaactttgattgtttctcagctctgccatttattagccatgtatctttgggcaagttacccaagttatctcctgtgttagttagggttctctagagaaacagaactaactaataggataggtacagatagatgagaggggatttaggaggctgagaagtctcaccatctgccctccacatgctggagaactagggaagctggtggcatagctcagtccaagtctgaaggcctgagaacctgggggccgctggtgcaagtcctgcagtctaacggctggagaatctagagctgtgatgtccaaagacaggagaagatggatatctcggctccaggagggagggatggggcaggaggggtgggggatgggggtgtgcggaggagagggagggagagagagaaagagggagaaagacaggatttgcttttttgcttttcctctgcatttttttttcctagttcttttcaggccttcaacctattggatggtggccgccgccccccccccccccccccccccccgcccatattgggtgagaatggatcttccttactcagtctactgattcaaatgccagtctcttcccaaaacaccctcacagccatgcccaggagtaatgttttaacagctgtctgggtatctcttaacccagtcaagttgaaaccttaaaccaaccattgcacctcctctttaactacttactaagttgaaatgataacatgctaaaatttcgcacctttcaaaattgtctgtaggctaggctgttttatgttaaggccttctcatggtttatggcacagggtaggtcgcccatgaatgatagctatttctgataatctttgagctcttctgaatgcagatcctttaaaaatatttatatatttattttctattttcattgttaaaactgttacattaaatccaacaaaaatatttctaacgaattttagtgctgcaagggttttaggacttcagatgcccttgatgttctggagaactcttttgccttaaatgatgttcctgttcctttcttcttaagatttgtctgttaccattgtctcttgttatgaggatcccttcctctgggagctgattgagtggaggcagttgtggtagttctcagccttcagcaggaattgtaagaggtcatttgcttcccagaagaattgttactccactggaaatcagcaggaatataagaatgtaagaagaaatcagatttttttttttttttgagacggagttttgcttagtcgcccatgctggagtgcaatagtgcgatcttggctcactgcaacctctgcctcccgggttcaagcgattctcccgcctcagcatcccgagtagccgggattacaggcacccgccatcatgcctggctaagaaatcagattttaaaagaagataggaatttgtttttatgagtcagggtgctacctgttttgttctggtttaagatcacattaccttatttctacttagtattgccttttttttggatttgtattacttgttggttagaattcagtagtactgaaggaagggcccttttgtgatccttgctgaatgcccagtgcgtagtgggcactccatagatgttagttgaaagacagaaaataatgagctggaggatggtagtgtaggcatgccctagtcattaacttttctggtcatctttgatctgagtgtgctgttgtgtatgtgaaagaaaataacacaaacgtctttaaaacttttgagagtctgttctaaatagctgtctcgaatgccttatctttttgttcttttttcagattattagactattgttgattttatagaattttcatataagtacattttaaaaatggaaataattaaaaatattgttgcaaaagtgttttctaaaaaaataagaattaaggtagtaaaagagcacccaagaatgtaggagatagaagataaaagccaaatacataggactctgcttcccactttctctgcaagctttatttgggtagatataacctgattgggtaaggctctaaataaaaatagtatttcaagcccagtggaaatcttttactcttggaaaaatacagtgtatatattttaaaaactttttaacaatataatttatcaataaattttatttcctacaggtataatgtgaatacagatttttattggtttcaaaagtttatattaaattgacagtcctatgagggaaggatatagcttggtatttctcaaagtgtatcatttataaagacctacgtaaatagcttacagtaattgtgccctaattatttagaaattgtgttactaaatgtgttttaaattcatgcatcagatatcacatcctgtcttgttcaggggccttaaggaaattatcaaacacaatgcagtcatcttatttaaaaggtatttacattgtaaatagaccggaagcaagtaacctagcaagatatctgcctagtgtccagcagccttgcaggagttaaaagcaaaatttatcagacatcaatagtttattgaagaaatagtcctttttgcttcataatttgcagaaggctgcaactgtcagtcatgatgtactgcctcttgaaattagtcaatagagcaaacagcaagaattgctgtgggcagaaaataagcactgtaatcatgacataactggggtcagtgatttatggatttcaatatagtagtagctgcatatgattgaaaatttactaggtcactagtgcaccaaaaattttattcacagcctccaggcatcttttgaaatgtgcaacaaaataaaaacctctgaacctgttttgacactgcaaactcagtggatgacatgccagcccagtgagtctcatttaaatgtaaatgtgtcataaacttttgtaccatgctctttaaaaaatgccagctacttgaagggataatgcatgtgaaactgatttacatattaaagtagtgaaaaaggaccttgtaataatcaagcttgaattcttttattttaaagttggaagctgaaggtgttcctgaagtatctgaaaaatatgaaattagctctgttcccacttttctgtttttcaaggtaaggataaaggtggtacaagagattatccatttgtagggtgccatggggctacctattttgtttctttaccctctctctaatccccgaatattaggtgtttggctgtttctggccctccacctttcttctgatagtctcatttttgcaccgatgctgagaaagaagaccatgccagctgcttgccagcatcttagaaaagtagcatggactgtgtagggccagcagccagaatcagagcttcttgatcaaaattcagatatgtggctgtggaaccccagtgttccctgagttggttaaattggttgtttagagcatgtgcctggacataatggaatctctggctggttctggtttgatgaatgacttttaggaagcaggtgcacacctgtgcttccaggcacccatgggtgtcatcgtagttccccaaatacctcatttatacttagtaatagattcattccagccaatgtgggggcagtcttttttgtattatgttagactgacctgatttgactttgagatgttgcagtgttttctcagtgtgtttctgagaaaagaaaaaaattatgtatttctaaaattgagatgcagtgcaggcaattggcaatgagggtttctttttttacatctccggtaatactgttgtcccctttaaaaatctgctataacaatgtcattattatggaatgctgcatgtattctaaataactttttaaactttagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtaagaagctgcctttaacataatataaacaaaatgggtgctttcccagaatggggtatggttgagatgggcatcctgtttccaaggatgctataccatacatcttatacttgtgttcacatacttttagaaaatcaaaaaggttataattcccaatgacactatataagaattagtttgcattatggactcagcatgttggaaccaaaaggggtctcagaactcatctaattcagatttttgttttatactgaagtcctcagactcaaagatagaggtgacttgcccaaggtcacctggtaagcagagttaggattaggttccaactaccatattgctgtctcttttgcctgtttatctacttttgctgttaacagttattttttctttcttggcagcctcctgtttttcacctagttcagattcagcaattaaaaaatttgcggaatttttcagtgtttttgtgtccagcctgtgtgcttttgcctcccctgtgtcatcactgtctaatgattctcttcctgcattgctgtcatttccagtttatagctgctggtaatggaaagattccgaattcttggcttgtagtcactcttattttctgtacacatggatgcttataattttgtccttaagtaagttttagagttatttgacccctctggtagtgggtttatgttattttctttttactgtgcctagtacaacattagtatgctgcataattgagcatttaatgccatttgatgatgctgttgagactctaagagtatttgtatcaactacacaggagggactttattaagataggggcagtaacattgagtatgctcttgatatgattacagcatgtccagagtgactttataaagatagccaagcttctagtgtgaatttgattctaaattcttccctgtagggttattaaattacatattagcttatgataatgtctagttttaaaaataaagtttcatgatgaattcttattttttcgagatggaatttcgctcttgttgcccaggttggagtgcaatggcacgatctcagtgcgacggaacctctgtctactaggggtcaagcgattctcctgtctcagcctcccgagtagctgggattacaggtgtccaccaccatgcccggctaatttttttgtatttttagtagagatagggtttgtccatgttggtcaggctggtgtcaaactcctgacctcaggtgatccgcctgccttggcctcccaaagtgctgctgggattataggcgtgagccaccatgaattctgtcttaaaagtatctcttagttctgcctaaaaaatttccctgccagtatttatgtgtcagataatgcctgctatttgtgtattgcaaagctaacttagtctgtactaaactaaaggtagcaacagatagtctctgttgcgtttgttattttgtttttaacgggggttgcaaatggttcacattcaccttcttccatgaaacatgaaaattatttcttgtactttgtgcggtggccactaaatgggaacttaccacttcagttgaatggattgtattcagcaccttcattcagatctcaggtacagtagaactggctgtgaaatgtgggtgaagcacacctacagtgaaatctctacagtattctctcctttggggttgaacagcagcagtctcagtcttttctgaatgataaacctaatgaaaaggcaggtggcaacactgaagcttggggaaggagtgctcagaggagaaggatgtcctgggaagtgtgctgcactgggtgtcatgccaggcgagcctcaggcccacccctgcggccttagcaactttggggacaagtcaggtaccctccttgtgcctttaattccttctagtgctgttgggaacaagattggctgttggagccaatcttggagggccttttcagtgtagatattgtatgattattcaagtaaattagagagaaacttagacattttaatttttctgcttaccttttactttattaaactgaatttaaaatatactgctagcatttttatatttatattaaacttatttaaattatgtttattataatggagtgagatttggaagactgtacaaataacagaataaaaaagaagctttgaaatatttcagggctgggcgtggtggctcatgcctgtaatcccagcacattgggaggctgaggtgggcggatcgcttgagatcaggagttcgagaccagcctggccaacatggcgaaaccccgtctctactaaaaatacaaaaattagctgggcatggtggagtcctgtaattccagccacttgggaggctgaggcaggagaattgcttgaacctgggaggcagaggttgcagtgagccgagatcgagccactgcactccagtatgggtgacagagtgaaactctgtctcaaaacaaaacaaaacacatttcagagccatctgaaaacgtagtattatagttatttaattaataaaagacaataaatattttgagatacatatggttgaatggttacagtttcttcttttaaagtacttctatataatttttataactacattttcagtgggtttttctgtttcctgatattttctgtttcatgtctttctgtcacatatagtaaatagatcatttaagaatgttgctgttctttaataaaatacttaggattaattggaaaatatttttaaactgttttcttatgggaacataagtcacctcgaccctctgctgttcctttctgagcctggttagtggagcattgtttttgctcttcttctggcattttagagaagggcgtaggcaaagctccctttataaaagcactggccatctcatcttgtgaacacgcacgtggctgctctttccttattttgcaccaaattagctttgaaagtgctatctctgctaacaccactgaactcccactgcggagtattttgatgtttgttttttgattagtttgtccccaccttgctttctgctaatcagaaaaacatgaatgaataacatttaaattttatatctagaaaaccttgaaagccatttttagggtctctcctggagccccactggactcagcctaacccctgcacaggtcatgtctccatcttcttatccttcatgtgggctctacctgcagaattgtatggtgtgttatgagcctgacgtgtagatagggtctcagttgaaaagaattggattgtccttactctgtgctcctcatgaagatgggaaaatgcttgttttaggaagagtttccagaagcactgaggtatatgtcatcttaaacagaatcttaaatccttgagcaggttaattatttgggaattcttataactatttcagttaacaaagcttttagcaaagcaaaaggtatttgaggcatagtcagatattccttctgcagtgagagtcatccagccgggctcttacttttgaatcagccacagaatcaggtttcagagatgttttttagggtttattgttaggtagtgatgagatgcggtgttaggcacctattcatgtcatgagtagaaatgactgggggtggaaatggggattctgtggcagttaaacattacttttctacatttaaatatttttattgcatgcatgcatttttcttaaaaaaaggtgtgtaaatattttgttactagaataaagccttcttgccatcttatccttaagcgtaacatttctagtctgccactttaactcttaaaaatgaaacactaccaatcaatctttctagtctgcatgtaattgcctaaagctaaaataaagcttcttctcagccagttacagtaaaaatgagttaatatattggcaacagaataaccatcagcaatcagccgttagctgtttactaatgaactcccagatgaataaaaaaatttcagaatcagtgttttacttcaggctgtacatgaacttaacacttcagatgtaggaaaagcaacttatatgctatacaaataaatactagtgcttcatctcaataaactgcagatttggaaaatgtttagagctcacttgtagatccatgttttaatagtaaatatgattttgggtgacatcagtaaagcccattcttgcaattaatcttatattgaattttatggtttgattttatttaaaaacaattgctgacactgctaagtcttatagaaattttgaatctgaagaataggttcttttccagtgaattacaactgtgtttgagaagaagaatgaggcgtgaaagagtagggccctacatagtattgggaacaatggagaagaattagcttatggaaagaaaaatactttttttttcagactaggctaataggtttataaaagactgatattcacactcttattcttcagttataatgtcataataagatgatgtcaaaaaagtacagaataaaaatgtgtcacaaaagtataataaaatcatggaacataaaattgtcgctatagtgtagtaaaaaaattacattacatactttagggaatgtaaatagttttaaaaaagaaactgtcaagttatgacatgagatgagaaagaataccgtcaatctattgatggttcatatataacaacagagaagatagctttaaaattcaatgtactgtgtgtattttagactacaggagaacacatgccttcttgatttctaatttatcctacttagagatagtgaagattgagaactactgaagtgggaactcaggaagtagtaaaatggcagtagaaatgcaacagcattgggttttaagtatagtcaagtagtagttaaaaataacaattgtagaattttttcatctgcccagaattgattctcatagattcataacagaaaggctgggagggactgtcagagcatcaggtcagtctcctgattagtaggaaagtgctgagcggaggccacccatggcctcatcatgtgtcaccttggtgggtggagggagcaggtgtcagattcagatttctggttttgtttaaagacaaggtcttgctttatcactcaaactggaggctggagtgcagtgacaatctcataggtcgctccagcctcagacttctgggctcaagtgagcctgttgcctcagtttccccagtctctgggattacaggtgtgcaccatcacccccaggtctctgctttttggctagtgctatttctcctgtgacaaaaaatgtccatgatattgaagaataactttaataaatacacacaccactttttttttttttttcagtagtcacagttgtgtcaaaaagttaagtcatatctgagtgtgtgatatggttcaaggtcaaataaggggatccaggaatttattttctctttgtatattattcagccatgctaattaaatcaccagcaaaataaggcaggcgtctatgtcttttagatgatatgtacgctgaactaatgtattatcatgtgtatgtgttttgggagagagaagttaagtgctttatttctttttttgtgtacaggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggttagaattgagaagtctgtgctttgtaaagaaattccatttagagcatactttttaaaatgttgtgataaatctaagatacaaatttcttatgaatctatatttactaataagaacctgcaatgaatacacagtatttctgattagttgattgatcaataatctgtgttatggtatgatcaaggagatttatgttataataatttttttcataaaactggtatgtgtgcttattttaggagctagaagcatctgaagaactagatacaatttgtcccaaagctcccaaattagaggaaaggtaagtgttttagaaggtttcaaatagcctatcatttaatatattaaaaatattttaaagtcctcaggttttgcattgctctttctgtgtagaaatcaaggatttggtatgccagacgtcataattgtttagtcacattagccattcaaactttggcaaatctaatttgtattggagaaattttagcaccaacttagtgatcatgtggaggatctgctttgcttttatagaaatgtcattgtttctgtggaacaaccaagttttgcttacctctctgcatttcagagccagggtccagttgttttgtcactgctccttggcgtaacctcagcacactcgtgttttactgggtgcagccttggtgactgctgcgggtgctgccccaacgccagagcactgagtgacaagtggtgagtgtgaaaaactcatcacctcgcaacaagctttgagcacttctcatggcctttctagaccacgagaacttacatgaacagattttggaggtgtgaaacatgtatttgttttatcaaggatctcacttggcttttagagacgttctcttacagaaatgttggactttggtgtgtaaggcaacttaatgggatttttattgcagtaaaattaatatagaactttaaaaaggaatttattatatcagcaatcagccattcatagttggggctggagattgtaagataaaccttcctttggtaatttttttttgccatgtaacatcttgagaatttctaaaagtgtttaataataataaatacctcatttgtctgtcgttaattaataatttctataaacagcgtccaatccacgtatgtcaggctgatctttgagtgccgcattctgtcctgtggttggtaccatttcctgtgttcttcatgagaaaatgatactcctcatcccttttttgactctgggcgtcttcatgtgtggttcttgcctgtagcctggtgatgcccttggcccatggaggctgtgtggtctccaaagacagctgtgttttttatatgcttgtatttgctcttcagttgattttccttctctgctgagtgcacttgccgctgttaatggccttgtctccatcagacctccgtttcctaatgtgctgcttctaaatctgtgcttgcagacaccaaagggtaacgggctagaattatgtcggaaggaaaattcagcatatttggagtaataatttaaagggctccgagtgagcagagtgtaggaagtggagttcatggacttgtgacatgtattttggcagtactttgtgagctgtggttccctgtatccaggtgactgggttagttagttgggttgtcagggtcagcattgtattcctatatctgttcatatttttctgaacttgagctaatcccactcggttggcaatgtaagtgatacagctttgtgcgtgattgatgcatttcatttgggatgagtttataaggatatttattattatttttttttgagacggactctggctctgtagcccaggctggagtgcagtggtgctatcttggctcactgcaagctccgcctcccgggttcacaccattctcctgcctcagcctcccgggtagccgtgaccacaggcgtccgccaccacgtccggctaattcttttgtactttttagtggagacggggtttcaccgtgttttgccaggatggtcttgatctcctgacctcgtgatccacctgcctcagcctcccaaagtgctgggattacaggcgtgagccaccgcgcccaacctctaaggagatttttgagctgtgaattgggagaacatggtggcgtgaccccatggggcttaggttctttagtgacccgttgtcccagcactgacttttcttgagatttgtgactaaacttgtggctgtatacagataattaaaattcctgacagcatgttagattatgatgtttgaaagactatataaaatataaaacatgttaagatgagagaatttgattttagtatctggcattagttgatgttctgaggtttaacgctgtcaccctgcagtccgaccttgtgagctttacacgtgtacagtggtatgcagcatcatgatggaagatggtgcacacaagatctagttctggaagttttggatgggcttaatatataggccccttattgaacaattccttactgaattggttattattattatttttttattactgtgagttgatgggcttaaattgcaacttgaaggaacattcgttgccttaaaagccatattgtgttttacagtggcttagggagagaatgaaatcaaggaaaatgtcaacgcatttgcttgtttaataccactcaaagctgtgaactgtcatcctgccatccctcaaatatgcatgttactcacgaagcggaggaaaagtggtgttgcataattgagctgagccgttttatatcaattttctctctttaggctcaaagtgctgacaaataaagcttctgtgatgctctttatgaaaggaaacaaacaggtaaagaactcaaaaatggttttatttgtaatttcttttgatgttaacatctgcaacaaggggacagttaaatctttttcctagctttagctaatgaagctgtagcgatatcaggaagttatccacgccttaattggtgcttacggagatcaaacaaagtaatctacattttgcttgactttatcatcaacatctcagtggggtgcatttctttctgctgccaaactttgtcagctaatgtggtcaacactgttaacactttactggttgtatgagttgttatgtcattatcctttgtttgagtttgtggactgctgaagtgtgcagctgagtcagtggacttcctgaatgcagggaacctggtcgtgcttgggtttgcacccctagatcgtccttttgtgacagtggaggagcaaaccctggctgtagcaggtgtgctctgtgtgtttgatgaatgagtgaaatggtcagcaattctcatttttaatgggatggttcttacagctttttgatgtaagtacatattgattatgcgtcattttgaatatcaagtttgatagattacttccaccgatagtttgagcagaactaattttctttcagattgagatcagagtggtaatttccagaaaccagccatacacatttatatcatattttgtaattttcatagcaattgaacctctacttaattctcaatcagttgttgaagtaggcagggttggacagactttggcctgttttagagataaagaaaccaaagttttgaaaggtgaggctgttggaataaagaaactgcctcacttgttagcaagatgcaccgggcaagtgacatggagaaccactttgctcattgggaaagggacacaatacttcacagggcagactctggttgccataactagtgtataagttaacataactagtataatgaagctaattagttaacataactggttaatataattaggtaataatgaaagtaacagtaacaaagaaaatgttaatataaatttcagcatgttggaaacattaggttagggcctaaattctttgattttggttcagtgtattgaaacaatagaggaagttaataattcctagtaatgataaagtgacattttttcttattctcggtaatggtttaagtggatatttattctcaaaactatttttttctggaaacctagaaagtattaatacattttggaaacaatgttattggggctattaaaatgttgacatggtaccatatcttttccacaagattgctggaatttggagtcctgtggcatgaaaaaagcttaagattttcataaactcaaaaaagtgttagtattctgtaatgtaaaaataaatgaggctggatgcggtagctcatgcctgtaatcccagcactttgggaggccaaggcaggtccgaggtcaagagatcgagaccatcctggctaacatggtgaaaccccatctttactaaaaatacaaaaagtttgctgggcgtggtggcgcatgcctatagtcccagctactcgggaggctgaggcaggagaatcgcttgaacctgggaggtggacattgcagtgagccgagatcacactccagcctggggacagagtgagactctgtctcaaaaaataaataaataaataaataaataaataaaataaaaagaaaaatgggagtcagaatccagttggaaatgggaaaataattgtcataatcattgcaaaaaggctaagtgagttaagatcattttgcatgagtgaattaaacaatgaactcaaatctctgtagaaaatctcggtttcacttagaggaactttttgaccacagagaatataaactgttggaacacatgtcatctcaagtggttacaaaccaaaggaaaaggaagtctgtgggtcacgtgtgcctgggttgatgtgtagatgggttcgtacttgaagaggggatgagcagaagctctgggagctgagtgaaagtagtggcagctatgctggacaagtgctgtgctggttgacaagagtattaggtacaaccatgctgcttgggtcatacaaaaattgtaatctttgcaaattttttttcatttaggaagcaaaatgtggattcagcaaacaaattctggaaatactaaatagtactgggtatgtaaatgttgttttcaaatggtgtattaaaaaaattccaacctggccaggcgtagtggctcacgtctataatcctagcactttgggaggctaagacaggaatattgcttgagcccaggtgttcgagaccagcctggacaacatagtgagaccccatcgccacaaaaaataaaaaaattagccaggcatggtcacatacatctatggtcctagctacttgagagactgaggtgggaggatcactggagtcttggaaggtgaggctgtagtgagccgtgattgcaccactgcactcagcctgggtgacagagcaagaccctgtctcaaaaaaaagaaaaaaatatttcaacttttcagttctgccactgatacttttcagttgtaatgtctatatccatacatatctgtatctttctttattttttgctgtattgttttgtgaatgccttaacttagatcaaaatagtattttctggccagtgtcaacctattagtaacataaaggaggtctttaggccacctttggaataactatttgtctactttcccagaggaaaatgtataactgagtcctcaccatgcataaagatatttcaggggaatatattataggtagtttttaatttttctcaaatatcctagttgctaaacagtacagaaagctgaggggcacatattaaggtccattacctggatctgagaggtagcacaagttaaattgcagtgctcctagttttgatgtgctcagtggtgaagctgtcaggtaagaacattgccattgatttttgtggttaaaaacaaaagcacttatttggagatatacagcacatgttctatagggtttgtcagatatttttgtttatttctcatttcatgattgtatcttttaaaaatcatgtattctaactgtagcttcaaataaattactttcaagtaatctttgatatacttcaaagatctattgaaaatagttgaatagtacaggttgaatacaatttcagggacataaaaagaatatagggccaggcacagtggctcacacctgtaatcccagcactttgggaggctgaggtgagtggatcacttgaggtcaggagttcgagaccagcttggcgaacatggtgaaaccccgcctctactaaaaatacaaaaattagccgggtgcggtggcgcacgcctataatcccagccactcaggaggctgaggcctggagaatcacttgagcccaggaggtggaggtttcagtgagctgaaaccacgccactgcactccaacctgggtgacagtgagactctgtctcaaaaaaaagatgtggttgtcgtctttagattactatgacattttatagaagcaagtatagtcagtttattgtaattgtaacttcaagcctgttcctttcttcacccctgccctgggccatacagtgggggctggcttgtttttggtcatttttgattttcccctttctttgtcgaccctctgctgcgggtccacagtgagacacacacagtccatccctctctagcagtaccaggttcctcaggtgtcttctgagccgacacactgggcctgactcagctcgtgtctttggtggaacatcttggtaacttggctttctgtcccatatctgtctaatctccattgtattgaaagcaccctgttgtcgcagagagcaggaggatgctttgggagagcatgacctcccagctctggacttgctaagcgtgattggccctaggatgagtgaggccatccaggacctcagcttctcttaacacgagcagaccatgctcttgctgggcgccaaatgtatgtggagaaaactcctttttactttttctcatttcttatcttttcctttagtagccaaaatacacatgcatgagtggttgagaaccaagtgtatattgaggtttgaaaggtaccctttatgaataacttttaggaagtatactggctgttaggactccacatacatacacttgggcccagtgcttcctggatcctttatgaatagttgtataactcattgtttttatcacagtattaagagatctgccacctttagttcaacttgaacaaagacttacattggggtttttaaaaagcattaggtttacattggggtctttttttgttcttctttcaaacattccttttttggtaattgcttctgatttatcccgtcatttagtttttttgactgttccctgtaccatagacagtttccttgggaacttgtttactaaataaacaagatttccctatgatggtttcagttttatggaaagtccagttttttttacatgtagcattttctttggccacctttgggaattgcacctgtaccctcaggcaccctgcaaggatttaggcatacatgcttgctaatacctgaccacctaacggtgaaatcgctctgagtggatacagttggatattcatgcagtgatttttcattttttgtacaagtaatgttcattgtatggtataaagccacaaagctttcattggccttttgtacattaaaaacagcaccctctctgaaataagtttaagtgtggaaagcatgtctcttgctaaggtggagggagctggcagcgtggttgttatccggctgctgagccctccagcctccgtccacgagcactactacatcctgctgcacgggcagcttccaggaggttaagaagcagcagcctggggtgggttagacattagaagtgggtaagagtgttcagttaatgaaggctcgtgcagatgggggtgtgggtctgatccaggggttggcaagttgcagctggctgcccatttttgtaaataaagttatattggcacatagccacatcccttcatttatacattgtctgtggctgcttttatgctgacagttgcagcagagagcagaactgagcagttgcagcagagactgtctggcctgtaaagcctgaagtgtttagtgtctgactctttaagaagaagtttgcccacccctggtctaacccaatattgtccggagaaaaatccagataaagtcatatgttggaatgactaattctgtgtagtaccagacagattaagaagtaaaatcatttccattggtctgtagtacattttgttagcagtgaaacggttttcttgattattttaaaaacatcaaatgcatagaggttttacactttgatttaactgtatttccagttaaaatgtcttctcttttttgcagtgttgaatatgaaacattcgatatattggaggatgaagaagtaagttctgtgtttgatgtttcacccttgtcttagctttaatcttaagggcctgataggatggtttcaggattcctgttgtttctttaggttcggcaaggattaaaagcttactcaaattggccaacataccctcagctgtatgtgaaaggggagctggtgggaggattggatattgtgaaggtaaggccagttcttctgctgttctaaagaacggaaaagattttggtatgtttaaaaatgatttcatattgaatggaaacttgagagttgtttttgactcctgtttccagcctgactctcagacatttctagaccagtatcaccgtttctgtgtgcatgactaccctgccattctcactgtccccacgtggcagcctgttcttactttcacacctgagctaaccattgcatctcctttctgtggggtgatcttccctgtcactcagggtccttgttagatcctgcttcagctcccagacaacaaattgttttttcttgccttactcatctgcccttgggtgcatggagtgacagcagtgtgaggcctgtggcccggtgctgcccatccttgccacagaggctgaggatcactgcccctggtcccccgaaagaaaaaatgtaggtcctttttggttttgagatgcttggaaatctgttatctgttagattgtgttttagataagacaccatttcttatgtatcttgagtccttcctgatgctttgtgtattttaggagttcagtaaatggttgttggatggataagtgactttacttcttgattgagttttaaatggacgttactttgcatgtatttaatgtctagaattcagggcaggcccaccaactaacacctgtgtgctctgtagctctttgattagcccaaaacaataaacagaagctgtagctttaatatctacacacagaccccactgcaccccaggcccactgtgggcatggtggcatcgaggagggtggtagctggttgggtatagagaggagctagacaggaatgctgggcaggaatgccagggtctgctcaggggcatgaacaaaactgccccgaaaagtgggttgctgactgccctcaggccttcctcttgcctcaatccatgagagaattttctgaggtcagatcttcgactttttatgtggaaaacaaatagcaagtagtactacttctagttatgttgtaaaataaaagttttttttttttttttacatttttttttgagagagtttcgctcttgttccccactggagtgcaatggtgcaatctcggctcactgcagcctctgcctcccaggttcatgtgattctcctgcctcagcctcctgagtagctgggattacaggcacccgccaccacgccccactaatttttgtatttttagtagagatggggtttcaccatgttggccaggctggtcttgaactgctgaccccaggtgatccgcccaccttggcctcccaaagtgctgggattacaggcatgagtcaccgcgcctggccaaaataaaagtttttaacacgtgcttttgtaaagtgaagcactagcctaccactgaaatgacatcagcactttggaccaatatgttttataaaaacaaagcttgagttccattgatgcagaggctctttttgtcctttggtggcctctgtgtaggttttgtttcctgtggagttccaggtttgatatcatacttcttaaacaagccagtgagacatttttcctggggaatggtctcactcctggaggaaaaaatttttaagactatagctcttgaatagccctgaagcagcagaaacagatctgcatttgtttcttccctccctccctccttccctccctccctccctccctctttctctctctctctctctctatatatatatatatagtcttatttttgtaagacacaaacaatactcaaaccccaaatactcttgagcctgttcttgtctgaatgttttatagcctgtaccttagccattggtaactcttgggaagatacaatcaataaatctcatttaattctaaagctaagctgcgtgggtaacttctttttagttatataacagagtgttatatgattttttatgttcacctgctaagaacatatacgtttgaaatgtgtgatattgttaacgtttttccttgagaagatatatggaatagatcttacgatcccattttgatctgtttcttgcagaatgcagttcttcatgttcagttcaattaaaagatgtttgaaatggtctaatctggctggcctctttggagcaatgagcgtttgttttgttgaatgagggactgaatgatgatttagttactcagctaatctagtgtcctgagaaaattgtgagttgttattgcctctgaagagtaaacggttcactactgctgttccagaatgtttggacttaagacagtttgttgagagagatagaagatttggttaggtttagactttccacctgccggctcgcattaacagcagtgagggtggcgaggactgccttatttggcgcgctcccaatgttccaggcacactgctttggtgctttaagaggctgcttcacgtaatctcccaagcagcctcagagagcagaattcttcttagtcagtagatgaggaaacagagacatagagaggtcaggtgaattgtccaccatcccataactagtaagccattgagtccagattccacctgagggccacctgcccttgcccactcagctgcgtggtcctctccgtgccttcttgagtgtgtgctcagaaaagtcctgctgggtcccttggaggggcagggtgtctgcttgttgagtaggtagaagaagatccctagacatgactgaaagccgtctgggttttgtgtgacagcatcattcctatttgaatttcatccagaggaggtcatacggattttaatggttttattgattgatgtttatgctgttcagtgataacctgaaatgttatatcatactaaatgtttctttaaaccagaaaatcttatttatcatgtctgtcctttcaagcttggtgtctataatccagattttaaatctgaaaaacaggcacaaggagcatggcgcctgtactgcagttccagtcaacctggtggtagctcttttgatgccatgtctgtttctgaattgttaggtctttttaatggtttctgcctttccctcttactggtactctagcttttcctgaggcagagatgtgttgccaggttgggtttcaatagcaaagcctgattcctctctgtgagtggaagaacgggaggggaacaagcatcatatttgagtagacttttaacgtcacactgctttttttttcttcctttttttcgagacagagtctcactctgtcacccaggctggagtgcagtggtgcaatcttggctcttgggtcactgcaccctccaccttctgggttcaagcaattttcatgcctcagcctcctaagtagctagaattacaggcacatgccaccatgcccacctggctaattttttttttaatagagatgggttttgtcatgttggccaggctgggcttgaactcctgacttcaagtgatctgcccccttggcctcttaaagtgctgggattataggtgtgagccactgcgcccagccacattacttcattcttcaaccttgaaagtcacttgatttattttccttatttattgctacagtttaaataggggcttcattggctccagttgctgcgtttcctaatactaaacaatctgttggttttaggataccttaacttcatttatttatttatgaatgaatgaatgagatggagtctcgctctagcccaggctggagtgcaatggcacgatcttggctcactacaatctccacctcccgggttcaggagattctccctgtctcagcctcctgagtagctgggattacaggtgcccgccaccatgcccaactgatttttgtatttttagtagagacggggtttcaccatgttggccaggctgttctgcaactcctgacctcaggtgatctgccctcctcggcctcccaacgtgctgggattacaggcatgagccactgcacccagccttatttatttattttttaagagacagatttcaccatgttggtcaggctggtcttgaactcctggcctcaagtgatctgcccacctcggcctcccaaagtgctgggattacatttgtgagccaccacacctggccaagaataccttgttaaattttttaacctgatagtgtattcagggtttatggctcatttagtttgagagtgttaagagactggagttttaatccaataggtgtttcttttggttctcagatatacatacaagctgtgattgtttagatgtttccatctttttatatatgcatatacatattattattgttgttttttatttttaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactactttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttggtcgttcaggttcctttggtcctcctattgagaacagtttgaagtccatgaaaattttaacaatatttttgatcctgaatctaacatatttgaaaaatagttgctccactaggcttccacagtgcaggcttcaaatgggatggctaaattcacctcatggttcttagttttttttgtacttgtggcacattctcttcatatattaccccaccctgtttgtttgggcagttaagatgctggtactgtctggtggcgataaggaaagggaaacagaagtcagtaattcagacaagaataaacaggatgaaatgcatctattcctaggtaagattagcccaccacctccacactgctgctgtctcttcagctcaggctgtttttctctgttttgattgtgtaaagagtagagtgctgatttgtgtgttacagagggtggtctgtacaagtcataaagctcgacatggccttgcttcctgctaggtgttaggacacccatgatggtggagtctcttggcattctgtgtaattagataaggctgtttatagcattggtccatgagaacttccttgtttctatttaaaatgaaaatcattgtataagtaaaacttcttaaatgtagatagaaatagaattttaactgaaattttatgaagccattggccgcagggatgtgtgtcatggaggagggctccatacttttttggtatacttatctcaaacttaattcatttgcatactgctttttctctaagtgccaactgtcctagtatattttctaagtcaacttttactttcactttatcctaagcaagaatatctttggcatcacagactcagtaagcccgtttttttctaatgcacatacaaataaataaaatgcacaacttttaacataaatggctgcctccaatttgggaaatactgttctggccagaggccgttgctctgataatgtcatgtggttagtgcattttaggaagacctcctttccctttggttgactcctgcaggacataagatatcagtgacgttatcctttgttgagccatcctggtttgagtcaggatgagtgttgagagtttttggggagttgcccctgtgtcctatattattttatcctcttaaattctgatggtctttggctccactgactccaggtaagttggggtgacagtgcagcatatttctattttctagttgtttctggccagacatggggaaggtcaagacatcttgttcatgcaaacggattgatggccattcctaatctgattttattagtgtattttaggaagtaaagtaagattcttgagcccagctgaacttcccctattgaattttctaacaaaaagagagtttgcgtatgggtttataattgagcctgctcttgtagaaatgttttatcagaattgaaatcctctctgatccccaaattctagagacaaagttgttttctgaatttgagaaatctgttcagttcacaaggaaaggtgacaatgtgtcatttggatgttgtcccacacgtgaggcctcgttgggtgcttgtggtgggagggaccctccaggcaggctttgtatggagggttttcatgtctggacacatttctgttccgagaagcactgctgcgtttttgggagcgtggaccctggccagagcctgtggccagctctgcctgccctccctttcttggcctgctcttttgagtatgtagtggggctttgtgtggcatcctgccaggttaaagctgcatggtgcttaggatagagctggtgctgtggggaggctcttgatgatgggggctgccatctatttgcctgttaactcttagaaaccaaacctcaaatgtcagaatttcctttctagaagaggctggttgaataggaaccagaaaggccctcatacaggcagggctgttcactcctcttgacttgcgtgtttgtgccttccttgtaggaaggcttcttagggaattgttatctgtttaggggaaataagcctgcaggaatgaacttttttttaaaataaaaactcttgatcaaaaatggaaagaaaaaaaccagtgaaacaggctaggtagtttgtggaattctcctttgcaggtgaggggagaaagcagctatctcaagggcacagctacagattgggagctggggcttccatccagggtctgggacacccaaaccttaggcttgcccctcccgggaggcctccccctcagagctatgtgggatgcagttgcctttttacctgtgatgagaaactggtgaattgccaggattctggctctggcttcagtctgcccctttccggggattagagggcattaaccctacttcctacagccaagcagctcttcctcatgactctactttctaactccgggggttgactgattgatttgaagaccgccttgttgatgaatgtgttgaaacttgctatcataatgtaaatgctccttaataaaataacaggacctggtgggttcagttgccttgcccacgtgtgacttacatgtttttgcctttttttgttgaacactgagccttgcagaaccatcaggaagtccaccttggtcccactggattgatcattaagaaggaaggaaaaaagttatttgccatttccgttctttacaaaaatgtcttaagtctgctgaggagtagactaaaaaatagcatgtttttataattagaaagcctcattttaataacttaaaaatgtttaatctctgaaacaactgtaatacattttaagcgcttggtaatcattatctgccttattggaaagaattatacaaataagacctatcttgacagtcaaaagttacaagcttaagattgcaatatgaaacatgatttctggtttagtttttaaagtaaaatcagctttcttttcctttgttttttgagacagggtctcctctgtcacccaggctggagtgcagtggtgcagtcatggctcacggcatccttgacctcccaggctcaagatcctcccccgtcagcctcctcagtagctgagatgacaggcatgtgccaccatgcccggctgtgttttgattttttttttttgtagagatgaagtctcactatgttgcccaggctggtctcaatctcctgggctcaagtgatcctcccacctcagcctcccaaagtgttgggattacaggccctagccaccatgcctgacctaagatcagttttcttaaatttgacagttgctacttttcaaaattcaaacctttctaaataaaagtaagttgattatttgcagatgaattcttgttttatacacatttcagatgttgagtttgaggacctagacccttccctttttgtctagtcacatttcctcacggccgtccactgatcgttgaatcagcgtaaatatggacagtttctcttgagtctttgggtcttcatttctgaaggctcctgtgtcacgtaagacttaaataaatcttacgcttttctcttgttaatctcttttgttataggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacgttgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatggtggtgtgcacctgtagtcccagctacttggggagctgagatgggaggattgcttgagcccaggaggtcaaggctgcagtgatcgtgccattgcaccccagcttgggtgacaaaataagagcctgtctcagaaaaaaaaaacaaaacaaaaaaacctaattgccaggacccgcaaattctgactgaaaaagaccttcttgttctccccacggtcattcatctaaatggttgtcagtggtacagtgttcatcttttctcaaaaagtcaagttttatttgaggaagttacagatttccatatgaactcctagagagagagcctgcccttgttcagggttgcccgggggatgcctgccatgtggtaaggtaagggtttctctgcccctcatctcccagcctgctgtccccaggagcgagttccttaacccctagccctgtcgttgagcccaagcttgtaacctggatatgggagctgtctatttaggaagaaggcatgtgtggtaatttctaaaagaattaaaatagatttttatgctcttgtactatgttttgtgcttaaaaggaagagccccgatataatggagaaaagccagaaggagcttggatgccctcagagagccctgtcacctgtctgtaggggcagaaaggaggatgcctttcctcacccatcacaaggggcacagccaacacctagaatagattaccaaggaaaagtataaaatgtatgtaaagacttaggtgacacaggagccttcagaaataaaaacccaagagaaactgcatgttcacactcagattcaacgaagagtgggtggctgtgcagaaatgtgattggacagaagggaaggatctaatcgtagactggatggggaagccttgccccgtgtgtagctttcttccttccaggtacagggcagggcccttctggaatgaaggtctgggatccattttcagataaagtagtgttgaggatgtctttgtggccggctcctgtagtggacctcagatccgggtgctcgccagttacagagtccagttgacaagagcaaggtctggtagaaagaaagtgactattaaccagaactagtcatggggatatggctggattcccacccaaagtaactactttgaattctggagagaaggcaagggtttaagaagtggggagtaggagcttgagctgggaggcgcgcagggatcgtgctgagtacaatgtgtgtcttgttccggcggctgtcctgggcctccgtccacctggagtgcgggctggtgtcatctcaacaagtggccagatttgactgctcaccttgaggtaagctctgggattttgcagctgggtttccacgcttggtctgtctcaagattagtccctagaacttcgaagtaagcacgtaattagagactagctcacagacacatgtgaagagagtatacggtgagaaaggggaggggtatggagtctattttaagattaagggaaaaggcttctgcagtttgctctaaggttgcatctcaggactaaagagaaaggaaaaaaaagtctaaaaatgcattttgaagttaagctgctcagttacactcctacacaaaggccagggaaagttagagtcatatttctagttttttttttttttttttttgagacagagttttgctcttgtcccccaggctggagtgcagtggcgcgatctcggctcactgcaacctctgcctcctgggttcaagcgattctcctgcctcagcctccacagtagctgggattacaggcatgtgccaccatgcccggctagtttttgtatttttagtagagacggggtttcggcatgttggccaggtgggtctcaaactcctgacctcaagtgatccgcctgcctcagcctcccaagtgctgggattacaggcgtgagccacagagcctggccgtatttctaggttttatggctggcctcgcaggagaggggttctggtttctatgacctgcactggggaagaggcattctactttccgtggcctaccttgaggggtggtggggtgcgggcaagggaaggggccagagggtcagagagcccttgcctctgaggcccttccggtgtcctgcagttcctcagtgtgccaaaaccacaggccttggggtatcattttctgagccccagcatatccctctattttgcccttaggtctggaggaaggttccagggcatttgcccttggtgggtgcaggtagggaggatctgcgggtcttcctcatgccaggagtcttatcccagaatcaaaggctcctggtgggtaggagcgtgtcccatgtgcagcacgcttggctgtccgaagttgctgatgagaagcagcataggatctggcagggacggtcctgagtggagaggctgagatgggaggtggtggcccacggttagcgggctggattttctgggccagcctccatgccagcattttgtcttcatcccggaaccctgtgcactgaggtgcaggaagcgtgtgtagtttcacacacttaagtgtaagaaagcatgttcctgttgaaaataacaccccgctgggcatgctgtggggtgacggcaggtttttgccctcctcctgcagctaagcactggagccctgggttcccatcggggctgtggcactgtgctgtttcccgggccactgccagggaaggagcctcctatattgctgggcagggcctgcgtgcaggtccaggtttataaattttagagcttgttcagaaagcaggcaaaaagtgctgttggaggtgctaagatataaaggtttttccccgggtgtgtattatttgctacttaatattctaaagaaaaattagaacattaagttattaacatgaatgtttctgcttttctttgcactgtgtagtggcaatttcaaatgcaaatataagagcatttaacttgtgtgtgggatacttgagctggcccatctatgtctatctcagcttctgccaggatgctggaggcactgcacaaaaggaaatgctcttgatccatgcacattccctcagcgaatgctgccttaaggctaaggttaccatgagagagaaggagctgtgggttgccctctcattgcctgccttctgtgtcatcttcagtgtgagtagttggctagtacaggcaagagacaaggcagagaggatatgatggcttcctccgtcatccgtgtttcttagaatgcaattgctctctttctgggctggaagcaagttctcatgtgattggaaagcgtggtgccagggctgtcagctccagctgtcctgtcgtagctggttacatgctgatgttgccctcgccttgagtcttgtcacctccgatgctgaggcccactggaacgctgcttctggcgcatcgcgaaccctgcatgttagccgggtggcaaggagtagccagttctctgctcacccacatgctctgtggtgcccctgcactaacagcacgagttcagataaaattattaagaatttcgagatgacgaaagcagaacgtgaaactgagtgtggtccttctgagtgcagggccccatgggaccgcacaggtggcaggcctggaaggccagccctgcttcaaggagtgtggctgaaggaggtcggggaactcaggccctgaccccagggttctcctttcccggagattctgttaaagggccactcaccttagccatgatcttctttgaacttgctccgaactgctcgctagagaaacacacacccggtcacctgtgaccccttgttctaggtgcattcctgcagggacatactctccacctgatgctgaaaccaccacagcaaacaggtgctgtcatgaatagttgacatgtattaagtcatttaattctcaccacaaccctatgaggtaggcatcttcagccccatttgacagatggggaaactgaggcatgggtgaagcacactgctcctggtcatagtacctgttggacctgggatttgactctgggcctcctggctgcagtttgccctcttaacccctatgaggtgtgaggagtcagtgaattggctcctgtggcttgggagggagacatgttcctctgggtgtccagggacagcactgggtgcagggtggagtgctgggctgtggatgggcccatattggtcctaatggtaggcagagagggtgaggaggtgcccaggaccggctttgccagaaggagagagaacgctggcaccacaggagcagcccaccgtgaaggccatgccctgcccgaagcgcggtgcctatttagaacccgagggccccccagcacgatggcgttttgggggttatttttgttggtggggaaacaagctcaggaatttgccaaagctcttatccaaggggcgagtggctcagccagggttcattaccaggctccggatcctgcttctcccggatcacagcaagcgctgtgcttaggcctggggtgggggacggattctccctgaaggcaggtctgacgcgggcgggagcacccaccccgctgggttcttacggcggatccgttacctgggtctccagagggtgaggtcgccgtgggcaccctgggagcagcagttcagatagaaatcctcccatgccgtgtgcaaacactaagttttttgttttgttttgttttgttttgttttttttgagacagagtctcgctctgtcgcccaggctggagtgcagtggcgcgatctcggctcaccgcaagctccgcctcccgggttcacgccattctcctgcctcagcctcccgagtagctgggactacaggcgcccgccaccacgcccggctaattttttgtattttcagtagagaccgggtttcaccctgttagccaggatggtctcgattttctgacctcgagatctgcccgcctcggcctcccaaagtgctgggattacaggcgtgagccaccgcgtccggccgcaaatactggaagttttaagtcaagcgaacaaacattaaactgttctgtcctcttaccttgacaaatacacctaccagtgaccgggaaggctgccttgtgaatttagaaagtcctgggtcttggcagcttcaggggacagatcgccccgctcacgtttgcccctcttgcttcccaccctgtttctgtcccttccccggggccctggggcacacaggggtgggatcgggggtccaggccgggaagggctgctcaggctccgggcacgcactcctgggggcggcctgtgcacatcccttttggaggggtctgccccacgcatccggggaggtacgcagcccctggtgccagggtccaggtggtgctactggggagggcgcgtgcaggaaccagcagccctggaaccagacgccagggtaggagctggtcacgagccctgcctggctgggtcgggtccctgtcctgggtcccagagtgccctggacgttggggctgcagggacaccccggggccagcgacggcaggtgatgtccagggccccgcgccaactgggagctttgctgccgctgcggccttgtgtgaatttggagggacaaggccggggcgcgaactgaatctactgtcatatgcggagtcaatgcaccatctccaggacctcgaaagcctcagtttccacgtatgcaaaacggtccatggtgccctcgtaccctggtcgctgctgcaccatcgaggtcagcgcgcggcaagtcccaggtaggccacgtcggctgcagacctcggcggcgggcggtggcggcgcgtgtccacgcgagggcgctgcgcaccgcgcttcagcccgacctcgccttctgcaggggcggtctcctggcgccagggggcgtgcgaggaccgaggagagcgcaagagtaagcccgcgggtgccggagcgcgcgccccgccgtgtgctgggtccagggcgcgcggccggcctgtccgggcctccttcgcagacgaagcggctggaacgtctcgggggcgcgccaagccgggggcgcatgcctgcacacgtgtgcggggctcacctggtgctgcggccggctcgggcgttgcctgcacgcaccgtgctctacctgcgggagcggagtggagtccgcggtgcctgcgtggccggggcagggcccacagggtccggctcagagccccgccccgctgcctgcggctgccgagcctttccaagctcgagggggccgggacctttgggaaaccagcgcctgaggcttgggggcggccgtgctgggagtggcggctgccgggaagcagggcggatccctggacacctggagccctgccccctcgtccccggggacccgggggtctgtctggttggggtccgagcggcctcagggtgggcgctgcatcctggcccggggtgcacggttgtgcgggggacacacttgtcccgtcctgcccgagctgcgacctgggccagagaagggagcggagctggcatagccccagccccagctcactggggcgccttgcccgcctccccaagcctgggccggcttggccgctgcagccaccgggcctgggccccagcactcgagccgcagggcgtcgcaggcctggcctcgcttccccagagtcggccctccccaggaattttttgttccttagccctagtgaaccttctgcgtcccctcgaagaggggagccaagggaccttggggacagttgaggttcgggtttttaaaacaccaataggctttatttttagaacagttctacatttacagaaaaaatgagcagctagtccggagttcttattacaacccctgctgccccccccccgtgaacatcttgcacaggcgacgtgcatttgttctaatgaacgaacaaatagtgacacgttactattagctagagtccatacagctgaggtcccctttctgtcccaggatcccaccgggtcgccgtctgctcacgctccttggcggcagcatttctcagactctccttgtctctggtgatcgtgacggtgtgagagtattttgaaggctctttctcgactggggttttctcatggtcaggttggggcagcggtgttttgggaggaagcccgcagaggcaaggcgccgcccccctcccatcacatcgaggctacacgctgctgacacgccttctggctgcggcgctgaccttggtcacctcgcacgtctccaccccagttctgctttctccctccttctatagggtgtcgttggaagtccctgtgtgcagcctacgctgaatgagtgtccctgagggggaggagcccataaattgctgggttctgcgtggagacttctgcatattcatctcttttctccatttttttttcttttggagacagggtctctctctgtcacccaggctggagtgcagtggtgcgaacacagctcattacagcctcgaccttctgggctcaagcgatcctcccacctcagcctcccaagtagctgggaccacagccatcatcacacctggctaatttctttgtattttttgtacagacggggttttgctatgttgcccaggctggtcttgaactcctgatcctccaactttggcctcacaaaatgctgggattacagacatgagccactgcacacagccttctctgcatttactcatctatttgatcattctgtcagtgtagactcataggtattatataaggggttaggaggggtgtggttataggctgctggtgtacacttgggcacttgttgtgtgtgtccctatgcttgtctgtgtttgaaatgtttctaatgaagtgaaataaagatggggttagggccgccactgaggggtgaaccaggctggtagacagtctcttaccagagcctgcccctgtgtcagggagggctgggtctggattgggctgtgttgggcctttgtccctgcctggtgccctgtctgtgctaatggctatggtcctaacagaggctcctggggcctagggggtggttcctgttggcctctaaaacccgccctactcagtgaccgagagagcaagttgggacccactgggaccgggccctgcccttcaggtggccctgtggcctctccgagtgcatggcagtagaagtggtgggggacattgcaacctgcaaagtgctgggctggaggccacttgctgagccacgctgtttctggcagggactttctgacagggctgatgtgtgtcctgaagggactcctgcctgcgtttggggctgtccctgaagcgagagcacggggtgtctgtgggggctggctcccctctcctgagcccaccccggtctctgtggatggctgccggcctgggttgatggatgtgggctcattatcttgtctgtcttaggggaaggtattagcttggcagttcataaaagattttaattaaagagggaagaatcattttggcaaactagccttgttcccacactcaaatgacctgtcaaagttataagttcggttaatttccacacaaaaccttgctattttgggggaattcagctggagtctggggcgacacagccctgggactgggcaccctgggtggaaacctgtttccctctctcttcttgcctgtgaaagcccctggcagccaccctgtccctgcttctccaaagccccactctctctgcccatctgcccacagtccccatgggtcccagtgttacccttgaccccttttccacatgcccttcccgcccaggtcctggtctcctgcagagctgcctcatctccaggcatccacgtagactgttacatcctcttctccatgtgccagtgatgggatgcttaaaatacattttgagagagttatgggctcacaggcaatggcgagggatggtacagagagaccctgtgtaccctgccctgttccccacagcaggagaatcttgcaaaattggagtgcagtagcacagccgggacatcccaccaatacaccacgagccttgttctggcttcagttttgtgtgcactggtctgtgtgtgtgggcacgttgaattctagacaattccaccacaagcacccacagccagatgcagaacagccatcaccgaaggctccctcctgccctttcacccacagccaccttccctcccacccagctctcccgggtcggcgggtgggtctttttaaaccacaccgcaggtcacgcctcctgtagcctgcagtggcatctcccaggccttcccaggccttcccaggctgggtccgcaggactcctcaccatggcggcagaagtggcccctgagtgacagcaggtgcacttgccctgcccggctgtctcaggacctcctcacccctgcctggatgctgcctagcccaccccttccactgcctccctcacactcctccccctcccccgcccgccttccccctatgctctccctctgactaagggaagagtttctcaggagcctcgctgcccctctctctgtctctgtctctttctctctctcagtctctttctgtgtctctctgtctgtctatatctctgcctcagtgtctctgtctctgtatcacgctgtttctgtctatatatatctctgcctcactatctctctgtcccttcatgctactaggacgtctggctgccctttcctccctcctgcatccctggcatgtggaacggtgctcgatgactcagatccctgctccctaccttggtctttcctgagcgtgctcagggctgtgcttggggacaggatggggacctgtggcttctctcacctcctctcctgccaatgcctgctgccctgcaggcccctggaggtcccaggctggtgactgggcatgcagacgatggaggagcccccaggggtcctcgaggcaccccctggaaagtggccaggtgttgatttgggccgagccgtgtgtgggtctcctgtggcctggccaccagcagggacagaaatggcagggtgatcactggctgacccagagattttgtttccactgagccttggccttcgttgactgttaccactgggctttgagtcagacgtggcatgctgctagagagcgagaaagagcgagagtgagagagagagagggaggggaggggaggggaagggagaggagagaaggagggagagggaggaggacgggtggtggggaggaggaggttctgaattctcccagacctcccggccggcacctccaggccaatggaatatttagttctgaatccttccctggtgc

SEQ ID NO: 773 - DNA, 1943 bp, Homo sapiens
ggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacgttgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatgaaaataagagcctgtctcagaaaaaaaaaa

SEQ ID NO: 774 - protein, 339 aa, Homo sapiens
GGGSMAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 775 - DNA, 23536 bp, Mus musculus
  misc_feature (1)...(23536): n = A,T,C or G
accaagttaacagcagaggccctagatttctgggcatagttaagaagaacaggaaacaacacagagcaggtacctgcaaggcagtaagaggacagcctttcaggagctgtgcctttggaagccgagtgtataggtgcacctgtgtgcccgcctggtcatgtgcttgtcccaatgtgagtacaaccgaaaggggctacccacacgtccatccccactctcctcctgcctccgtgcaatatgcacggtgtgcaccagtgtggatgcaaggctggaacttagagtttctacttcccttagtttctttgtctcctggtttcaaaagactaaaagtaggaccctagcaaggtaccgcacagtactgactcagaaattcttaagcttagtgccccctagggggagcatcaggcattaagagagagaggtgagcagcagcccccttacacacacacacacacacacacacacacacacacactctcagtgacaccagggggtatggcctttgtacccgtctgatcttcctatgatcccagctagggtgacaacatcacttcccccaaggcactcttcttgcctccgagcactcccagtcctccctcccggccttcaaggtgggatgccgcccaccatcctcacctgggggatggcctagcccttctctgctaagccgggggtctgcgaggctccgcccagggcccctccccctgccccggacccccgtgagccccgcccccgacacggccccttcctcgccacagcggactgcgcgggcagccaggtcggggcaatgctgctggactgcggctgcagcggccggctcggggtgcggggcgccggccgctctgcggcggaaccggcggggaccgcgcgaggtgcgggggatgggggccaggtcgcggttgtacgggggaaccggggaccgccggctctcacctcctctcgggcggggccctcgtccgccgatgccatgggctcctctgggaccccggagccgccaccgccgccgccgccgccggcgctctctcccgcggccgagccagggggggacatggcgtagagggggcgcgttgagctcaggaacctcccggggggctgccaggggccgggggcatcctgcgctggtcctgaggagggggcgcgaggggcggggccctctctgctccccaccccccgccggggggagggggcctagaaagggcacgggggaggctggagatggggggatgggtggggagggcggactgaaggggccgggctgggggggccggggccgggggcgggtgtcaccttgaggccctcgcggcgccgctccgcctcccgcccgctcccaccgccgccttttgtctgagccgagnnnnnnnnnnnnnnnnnnnnnnnnnnnnnnntccagctgtcctcttagaagggccctggcgagcgggaggatcaagcagcgtcggtctcccatctttggtcccacaagtccttgaagttgaaggttggggagaagagaatgagtctggacattttagggaagacccttattcctaatttgtatggtaaagggttaaggcagaagccggactctagaggcgctgaagctaaatccaagaaaggactactggagggcagagagaggagccgcagggaggctctccctccttcccaagagcagccccagaaaagcgatcaagtgcatccagttctctagaacgggggggggggggtgtaaaggacacctgagtcctaactcttaattctggccctgccataagttgtgtggccttagacaaacactttctctctctaagcccttgttctgttcctcccgggtacaatgaaaaagtccactagtctgccgaggtagggaggtcaagtcacagaccacagcaagctgagtgactgccagtagccaggccctgtatgctgcccacccactgctgcttttccctgcgttgactaagacacacaagagactggcagtgttctgcctgcgtgcattcctggtgtatccataagtaaacaagtactcggcacctactgtatgtcatgtatagaaataaaatgcaatttcctaccttcaaaaggcacagcctagttgaggagaagacatgcaaaccagtcattataatagattgtgataaagaccgggcaatggttgttctgggtgtgaatagtcactgtgccaacccactgtgttactggggtctttgtcagacagtaactgttcttccttacccggaggagaccaaggcatgaggaggacaagtgagtgcttacggaaccacctgccagcacccacaggatgactcctagacttcagagctttctctttgtgaagggaagtgacacacatctgagacaagaggatcaatacttaaggccagcctggactagataccaaaacactgtccaaaaaaaaaaaaaaaaaaaagggtgttaggtagtaggttggggtgatagctcagtgacagaacacttgtctagcatttgggaagaactagcttcaattcccaattccagaagttcctttggagcaggggatgaccttgaggcagtgttgatatcatatctgatctctggggttaggaaataagcatactgaggtgccaggtttccccttgcctcttcggatcaggaaagccactccttgtatccccccacctctgcctgctccccccaccccagtgcttctgcttccacgccccatttcctattcctccctcctcagagagaacagatggtcttctattcacctactgctttgaagtgtcagcctgaatgaccctctttagatcaaaaagtccgttctctccctgaacaggacgtgcggagtctccagaagggaaaacttctccttcccacccatgacacaagagaaatcttgatacctcattctagtggctccagcccactgcttcgcagccaactctagcccctcactctggtttcagcctgtctcaccacattctgtcttccctgtacagacagaaggcccaacacaggactctatgctgtctcctaacctacatgaacgactcatactttccatttggctattgccttccccctgatgcccattactgtctgtctctcaggggactcgacctcaaacagaggacagctgtaaaagggacaattcctggggctggagagatggctcagctcttaagagcactgactgctctttcaaaggtcccgagttcaattcccagcaaccacatggtggctcacaaccatctaatgccccttctggtgttctggtgtgtctgaaaacagctacactgtcctcatatacagaaaataaataaataaatctttaaaaaaaaaaaaggacaattccctttggtcaacttcagaactcccaagagactactcccatcttctctggtcataaacaatatctttccttggaagcgccagggaatgggggattgaaaggagggggcagtgaaagaagttgaccgcctggtcaccatggaaactgggcctgtttccctgaagataagcctagtgcagtgggcaggggtgggaagtagggctatccaaagagaggcagagaacaccagcacccagcacggagggaggggctgggtagcgccactggcagaaggctgatgttaataaaagtcagagcctgaccacattgcagcttgagtcaaaggtagcactgccactgggtccttcttctaactcctggagtgacaggcttcctgtcagagtataggcactttggttgaggctgtcggtggctcaatgctgacctcatatggtcaatgcagggattgccacacacctgttagggctcaggcccatacacccagtcgggttgaaatagttatccttaaatgtggcttctttgtgaattagaaaagtggtcccttgcactcctgtaagtcgggttcccccatcgatgatgtttagaccttggtaagagtttcaatgaagaaaacttataagacataggattaggtcaaaaaaagcaagttctgtttttctaactatgggttcttgggcaagccagctaacttctctgggcctcgggcaggtttggtttttttttgttttgttttgtttttttgtttttttggttttttttttaacccgtagtttatacatttgctctagattttgagaatggaaggggtgcatacaggagaggacgttgaaaaattctgaagtcacattaaccccaaaggagcgtctgtctgttcagttattctttgttttgctcagcgtgttgatttggggggggagtgtttagaactaaggatcaaagctaaaatacattcaccgggtaagcagcatctatccctgagctacattcctaatggctgcctcagttccctagctgtcctgtcatgactccagcctgccttaagcccagcacatcttgctagtcctccagggggacttagagcagtgagcaatcgagaggatgctcttcttttttaattaattaattttatatcccaattgttgcctcccgccaggtcctacctccacagagtcctcccccatccccttctcctctgagagggttaggcacatcctctcccactattgggaaattgactccacagacagacaacagctttaaggacagcctctgttccaggtgttgggggatgcacatggagactgagctgtacaaatgctacatatgtgcgggggagggctcagtccagctcatgtatgctcttcggttgatggttcagactctgagagctcccgagggtccaggttagttgactttggtcttcctgtggggttgccaatgccttgggggccctcactccttcctccaactcttctataagagtccctgaccagtccaatgtttggctgtgggtgtctgcttctgtctgagtcagctgctgggtggagcctctcagaggacagttatgctaggctcctgtctgcaagcataacagagtgtcattaatagtgttcgggattggtgtttgcccatgggataggtttcaaattgggacagttattggttggtcattccctcagtctctgctccatctttgtctctacaattcttttagacaggccaaattttaggtcgaaagttttgcagttgggttggtgtcctgttccctccactggggctcctgcctggctccagggggtggtctcctcaggttccatgtcctcactgttacacatcttggctaaggtcacagcattgactcctgggaggagaggaggctctcctcaactctttccctcgccatctccagctcaagttgaaccaactctgtctctttccccactgaataagtagttggccctactatgtgacaaacattctacattgtgattgccagaaactttcaaacattttatttaaaggaattttattattaaaggagtggtggtacacacctttagtcccatcactcagaagacagaggcaggtggatctctgagttcgagaccagcctggtctacagagtgattccaggacagccagagcgcacagagaaaccctgtcttgacaaactaaggtaaataaataagagttatttattttttatttttattttatgtgtataagtgtcttgcctgcatctgttcatatctagtgtctgtggaggtcagaaaagggcatcatattagatctcagatggttgttagcccacctgtggatgttgggaattgaacctgggtcattttcaagagtggctccatatgtttgcaaacgagtgaatggatgaagaaaataaggtttttttggggggggaggcagaagagaatggctcataatagctatctctgctagctcccccatcccccagtaccaaggatgcaatgaagctgttcctatggttggcaatggtcttctaagggcattgctagccccaagaaaagagcagcaagatgctccatctcagggatcgcctgtgggtggtgttctctcaaaccctagtcatgttgaagaaaagcaagaagggaggggaaagacttcagggctagggtggaaacttcagtagtgtcaggggcctccccaccctggctccactgtgaggaactaaacttctttgactgctgggggcagccatctcctgtacctaccaaaggccagtgcacaccctgcaaggaagaagaaaccccatgaccaccaaggcttgtgagataagtcctccctagaaaacccacttccccagatcacatcctcctgccaagtctatcatcaggggagttgacccagaactgtctatgaaggtttcccagggaaaagctgctcccctgaagataatagatgcactctctcttaccaatccccctgagcactgattgaaaataagtgaaaaggcaagagaagttgagaaaaaaataggcagaggatagcaagcagagccaccatcaccaccccttccccatctgtgctggctagtcaggcaacttgatgggagccagcgtcatctgaaaagagggaacctcggttaaaatgcctccataagatccagctgtaagcctctttcttaattagtgactgatggggaaggcccaccccatcccattgtgcatgatgccatccctgggctggtattcctgggttctataagaaagcaggctgagcaagccatggggagcaagccagtgtgcaagacgctccccatggcctctgcatcagcttctccctccaggatcatgtcctgtttcagttttgtcctgacttcctttgataatggattatgatcttgaagtataagccgaataaaaccttctctccccaatttgctttttggtcagggtatttcattgcagcaatagaaacgctaagacaccccaccaccaccaccaacctacacaaactccccacaaagtagccggtttatgcagaaaagttttttaaaaatacactttttaaacaattgaatgaataaatgaatgaagacaccacggaactaaaaagaaggaacaaacaaatgcacggaattagtgaatgaaataaaagggaaggggaagaatgagtgaatgaatgaatgggcgaaacaatccacgcaggagtgagtcaagactggtaaccagagactccctgcctacgcaagcagcaaacagggggattccggaggggcggggctctacccggaagctcctttgagggcggggctgtgggcgtggcagtggctgcgggccacttcttgggtccgggggcggggcgacagagaagacctaactagggaccgttcagctgcccaaagcacccgctgcggtggacctggccggcgccctggacctctcgcttttctcatccgctccccgcgcctgcacaggcaggtaatgaagccgctcggagagtgactctggttctgttaggcggtcacacaaacccggaaaagctcgcttttgcacacctcagagttagatcccgctggaccctggaccccgggctggcgcggccggcatgtcggatgcgcggaaggggccggacgaggcggatgatagccagtgtgactctggcatagagtcgctgcgctctctacgctccctgcctgaacctactgcggccccaggctccggatcatcccaaagcggctgcccacagccttggagacatgctccggagacccacaaggaaccagagaaagaagatgcggatggagagcgagcggactccacttatgcctcctcctctctcactgaatccttccccttactggagagacccgaagccaaggatccaagccctcccgccccaggatcgccgctgccccccgcgggggtgctgagccctcagcaactcgaggcgctcacatacatctctgaggatggagacacgtgagtaaactggctaggctgagataagatgttcagttagagcccccctccgagctgcaactggctgggctaccaccaccacttcatcacccgagaggatagaccctcacagcacctgccctggaagggccagcctccttctccaaactccaaacttaacttgcaacttgcttttaagctgtagccaggttcagaccaaaaaccagacatcatcacctcttttgggagtggacaggatagcagtgcccttgtaacctagaacaccagccacagtcttgaaaatctactagtgacccactcctgggaagaggaattcccccgcaaccaattcagtttttgtttttcttgttgggggaaggaatgtccctgtttgctcaatatttgggataccaatgcctaacttcagaacaccctaaccagaggggggaaaaaagactacaccaggattacaggttgtcatctgagctcaggaagcctggattaacggtgctacctggatgcccatttgaaagtggttccaaaagagggactagactgagaatttttgcccccaacaaacaggataggcagctggctgccccagctcacttcctcctctgctgagaaaagggaagtaatggcttggcctcagcctccccaacagttacctcctgagctccccaaattcttcttgctgtcccatctcttgatctcccttttctcccttaggtccagctggaatcaggtgcagctggactgtgaggctatcaagtgtgtaggtgtcaagtgcagaagaggtgactgggctttgtgggtgttagagcaggggcagctggagtgctagctagatgagagagacgctgggatgcagggggtacctgtcctgacctgcttgttggagatgtaggggtcttggttgggtactagcaaagatagtctccatcctgtgagcaggagagaggccttttgtatttcaggcgccagtcacaacccttaggccaggacctcagagttctgggagctctgtgcacagcttctcgggccaccgcgccctccacggttagcccctgtgctgcatgcagccttgacacactctgcttagagacagatccagtgtgtctggagaagcatcagccccctcccccccagcccccagcagacatcttccctcctttggaggtggctggactgtgggaagtatggaagtgggaaaaggaagtgggcaggaggaggggagactgagggagagagggaggtggctgcaggaatgtgacccagagagcaggccctggccgaggggatttccacagtggttcctccctccctccgtcactctctcctggcctcctctactgcctgcctacagcaaaagtttgccccccccctcctgcctaagtatccccctccctagcccagacaggcctttagccaagttgcccccaaggcagctgtccaggtctagaccatttaaccctggctttcattttccccacctgatgtggggaaaccccaagactggaacttcccatcccaactgccctgttggccctaacttacaactcccatcacgcccccctacccccgccccatcaaacccattttctgcactgcaccaaactcccccttggagctgtacctaggagagggtttgtgaccagaccccatatgatggcttgtgtggaatggcccacttgactagtgggtaaggcagcagttccaaatgccatgctggctccttggagtgtgtgacattgagtcgctgggggaaccccacatcggcctcctcctgtcctccctgttgtggggaggtgggtagctcaaccctggaaaccccctctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggacattcagaacaacctttaccaggtgagtagagagagaaggctatgcccaggtgcctgctgccatccccagcagccaaaccctctgctaggcacagcgccagaagctgcaatacaaagatgcatacagaggaagcagcgtctgcccaggcacgaggtgcccacagactcatcactggcacctgattatacagcacgatgacaagtgtattgaagaccttaccagattcagtggggtctggcgtctttgtgggacaggcaagaaaggctgaatataagagatgacatcttagctgagcctgaatgggagcagttgtcagggagaggccctggctcctccgtctttcctcccctcccccagcccctgcagagaaaccctggaggatgatacagacttccctagggatgaaggattaagagcaagaccctgtttccctcatcttacttccagaactggggtcctaagcatttggggaggggttcaggagtaatttcacagaagacccaactatgactcttacagttaccttgagagaggctcctgggagttggaggtggttgtattcccacatgtcctcaggggtaggagccagctgcagtggttctgtgaccccgtgacccctctgtgcctacagacagcactgcatctggccgttcacctggatcagccagatgttgtccgggcgctggtgctgaagggggccagccgaattctgcaggatcagcatggtgacacggccctgcatgtggcctgtcggcgccagaatctggcctgcgcgtgctgtctgctggaggagcagccagagccaggcagacagctttctcatcccctggacctccaactgaagaactggcaaggtgcgaggagaacctacacctgtgaacaggaccacggaaatgcgagacagatagtaaacagcacactgtgaagtgtgtgtgtgtgtgtgtgtgtgtgtgtgtgtgtatgtaaaggaagtgggtgctgtggtggaccaggaggagaagaaccgggatgtggcagagttggagggaattttttttgtagagacgtcctcagagtcaggagcctttgaacagagattcaaaagagacaaaggatgtaaattttaatctaaatctctattattataagtaaggttggagaaacaaaggaggttctaggccagaagggggataggaaaataaaagccctggggcataaagggagaggtgacccctgggtagagatccatgaggatccccagacagctctgagaaacctcgcctgggcttgaaggtaaaagtctagagttagcaggggtgggtgtgtgcactggaaggccgtgtgtgactggggctgtcgctcagcaggggtgggtgtgtgcactggaaggccgtgtgtgactggggctgtcgctcagcagcctgacccttgaagcataaaagtttcagtaacatgaccgaaaaagtggaaactttgagttcctttcctctcagacctctgaggggatttctgggaggtggtatttcaatagtcctgtgattagaggcattgagtaggcaggggtcccttgaggctgaagggcagggtaccaaatagcagtcccctccctcctccaccccaggtctggcctgtctccacattgccacattgcagaggaaccaaccgctcatagaactgttgcttcagaatggagctgacattgatgtacaggtgaggctccacctggtccaccaatcagggccccacctggtccaccacctgccaccacctgatccagcacctgccaccacctggtctaactacaggtcccctggcagcgtcaaacatattgacatgccatctccggagcgcatgctcagcacgctacctcatcacatgcatagctgacatccctgttcattgcaggagggcacgagtggaaagactgccctgcacctggctgtggaaacccaggagcgcagcctggtgcagtttctgctccaggccggtgcccgggtagatgcccgcatgcttaacgggtgcacacctttacacctggcagctggccggggcctcaacagcatctcatccactctgtgtgaggccggtgccgactctctgctgctgaatgtagaagatgagacaccccaggacctggctgaggacgtaagagacgcacccgcaccatctgccttgcagagcctctcacccataacagagttaggcacatgcattaggcaaaggatgctcaccagttaatagtgccggagtcaggctggagggtctaacttggttgacagagtgcttacctagcatgtaagaggtgctgggttcaacacccagcaccacatgtatagtggtgcatgcctgttatttaagcacttaggaaatggagggaaaggatcaaaactgaaggtcttcttcatctacatagcaagttcaaggccagcctaagctacatgagttccctcaaccccctaaaactgctgggggtagaacagaactacttttttttttttttaccaactgtgacatattgggctgtatttgccgccccccgcccccccagcctacaaccagttccctaggctggttaagcccaaggagcccaaacatggactccaacaggagtgactctgtgaagctaaccagactgaagacaatgccatagtgaggcccgggagggaggacaggaggagcaacacctccacacacgttgcacgtgtcttgaagcaaatgtcttcagcatataaatacccggggttttcaggtcttagacttttttaaaaattttttgtttaagatttattcttttttgttttttggtttttttggtttttggggttttgttttttgttttttgttttttgtttttcgagacagggtttctctgtatagcccctctcttccattttagtgtcatattagaatggtggcgcacgcctttaatcccagcacttgggaggcagaggcaggtagatctctgagttcgaagccagcctggtctactacagagtgagttccaggacagccagggctacacagagaaaccctgtctcgaaaaacaaaaaccaaaaaaagatatattcatcaagatatgctggcacatgcttttaatcccagcacttgagaggcaaagacaggctgatctctgtgagtttaaggccagcctggtctacagagtgagatcctgactcaaaaaacaagcaaaagtatccaaaagccttccacaccccaaccctaaccccaacaacagccactgtgtatacatagtgccaatggacatactatatctactgtaaggtcactcctagctcagatattctgcatggcttatctcagatcttgtctaatcttcgggtctctgccatgcccaggtctttcactgtctggccttcagcttgcccaggtccctgctgccatccctggtgccatcacttagggcattaactctgcttctctctgttttctttctctctctctccctctctctctctctcgctcagctcctttcttatttgcccttcgatgacctgaaaatctccggcaaaccactgctatgtactgactgaagctcggatgggtccccaccgcttcccacctggaagctggatccgcagctgctgcagttgggacccaagcaatgtcgcccctctgctgatgctggtcctggggctagcatagtcctaaaatgagatgaaggattgcagacgaggaagagccgatctggaaggaaggacttcccaagtggcctggatggagattcttgaaagaccctcgaagccactggtatcctgaaggaagcctccttgcttctgttgaagatggcatgggctgaaattgccagctacctggaaaatggggatgagcaaactgacccgaggggtctcacctaaaatacctttgtgagtgtgtttggcactggggtgtgaacctagagcctccccagcggtaggcaagcttactatcatggagctgtgtccccggccctcttttcattttttatgttgtgatgggatctcaatgagttgccagagatggcctggaactcactctatagcccaggcagtcatctttgaactgggaacttcctgtctcagcctcctgagtagctgggattataggtctggtggcagcgggccaccgcaaagttatctaaagacttcaaacataaggctcccaactgaacctttgcagttattctaatatgacactaaaatggaagagaggggctttaaaaaaaacaacaacaacaacgtttcccttctacagttgtatgcataggcaggcctgactctcgggtaaaggcagagagaaggaaacaagccctgagcaagcacagggccttgctgggtatggtaggagacctaagtggttcctgccaccacaggcacatctccttcatgtggaaatgcccagggctggagagtgaggaggaagaatatggagacacacacgtgtccctggagaagtttgaggacattgatcacaagagagttgcaactttcctcccccacccaacccccttagactccacacactgagggccctgctaggtcatgcacgaagaaggagaagaaataaatcaacatactttccgatgcttagcacttataagcactaagcaaatgcatcctgtgagtgagacagatattaaaggcataaacaactaaatatgtggttatacgttgcaatgggtgactgggaaggaagaaaaccgttagcaggaaggaggacaatggagtgggcgaaggatcatcctctgggaagcttcaagcaggtgtcgttgaaattgcgatttaggatgagcaaggggaaagacagcattggggaaggcctccgatgaattaaaggaactgaaaacaggccaacaggactctacaaggttgggcaagtgggcgaggaggacgcaccaggtcatacagagcctagaaggtcacaatcacaggtactaaggggatgattactgatgcagccaaaaaaggaagagacatcattgtttaaaaactaacgccggttctggtggcgcaggccggtaggatttgctgaaggaggcagaggcaggaggatctggagttcgaggccagcctgggatacagcgtgagttccaggacatccagggctacacagagaaaccctgtctcgaaaaaaaaaaaaacaaaacaccaaaacaaaaaacaaaaaacaaaaaaaccgtaatgtaagaggaagtactgggtctcagatactcaaaatcctagtccactagatggcaatggtcatcatcactctgtgtgggttgggttgggttgggttgatggctgtgaccaagcaagctgggaaagggagggagtcccaactggagttccccaggggaaccgggcttggtctgcctccgggccgcgtggggtcgctgtggccggagtgtcgcgaagggggctgaggcggggaggaggcgggaagagcgcagcacttccgctggctggctgactggctggctgctggagcgggcggcagagggagcggagggagcgcgcggcccgggggactcacattccccggtcccccctccgccccacgcggctgggccatggacgccaggtggggggctcgggcagccatggcccacgtgaccgagaccccggggccacgtgaccgagaccccagggctccggaggcggggtggggggtcctccagccgcagatccgcgtggcactgttgggagccccgtgtggatgggcacgcggcatgtggcctacgctcctcgcggggcttcggggattgtcgcgcgtagggggatgagggacagtggcgcttcggagagggaagggggtgggggttgcctgtggcctgagctgcccgcgcactgaagggaacagaggcgacctatgtggctggacaggcggggccgtccccgagaagggaggaggttctgcctggcctgcgccggaccccctgagagagagggagagagaggctctttgtccgtccctctgggctgcagcggagggggcggggaggccactgggcacttccctggtacagtccccttcggagggcagagaggcggaagagctgcaaccctaatcgttgcttcggctgtcccagcagatggtgggcagtagtggtactcgccacactcccttccttgggagcaggtggagagtcacccgaagcccctccgcagtcctggacacagctgtggctcttccgcttcttgttgaatgtagcgggctatgccagctttatggtacctggctacctcctggtgcagtacttaagacggaagaactacctggagacaggtaatgtggccagagggtggggagatgagggaagtctggttgcaggtgttggcagagcgggacttgggccgggagggaggccagtaagtcagacaccggatcgggctggctgctctgcagaggttgtggaccttgactgtgtcttcttcaggcaggggtctctgcttccccctggtgaaagcctgtgtgtttggcaatgagcccaaggctcctgatgaggttctcctggctccgcggacagagacagcggaatccaccccgtcttggcaggtcctgaagctggtcttctgtgcctcgggtctccaggtaagaatacaggctccccttctcttccccagctgggtacagacagcccctgacttaaaccaaattttccctgcccaccccaaaggtttgttagtttgggtctggtttgtgtccctacaggacacagcccagtcctgaaagtgaacttccagcgcttccttcaacacctgtattgaaatgaaagttcactgtacacacgcatgtgttcatgcgcaggtccacgcgcgcgcgcgcacccatgcaatggcttctacagtgtggaagaaggcctgcctgagttgtattttttttccctatgcccatattctgctctgtctgtatgttgtatctgagtgtgaatttgaggaattgctggctaaacatatctccagagctgcttcccacattattattttgagacaaggtctcactctgcagccctaattactccagaactcactatatagaccaggttggtctccagcttagagatccccctgctctacaagtgctaggattgatgacccaccacactgttttgacagagtttcacaggctcagacaggccttgaactttcttttttttcttcgctgtttttccagacacagtttctctgagtggctctggctgtcctgaaacttgctctcaataccaggctggcctcaaatccaaacgcctctgcctcagagtgctggacagagtgggttaaaggcatgtgccaccaccacccaatgcaagccttgaactttcaaccctcctgcttcttccttccaaatagctggggtgacagcgtgtaccaccatgcttggctttctccaaaattttgtcagtaggatttctttgagtgaggctatcacagggcattcagagtgggagccaactcaccttagatatatgttgaattgaagtgtccagccacccccacccccagcttccaaacatcccagtttctttttgagttagttcaaactaaataaaactctttatatggtatgtggagccagctctaatggatttgcatcatgaaagaggacagtgtttggtcttaaagcagatgtcatggtgtctgcaactccatttgattcccccataaaatgagctaaagcttgggaaagaaggcccctccctcagaggaaccaaaagtatggtgtcagttacatctgatgctaccaactctgaggaagtaggaaacagacttctgcctttccttctatactgtcgctcttctctgccctccctcttccaggtgtcctatctgacttggggcatactgcaggaaagagtgatgactggcagctacggggccacagccacatcaccaggagagcatttcacagactcccagtttctggtgctgatgaaccgtgtgctggcgctggttgtggcaggcctctactgtgtcctgcgcaagcagccccgtcatggtgcacccatgtaccggtactcctttgccagtctgtcaaatgtgcttagcagctggtgccagtatgaagcacttaagttcgtcagcttccctacccaggtgctggcgaaggcctccaaggtgatccctgtcatgatgatgggaaagctggtgtcccggcgcagctatgaacactgggaatacctgactgccggcctcatctccattggagtgagcatgtttcttctatccagtggaccagagcctagaagctctccagccaccacactctctggcttggtcctactggcaggctatattgctttcgacagcttcacctcaaattggcaggatgccctgtttgcctataagatgtcatcggtgcagatgatgtttggggtcaatttattctcctgtcttttcacagtaggctcactactggaacagggggccctactggagggggcacgcttcatggggcggcacagtgagtttgcgctccatgctctcctcctctccatctgctccgcctttgggcagctcttcatcttctacaccattggacaatttggagctgctgtcttcactatcatcatgactctacgccaggctattgccatcctcctctcctgcctcctctatggccatactgtcactgtggtggggggactgggagtagctgtggtcttcactgccctcctactcagagtctatgcccggggccggaagcagcggggaaagaaggctgtgcccactgagcccccagtacagaaggtgtgagcagtacagtaaagaccctcatcttctgaggcactggctcagtatcagcatacagcagaggattggagccctggaggcagcctcttttgccttaaaagcccccacttcatggaaatgacagctgtgggtgtttggttagaggtgacccagagctcctcccccaatctctgaaatcttgctggtggccaagcaaaccagcaccagggctttgctcatagcacgcacccttgaggctaccaggcaccagctgggaagagaattgtttacaggtcatgcagttcccctaggggccagtgagaatggtgctgtgccagaagggacaaaggcccccagcccagttggggccccagtgttcctacccaagttttggtacttggaaatgtcaccttttgctcttatttgattaaactgcagcagtgactttggacctgtgttttggttggcattaatagttgatggacaagtaactgcctttcatcaccttccaacaccactcaggaagccctgagtgttacaaggagagcaggactgtataaaactgcatcttctttattttgcatacttttaattttagaacaaaataaaacaaacaaaaaaaccacaatacataacacccaaccctgctattctgtgggaggggatcttcctgccttaaggcacaggacaggatagaagattcttgtagacatgagcagagagccaggtgggtcagggctgctgggggagccacggggatactatacagagggcagggcttcttccaggaggctttaatccacctcttccatgcgcgaggcatcctcatcgccttccagaggggggatctcatcaggaacagcagcactgggctcctctgcagtgacctcatcttcatcgatgcctaagagaaagacacagatttaagtaagccacaaagcactaagtctgcccaaaggtccagctagtacaacaacttgctaccaggagctcacaagccagactcacccaggcctagtttaatcatgcggtagatgcggttggagtgggtttggggatcctcaagtgagaaaccagaggagagcagagcagtttcaaacagcagcaccaccaggtccttgacagctttgtcgtttttgtctgcctcagccttctgccgcagggtctccacgatggggtggtcagggttgatctccaggtgttttttggccatcatgtagcccattgtagagttgtctcgcagtgcctgggccttcatgatccgttccatgttggctgtccagccataggtgcttgtcacaatgcagcagggtgaagacacaagcctattggagattgtcacctgtggacaatcaagaacaatgacaagatgtaccttggccataatggaactgctatgtatgaagaaccttactaagatggcaggcagaggactaacccccttacatgctctggagactgaaggttgcttgagtacagggattcaaggataacctgggcaacacaggaaggccctttccttgcatacatacattagatggaataattactgtttagtctgtgtgtgcctggtctgtgctgcctgacatttctagctgtacagcagactaaaatatttggagctaggggagactcaccttttcaaccttcttgtccaagatctccttcatgagcttgcagagattctcaaactttgccttgctctcctccattttcttcttctcttcctcgtcctctggtagctccaggccctccttagtcactgagaccaggctcttcccatcaaactccttgagctgctgcacgcagtactcgtcaataggctcagtcatatacaccacctcgaagccccgcttccgcactcgctccacaaaggcagagttggccacttgctctttgctctcacctacaggattaatacaacaatggccacatggccaccacatggcctccacaccaccacttccccctttcccaagtccacaagacagctttactcagacccaatctccgacataccagtgatatagtagatggacttctgggtctccttcatgcgagacacatactctgacaaggaggtcatctcatctccagactgagaggtgtgatagcgaaggagctcagagaggcggcggcggttagtggaatcttcatgaattccaagctttaaaagaaaaatccaattatatgagctggaaaaaacaacaccctaaatacaaagttatttggagaacacttgtccgtcttacctttaaattcttggagaaggcctcatagaacttcttgtagttctccttgtcctcagccagctcggagaagagctccaggcacttcttgacgatgttcttgcggatgaccttcaggatcttgctctgctgcagcatctcccgggagatgttcaggggcaggtcctcagagtcaaccacaccgcggataaagttgaggtactcaggtatcagctcgtcacagctgtccatgatgaacacacggcggacatacaatttgatgttgttcttcttcttcttgttctcaaaaaggtcgaagggagctcgccggggaatgaagagcaatgccctgaattccaactgaccttctacagagaagtgctgaaatgaacccaataatacattttaggacaggactgcttcaagccccaatatcaaacatctgacagcactgtgaatgctgtactgctgaaccctatgaataggaaagcagccctaatcacaaataaacccagcatgctggtagcaagaattatcccgccaagcagaaccccggctgtaatcagggtggtggccatgacagtgggagtgattgagaagagtaatccagtgtcagatatggctgacaccctgattcccaccagaaagagaatgtgaaaccactgttagctctgagtagctccagtgttgtcacatggttcttttctgtggctttcaggtcccagctaccaaccagtcgagccagttattccttaccacctccagcttctgcctacctaccctgccttacacaacagaggaaggcttctcaccttgactgccaagtggtcctcccagtcattggtgaggctcttatagaattcgccatactcctcctgcgtgatgtcatccgggtttctggtccagataggctttgtcttgttcagctcctcctggtcaatgtacttctctttgatcttctttgttttctttttcttgtctttgccgctgtcatcttcctcatcggatcccacatcttcaatcttaggcttctcctcatcctccttatcttcctcctctttctcacctttctcttcctctgcctcatcatcactgatctccttctcccgttccttctccaactaaatcaccaatgacacatgtaattaattggagaatgtagcaccagcaaggcccagtgccattagcctgctccaacactgccaagcccatactcacatagagggtgatgggatagcctatgaactgcgaatgtttcttcaccacttccttgaccctcctctcctccaagtactcggtctggtcttctttgaggtgaaggatcactttggtaccccggccaatgggctcacctacagagaacaaatcaagacatgaaaaactgaaactaaaatacaagaacgaactacgctttttccgttcctggtttctcaagcaagctaagattcctgtgtagcccctttgcttgccttaagaactcacccaagtgctggcactcaccaccccttaaaatgtacttttatagaatacaacgtttaaggtttccccacaatgtagcctgccgcctcaccatggtctgcccggacggtgaaggagccacccgcagaggactcccaggcatactgctcatcatcattgtgcttcgtgatcacaaccactttctctgcaactagataggccgagtagaatccgacaccaaactgcccgatcatggagatgtctgcaccagcctgcaaagggtttgaagtaaagaggatcagcaacatggttcttggccaagtataaccatctgctgcgcaaggtaacaatcagttcaatgtccagagatctaggggtcaaagctgtcctgaccaaccacttgtactttttttctaataagtgtcctaatatgtaataccctagacagacaaattttaacttaagcagtaacaaattagaggacggtgtggatgaaaggccacacacctggagagcctccatgaacgccttcgtgccagacttagcaatggttcccaggttattaatgaggtcagccttggtcatgccaatgcctgtgtccaccaaagtcagcgtgcgctcctgagggttggggatgatgtcaattttcagctctttcccgctgtccaacttagaagggtccgtcaggctctcatatcgaatcttgtccagggcctgtagtaaacgcaaaaagccagattattttatttgtccaaacagtccctcccccttcaacatcaactgaactgttcttctcaatcactcccacacacacacttccgtgaagccttagaaattcaacagaatactcacatctgaagcattagagatcaactcgcggaggaaaatctccttgtttgaatagaaagtgttgatgatgagggacatgagctgggcaatttctgcctgaaaggcaaaggtctccacctcctcctctccatggtgcacttcctcaggcatctaagaatgaaagaattactaccaaggaccattatagacacacattttaatatccagctcaaacttctttagtctgggaaagtatccaacccaaagagacaagagcagccattttctttaaaaaaggacatttaagctacaatggccaagacaaaaat

SEQ ID NO: 776 - DNA, 645 bp, Mus musculus
ctggacattcagaacaacctttaccagacagcactgcatctggccgttcacctggatcagccagatgttgtccgggcgctggtgctgaagggggccagccgaattctgcaggatcagcatggtgacacggccctgcatgtggcctgtcggcgccagaatctggcctgcgcgtgctgtctgctggaggagcagccagagccaggcagacagctttctcatcccctggacctccaactgaagaactggcaaggtctggcctgtctccacattgccacattgcagaggaaccaaccgctcatagaactgttgcttcagaatggagctgacattgatgtacaggagggcacgagtggaaagactgccctgcacctggctgtggaaacccaggagcgcagcctggtgcagtttctgctccaggccggtgcccgggtagatgcccgcatgcttaacgggtgcacacctttacacctggcagctggccggggcctcaacagcatctcatccactctgtgtgaggccggtgccgactctctgctgctgaatgtagaagatgagacaccccaggacctggctgaggacctcctttcttatttgcccttcgatgacctgaaaatctccggcaaaccactgctatgtactgactga

SEQ ID NO: 777 - protein, 214 aa, Mus musculus
LDIQNNLYQTALHLAVHLDQPDVVRALVLKGASRILQDQHGDTALHVACRRQNLACACCLLEEQPEPGRQLSHPLDLQLKNWQGLACLHIATLQRNQPLIELLLQNGADIDVQEGTSGKTALHLAVETQERSLVQFLLQAGARVDARMLNGCTPLHLAAGRGLNSISSTLCEAGADSLLLNVEDETPQDLAEDLLSYLPFDDLKISGKPLLCTD

SEQ ID NO: 778 - DNA, 27990 bp, Homo sapiens
agctgctgacggcgcgctggcagtgctcgcagctgcgccggtagggagccacgcccgccgcgcccgggccgcctaccccaccgtagcggcacgagggcgcgtagccgccgcctgccccgccgcagcgcgtcccgagccccgccaggtccatgagcaccgcctcagagtagctgggcaccagctgctggttggagcggatgtgccactcgagctccgtgctgtctactgtgttgacccgcggcaggcggtgggtgagcgggggcagcagctcatcgctggggctgaggccaccgcctgcgctgctggccgagcccgggccctccaggccaaatagcttctccacgtggtagtgcgcgtaggccgtgcggtactcggccagcactcgcagcggccacgacagcgtgagcagcgccgcggcccagaaggccgacgagcaggcgtaccagggcggccgggccgggtccgggaaggccaccatgaactcacggaagtccacgttcttgaggtgcatgccctcgcgtgcctccatgtagtcgtctaggccctcgttctctgcgaagaagcgcgcgcgctggcacaggtacgcgttctcggcctccacgctggcgaaactgaagcacttggtgaagcgcagccgcgtggccggcgcgccctccagccccaccagcgtcttggacacgtcgcgaacgccgcagcgcgcgtagtcgaactcagcctccgccacgtgcgtgttgacgcgttcgtggtagacctgcggcgcggggggcaggcggcggggtcgcggggagcccgtcattggtgcccgcttctgcccactcaccctttcccgccccatctgtgctctggttgcctggtcggaccctaagtctgtcttggtttaggtgccggctggagctggttaggatctttccgtctgacttacagggcaactgacgccctctgtgtaatcagacgtgatgaccggactagaaccagccctacctgtgcgcatttaaattttttttctttttctttttctttttttttttttttttttgagatggagtctggctctgtcgcccaggctggagtgcagtggcgccatctcggctcactgcaagctccgcctcccgggttcatgccatgctcccgcctcagcctcccgagtagctgggactacaggcgcccactaccacgccaggctaattttttgtgtttttagtagagacggggtttcactatgttggccagaatggtctcgatctcttgacctcgtgatccacccgcctcggcctcccaaagtgctgggactacaggcatgagccaccgcccccggccgcgcatttaaattttaactaagccctgcttcctctaggggtcaggccctggccatgaactgcccctctggcctgcctgatccatttgccactgcctctgttttccaaagtgcccccacatcaccacaaacagcctcctcttcttctttcttcccttttacaattgtgtttcccaatgggttccccagaagcactccctaaagaacccctctatctctagtctgcctgttcacgctgtagctatcatcagcctccttcctgcttctcacccgccccaggcttctgtctattgatccttatactgagacagatggcctgcatctgggaacgtctcctccaggaccccaatatgtctcatcctggcgagtccacaaagtgctgattgacctgcccaccctcagtgagacttcctacgcccacctcctcttagacccttgaacttgacatccaggaagctgggattgagcctagcactaccacttaagagcagcagactttggacaagtcactgagtttaggtgtccatacctgtgaaagaactcagtagcagtcacctcactgaacaggtaagagcatgctatgatactgggcatgtgaagccatctccagccattaagcactatttttatttttatttttttttttgagatggggtcttgcactgtggcaatcacagctcactacagcctcaactgcccaggctcaagcgattctcccacctcagtttcctgagtagccgggactacaggtgcataccaccacaccagctacttctttttattatttatagagatggggtcttactatgttgctgccgggtgggctggtctcaaactcctggctcaagagatccttctgcctcaccaaagtgctgaggttacaggcctgagccaccacactctgccattaatcactaagtagatccattaagcactaaacagtatagagatcctggagccagattgattgagttcaagtctcatctccaccacatactgcctatttgaccttagacacattacttaaactctccaggcctcagtttcctcatctgcaaaatgggaatacctgcctacatcatagggttgttatgagggttaaataaatgatttgatgtgtgtaaaatacttagagcagagcctggctcctggtcggtttttgctgttatgattatggttgttgctattgccctgctgttgcaatgctcatgggagctcactgctgccttttgctcctcccaccttccccccagggaggtggggagggagtgaggcagcacgtaagtgccacctcccatgttgaatgtcctgcactccccaccagctcctcacctgggtggtggtataggcgtctccattgcggtatctggtgacctggcgggtgcggcggacatagtggtagctgatggccttccaccagatgcagggcgtggcttgctgcatgcggcccacacgttcccgcacactgctcacatcaacacggtgctgcagctcatggcgggcttggcagtgccaacactccaccaggtagacggcgtacaacatgagcaggaaggccagggggatgtagacatagccgttggagcaggggctgtcatggtacatgaggctgttgccctggtaggcgctgctgaaggtgaggcgcgtcactgtggtgacgtggcaccaggccactgcccccaggcagccgtacatgagcagcgagagcaggaggcacttccagtgggactcacggcagagggacttggtgaaagagggctggatgggacgctgctgctcaggtgggcagggagaggggccaagatgagtgggaagtgagagcaggcaggacccagcacagagatggatacggggatggaggggcagaggccagcaccagagataacaggcagagagaaacagggatatggagagaaaaggtgagaccaagatgggagccaggggccagaggtagaaacagaagtgacacagagcaagccagaggacaggaaaggggaccggaatgccagtacaggagagtgcagagagagacaccccaagaggcagagaaggatcagagccagagatagaggcccaggcagcaaacacagatggataggatggtacccagagagcatccgaagacaaacacaaaaatggcaatgaaacagaagatgtggacagggaagacaggggaggacagacagacaggcatcagcgaaggaaggtccccagcccagaccccttccaggtcctctagaaaagggggagggacccactgacatcacttccccacttaacaagtggggccctcacttccagatttttttcagtcctaggttctagaggagctactcccctctgacccatccacctccctaaccctcacaattagcctaacacgtcctttggataagggcctccagagaaccccaggcccagtctcattccccatgttctggaccctggttcccctgtgagtctccctcctgcaccctgacatccttccctttgtcctaggatgggagggagggggctggggtccctgagcggcaggcagtccaggaggaggtatccagaagggcagaggcatgtggctgaggagaggacaggcataggggatgtgggactggggtagcgaggacaacgtttgaagcccagcaatttatcaagagaaaattatttttggtactctcctggagcctgtctgttaaagctcctggcacattctgtcccagggttggcccaggagttgtttacatgtctggctccccactacactgggtactcctgagggcccatgcttcattctctttgcatcctaggtgcctaccatggtgctggcccccagcagccacatcctaattgagtgttgagtttaatttcttgtagtggcctctgttttcccacccctcctctgtgctgtctagctttaggaacccatcccccaccacacacacacacacacacacacacacaacctcctgctgggatcctgacttaccccctcaattcctcaggcctgacctagaggccagccaggaaagagaggaaaagagtggaaaagaagggtacagtaataggcatcggtccctggatctagaagtatggatagttaggcgagctaggaaatagcacacagtacatgtggacaaggagattagggtacatgtgcctttcggggagccttgtccttaggaggtatgaacatacgggccccttcgtgtgcctacctggttatgtgcttgtccccatgtgggtacctctgaaaggggctttacctgcaggcccatccccgcttgtgtgcctctgccctagtacagggtgcatgcgtgtgcacaagtgtgcatgggaggctggagtgggggtgctcctggtactttcctccgtctctttgtcttcaggttcagaggactgagtactagggaccccaactagggatatgaggaagcagcaggagcctcgtgagagagaggtgcacacccccccccacacacacacacacacactcccaatgaccacaggcgggaccccccgtacacatctgacctccttagggtcccagatcaggtaccaccaccacttccccatggtaccctcctcgttctgtagcccgtacaagccgcccttcctggccttcaaggtagcatcctcctctgtgagacaggatccccgccaccgtccccaccccggtagagcatagcccccactctcataagcccaggatccgcgaggctccgcccctaggcccctccccctgcccgggacccctgagccccgcccccggcgcggccccttccccggcaccgcggacagctccggccgccgggtgggggcggcggcgcggactgcggctgcagcggccggctcggggtgcggggcgccggccgcgctgcggcggaaccagcgggggacgcgtgcgatgggggatggggggccaggctgcggccgcgcccggggaaggggcgccctagactctcacctcctctcgggcggggccctcgtccgccgccgccgctgccgccgccgccgtgagctcctccgagaccccggggccgccaccgccgccgccgccgccggcggcgctctctcccgcggccgagccagggggggacatggcgtagagggggcgcgtcgagctcaggacctcccggggggctgccaggggccgggggcatcctgcgcgggccctggggagaggacgggagggggcggggccctcgctgctccccaccccccgccgggggagggggcccggaaagggcaccgggagtaaggggctgggggctgagggtgggaggcaggctggggggccgggccggggggggccggggccgggggcgggtgtcaccttgaggccctcgcggcgccgctccgcctcccgcccgctcccgccgccgccttttgtctgagccgagctggagccagcgcgccccccctttcctgccagcgcagccgagccccgcccccagccccccaaactccgccttcccaagcctacctaataaccaccccccgaaggggtaaagcaacagggactccccacacctcttccccgctcccagccctgctcactgcacctccctcccgcgctcctatcctgggagaatctgtgccgcaacccctctccatctgttctccgtggactcggtgcccgaggttcaaccaacagcacccccccacacacacacacatctctggttcccccaagttcccagggcagaggagtggggagaggaaattgattcttggaaccctagggaagatccttactcccagtttcgtggtgaagggttaaggcagaagctagacttccagaggaatggaatagggggaaagggaagagattgaagctagatgtgggaaaggactaacagagggcagaggggagggcattggaaccggccttcactgaaccatctttcttccctaaaagaacagctccagagaagcagtgaagtgtgtgcaataccctaggctggagggcaggaaacctgagttctaattctgaattctgtatctgtcattaaggagttatgtgaccttgggcaagtgccttcctgtctctgagccttaatttcttcatctgtgcagtgaggaagttgactggacaatttctaaggctctgacttgtaggtgtaggaagcaggccaggctgagccactgcaggcagcctatcctttcaggccatccaccccacactgcttttccctgtatcccctggcacagcaggaaggaccctgacatttattcattcattcatttctggatgtctccattcagtaaacaggtgttgggtacctattgtgtgcccagtacagaaatgaaacacagtttccttcctgcaaggagcacaaagtctaatggggagaaaagaacatgaaaaacaaccattatgaagaatataataaaagccatgcatgatcaatcttgtgcatacacagtcactgtggaatcctactatgtgtcattagagtctttgacatacagtaactgttctccccaattactcacagggaaccaaggcagagggagagtgaatggcttactcaaggtcacctgctagcactcacagagctagtcctagaattcagatctttcccactcaaaatctatggggaatatttgtgggtaggaagttagtttggggcaaagcctcgatgtctgattttgggggatagggtacaaacacactgatctgcccaggatgttccttccccttgttggggacaggagagccactgctcccacccctctagtcccactcctggccctgccttcattttactactcttccctttccaggtgaggtgaaggtggctctctgtccacctattgcttagagctatccagcctgcatggtcctctccaggttgatgggtccattctccctgcccagaggaaggcggctgtccagaagaggcgggggtctggttcactcccttggcagaggcagaatctcacttggtggttcattccagcatctcctgcccatgctttttgggaagctggcctcacagctaactccagcccctcttgttccagtttcaaccccttcccccacagagagcagagcccctaaccttggcctttccaaacccacagaggatcctttcgtgctccccatttaggcaccataatcttcctcttgacacccacccccactgccttcctgtctccacttcaaagggctttggaggagggacagtttagctctttttggccaacgctagagctcccaagagacaaaaggctacccctgccttctccattcacacacagtacccttccctggaagctacaagaaaggggggtgaaggagggggcggtggaaggagccagctgaccggctggtcaccatggaaaccaggcctgtttcctgaagatgagcctagctggggtgggtggaggtggggagtgggggcacaaagggaaccagaaaacaacagagagaaagacgaggggcccagcctcagagaagactggagctgaggaggcgaggtcaggtccctagccatgctgtggcctaagtcaaagtccccaggtcaccctttcagataacactgcaatggtccccctccccattcctggagtgttggaaaggattcctgtcaagagtgcaagctctggtagtggggccagtgggtgactcaatgctgacctcatgtggccataaaagggactgccacacacctgttacggctcagagccaaacacctggctgggttaagtgggtttttcctaaaattcagcctctgtatgaataaaaaggaggtccttgcacactcctgagttcttacatccttgcagagggctcagacactcccaccctatgtggtttacctcttgataaagaaaagaaggttccactaaaaaatatgtaaaagttttggattagatgagaagacatctctgcactttctattttaacttgagcaagtcaactcacctctctgggcctcagtttcccaacattaaaatggggatgatagtgtcagatttcgtgtggatttttttgtttttgtttttgtttttagactgagtctcactctgttgcccaggctggagtgcagtggtgtgatctcagctcactgcaacctccaccctcaagtgattctcctgcctcagcctcccaagtagctgggattaattacaggcatgtgccaccaggcccagctactttttgtatttttagtagagatgaggtttcgccatgttggccaggccagtcttgaactcctgacctcaaatgatccacccacctcagcctctcaaagtttataggcgtgattacaggcgtgagccaccgcgctcggccaaattttgaacccagttggtctgggtctggagtttattactatacttttgctgcagcctttgaggaccggagaggaacatgtcaggggaggagactgagaacatctgaaatcatgctgactcaagggaaggagatgcttcaatttcccaggcctttcccctcgtggctcctcactgggcttcatgctcattacgtctttcccactctggtcctacatggggttgaagaacagtgggccatcttctcccctcagccctcccccaactcttctgcctccaatcgccccccacagactaggtccttctcctctccctatctctcttcccttcccattctcagttcaaatggaagcttccttgcctctcaccccactgagtagctggccccactgtgtgcccccacaacaccctgttctcacttctgtcttatcccaaccactctgagctgtaattgccaaggagcttttttaggaccatgggatttttttgttggtcatggggggtggttattggttattactgtgatagtcagttttgcttccagtagaaagaacaacgtcagacattacaggagaccttccatacatgtttgtcaagtaggtgaatgatggatgaataaaatgaggttgcaggggaagggctgtgggaaagctggcctcccccctgcaaaacgttgctgtctacactcatccaccttcctttctccaatgctggagatggaaaagctacatgttcccttgcggataaccctctaagggcattgctggcgttaggctgatagcacttggaatagtggggaggaatgagggaataaatcatggagcatgggcttagggctcacttgtagtagggtgctcccacggccttcctaggcccagggacagtgaaagaggaaagatgttttgggactaagattggggctgtgttggggacctgagcagagtgcaacccagcatgtctggggcctccccaacctgaccccacttccttgactgctggggttgaccagaaactgtaactacccaaggccagggtttcaccctttgaggaagaagaaactccacaaccactttactttttagacaacagtttccctgagaagacgctctttccaaaaaaacattttcatgcccaattccatgtgatgtgggacgttgacacaggagactgtcttccaggacccaggagaactgctcctttaaagataatgggagtcccctttccctacccgtacccctgggcactgatagggaaagatgagaaagcaagagaaattgagataaatgggcaggggataggaagcagtgcttccccatcccatcgcctacatgccctcccccaaagatgccagcttgtacggacaattaatagatatttcttttaaaacaaatgaatgatccgggaccggtggctcacagcctgtaatcccagcactttggtagtccgaggcaggcagatcgcttgaacccaggagttcgagaccagcctgggcaacgtagcgagacccccgtctctacttgtagtcccagctactcgaaaggctgaggcaggagaatcgcttgaacccaggaggcggaggttgcagtgagcagagatcaaccactgcactccagcctgggcaacagagcaagacttcgtctcaaaaaaataaaaaataaaaataaaacaaatgaattaagaaatagaagtgaaagaaggaaacagtacatgcgtggaactaatgaatggagtgaaggaggaagggggaaagagtgaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgtgagtatgggggctaggctgaatcgggatgctaactctgggcctgcccaagagccgcaacaggtcgggcacccccactcccccgtgaagatccttcaagtccccattcgctcttccaaactccagacttaactctcagcccacttttgaggtccagctaggccatggaatcatctctgtcctcccatttcggggtgggcagagctggcaggacccttaacccagccagcatcttggaaatctaccaataatccacccttaggaagagaaaattcccctgaccaagtccagtttttttgtttcttcttgctggggaaggggacatccttatttgctcaatatctgggattcccagttcctgacctcagaatgctctgtctcaaggaacaacaggtgccagttacaggttgccagtcggggccaggaagctaggcatggggggtgccaccagggtgtaggtttgggactggtcctcaggaggatggggtgagccaggctggggcactcttgccccagcagacagacaggcggctggctgccccagcttacttcctcctctgctaagaaaggggaagtgagggctagagtcagcgtccctgacatcctctacctccagagcccccagtcccactaactgtcgtgtctcactccctcacttaacccttcctcctccagacccagatggagtttggtgggagtgggccagagggcagttgaagtaaaaggcagttgtgtgggatgggttggccagttgaggatttagccccccaggaagaagaaaacattgacagaggagggaaaggttgggaactggggatgagaaatagagttggggagggctggaatccctggtcaagggtgctcatataaataggagtaggggaggcaggaggtggctgtcctaacctgctttttggagatgcagggtcctaatcctgggtggccattgataaagacagctggtggacccagtgggtgggagaggagtgacccagtcctttctgtactctgcctggatcaccagccctcaggcccagaaccccaaggttttgggggctgcacgcaagatacctctgatgacctttgatccaaggagaggggacttttgacattgccgtcttttgttagcctctcagccccagccttttccatctctagttagaagcaggtgttgtgtccagattgggtgtgtgtgtggaggggagaaatgtccgggctccccagcgagtccccagagagcagggggcactttcctccctctgttggaggtgtctgggctgtgggaggtatggaagtgggaagaggaagtgggaggaggggatactgggggagagagggaggtggctgcaagaatgtgacccagagagcaggccctggcctaggggatttccagagcagttcctccctccctccgtcactctcctgggcctctcctgctgcctgctgctaaagcctgccaccctcctgcccaagcagccccctccccagcccagacgggccttttagccaatctacccccctcactaatgccccaaggcagctgtcccggcctagaccctccatcactggctttcgttttccccacctgacgtggggaaaccccaagactggaacttcccctcccaactgcccccattacccctagattaaggttcttggccccctcaacaaatacattttctgcactacaaagacctcctcttggaggtgcacacaggaatggagggcctctgttaggcccgacctggtctgtgctatctgagaggtgcctcttgactcccagggaagggcagcaggacaggatgctgcactgtctccttgctcctcttccaagagtttctgtgtctctcccttggaatgtgtaacactgagttgcttgggggtacggggtgaccctgcaactgtctccttctttcctgtgtgctggggtggtggggtgcttagccctggaaaccccctctggactacttcggcagctttcaatttggctttgagctgcagctggctcggcagagccctgagggcaaagaggagtgggtgtgggcaggctggacaggaaggctgttgtcctgtcagcaccctgcccacatgcccacccagccaaggccctcctgaaggccagcagtgggaacttggagctccaaccctaggatcctggcttcccacaccaaccctcacttcctggcccacactctcacttcctggacctaccctatgggtagctagttaaagtttgatgtgttccttctaactccaagaccccaacccactccctctggcctgggcccttaactctaagccccgcctctgctcccctaggctggtccacctggcagtgattcatgaggccccagcggtgctgctctgttgcctggctttgctgccccaggaggtcctggacattcaaaataacctttaccaggttggtggcgagagaatgttatgcccagatacctgtttgtgccctggcagccattcccagcagccataccagtccaaaggctgctcacttaggaaaccatatgccagacactgagctagaaactgaggagacagacccaagtaagacatggcctctgtcctgaggtgcttgcatcctgggctgggggacttgtatcaacagctaaatacacagcctggtgacaagagttgtgatagagacacataccagctgctatagggtccagtgtctgtgtgcagcagccagggaaggcttacagaggagatgccatctgaatggagcctaacagagagttttgccagggagagactgcccggtgcctctatctttcctcctgcagcctaacccctgggggtaacagaggtctcctcacagggtgaggggctagactctcctcctacatgtcctttctccagggcctaaggtgacttacaagaaaagcagagagctactttcttcaccttgcttccagaattgggatcccaagagcttggtgggggaggggtgtgacaggggaagggctcggtagtatttccttggaagaacaggttatggcctttataagctgctttcaaagaagatgctggcagctggtgattcttgagcccaagcatgttcccagaggtgggagcatgctgcagtggccccatgaccctctatttgtgcctccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtgtggacagtctttaagactgcccttagggcctgtgggatgaggagggcataggagatagggacctcactcttggggaagggagggtcccagcttgtccattggtgcccctcccactgtaagcacatagatattcagtacatctttgccaaatgaatgaatggatgatttgatttcgaatttaaccagtacctactgcctgctgagaagaaaactaaatcttgcccttaagatacttagtttaatagagattagatgacctgattcattcattcaacagaaatgtactgagggttttctatgtgccagacgttatcctaggagctacacttgcatctgtgtgcaaaatagagaaagattgagatgagcaataaatgtaagaagtgaactatgtaatatgttaaaaggaagtaagtgctgtagtaaaaagcagagcagagtgagaggaaggaatgtggggagtaggagagttgatatgattgttaaatagggtggtccgggaaggcctcatggagccagtgacatctgaatagcgccctgaggaaggtgaagaatgtaaatttgaatcgaaatctctattactaagcaagggtcgggagtgtccagactagaaaggagagcaaaaaggccaggggagcacagaaggaagcggcccctgagaaagggctgggggcatgaggatcttaggtggcttttcagaaaaggtggctttcagactgggcttgaaggcaggttgtgtgtgtgtgtgtgtgtgtgtgtgtgtgtatgtatgtgtgtgtgtgtgtgtgtgtgtgtgtgttgtagtttgtgtataggaggagggtgttctttgggggtgtcactcagcagcctgacccctgaagcatgaaagtttcaataacatgactctgaaaaggtggaaactttgagttcctttccccttagacttttgagggggttttggggtttgcattttaacagtcttgtgattagagacattgagtgggctgtgagtcccttggggctgagtggtagggaggtcccagaagagagggagttggtggatgcagatcagcagccctcaccctcactctcaccccatcccaggtctggcttgtctccacattgccacccttcagaagaaccaaccactcatggaattgctgcttcggaatggagctgacattgatgtgcaggtgagacagccagcaaagcactgcccggcccagggcctgcccccacctgacacatccccaagtcccctgcccagcagtcagaagtggtggcattcacttccttatccagagcccaggcccagcacactgcctctgagggccttggctgacatccttattcctccccaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaagtaagtggcatatgctttgctctccagggccttgcacacccatagcagagagaggttctgtcattagctgaaagggccagggagccaggagtcctggggtataaccaggactctgccactgaccaactgtgggaacttgagcctgtttccttagttggtccaaggagccaaatttggactcttacagggaccctgcagttaaagtgaatcagtgaagttggccagatatgagaccatggtgtggtgaggcctataagaacccagagagccatccctgagggtctctgtactcagcttcagcaaaggcttacaaagcaggagtgtaggcccagtttttcctggtcttggactttcttgagaggtgaaactcagattttctgtacagtctttcctatttttaaatgttcagtgtaaaaaagaaacctaaatgttctgcgagtacccagcagcccccccaccccatcccccaacaacaacaaacaactccaggtccatgggctggatcacctctaagggtccctcctaactcggatattctggcattatcttagaaaaggaaggcttgtctaagtcctcagggctctgccaagcccagaggggccactattttgaggattcgtgtgaagatttgttccctgatggtcttcaactgtcatttggtggggagggagtggcccaacaggtttccctgggtcccctttcccaagtcaccttttcccatgtcctctgatcttgcttctctccattctccttctcagtcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagttgcagtgggtgctatgaagggaaaagaatagtgggaaggaaaaggatggagtcggtagagggtcatactttgggtggtccgggaaccctcgcctgaggagtatcatctcaactgggatgtaaggatgagtaaagggatgggggcagagcattagggggaaagcctgtgaattagaggaactgagagcaagccagtggggcttcacagcgggcgagtgagtgggcgaggaacgcgggcgaggccatgtagagcctcgaagatcatgggaagtgggacagaattactacccagccaacaaagcaaggagacaccttcatcctgtcagaaaacggggaaactaacacagaggagcggcttgggatgcagagcctcaatgtcctgtccacaagatggcaatggtcaccatgacctctgggacgcttatgaagggcgatgacgaagcacaggggacacgccgggcgggcgcctcttcagggctggggctccccgcgcccaggggcagcccaggtccccggaacccaagccgcgtctgcctccgggccgcgcgggggcgctgtggtccggcggcggcccggggcgctgcgtggtcgcggcaggggcggagggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccaggtgggggctagggcagcagcgagctcacgtgaccgagcccccgggccacgtgactgccgcgcctcagcacgggggccgggtggggtcccggctgctcggccgtcggccagcatatcgctgcccggagccagcggggatgggagctgcggcttggttttgtgctccttggggagcttcgggcggaggggctggggaccctgacgtcccggatcttggaggggagtgtgggggaaggggcgcttcctctgacctgagcagccggctagcgttggagggaacagaggagacctgtgtggccagaggggcggatccgcccccggggagggaggaagctctgcctggccagcgccggcgcaccccctccccgagagagagagagagagagagaggctctttgtccgggccggagctgcagcggagggggcggggaggagactccgggcactactccagtgtggtcccctctggagggcggaggggatgaggagctgcgccctaatccttatgtccgctttccttacagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtgtgaagaaagggcggggaagtgagctaggtcgggaaagagggtatttggccagcagtccaaacgggatatgacttggagagggcgggaggtcggtaggccggacagcagggcaggctggctgctctggggaagatgaagtgctatggagaagatttggggcttgactttgtgtgctttcttcaggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgggtaggtgggctcagcctctcttcctgggttggatgccggtgggcagggattctgtgaaggtttccattttaccagtcccagagctttgctggctggtgtgtttcgtgtcctcctcccaggggcacactgcacctccatctttgaggtgtttgggggaaatgcccttttgtttcttccttttctcctctccagcactggtactgaaagttcatgctgttatttcaagatgtctagtgcagaagagaggactcctcttgccctattctctgtgatttctactgtgccgttattatacttccttcctgcactggtgtctcacatactgtaaacccactgataaaattgtgggggagccattcagccttcccccagtactgcatgtgagagagtgctaacatgctgaccccatggcattttgcagtgggtactagttccaccttgaatatcatgttgaactacagatacccaattctgagagttcttgcctccctgaataggtttttcacacacagttgattccctacaaggtgaatccagacttaggaggggagaagaaacttctacagaggaaccaaaaagtgtatattttcctttgaatcacttaggcataatcctgaagagagagaggtcaatttttgtctaccttttcattatcttgcttattgtctcctttgtctctaccttccccaacaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtggacttggtcctgtgttttggttgactgaaagggcattattatatggtagtttttccaaactgcctttagcttcagtgtgtgaactcttaagactcactggtattctgttattttcactacaaaaccagctcaacttgctgtgctcatgaaaacagcaagagctggagggatgaagaagctagggaaggataacatccacttcacaagggaaagcagaactgtataaaaacggcatattctttattttgcatactttaatttcagaacaaaatgaagaaaataaaataaaccacaatacacaacatccaatcctgctgtcaagagtagagagggaatggggcttgacacccttagtttactgccttcaacacaaggacaggagagggaaaaaaacactagacaccagcagggggagccaggtgggacaggggcactcgaggctgcagtgggagcccatggggacactatacaagggcacaagttttccaactatgaactcctaacctaatcgacttcttccatgcgagacgcatcctcatcgccctcgagaggggggatctcatcaggaactgcagcattgggttcctctgctgccacttcatcttcatcaatacctgaagtaaaattaagccatgtgagacttgaccaaatagcattaagtcaaatccatagaggagacgagttgcacaaactccttgccacaccaagtaccaaagctacttacctagacctagcttgatcatgcgatagatgcggttggagtgggtctggggatcctcaagggaaaagccagaagatagcagggcggtttcaaacagcagcaccaccaggtccttaactgccttatcattcttgtcggcctcagccttctgccgcagcgtctccacaatggggtggtcagggttgatctccaggtgctttttggccatcatatagcccatggtggagttgtcccgaagtgcctgggctttcatgatccgctccatattggctgtccagccgtaggtgctggtcacaatgcagcaaggtgaagacacaagtctattggagattgtcacctgtggacgatcacaaaagccttagattgacattaccactttgaaagagaaaacaggcattgtcaagcctaattccagcagggggaggaggtggacagaccacttgagtttgagaccatgctggccaacatggcaaaaccctgtctacaaaaaattaaccgggtgtggtagcacacatctgtaatcccagccactcaggagacttgagtttgcagtgagcgagatccagtccaaaaaaaaaaaaaatcggccaggcatggtggcttgcgcctgttaatcccagcactttgggaggccgaggtgggcgaatcacaaggtcaggagatggagaccatcctggctaacgcgatgaaaccccatctctactaaaaatacaaaaaattagccggggtgtggtggcgggcgcctgtagtggcagctactcaggaggctaaggcaggagaatggcgtgaacccaggaggcggagcttgcaatgagcagagatcgtgccactgcactccagcctgggtgacagagcgagaccccatctcaaaaaaagaaaaaaaaaagaaaatgatggtattttatctactctcagaagttaactgaagcaatgcctaatctgtgccaaattttattaaaatagccttaaacctgactagagaagagaacaagaggcaagaaggcatgaaacagtaaataggctgcctcaaaccactaattgtatagaaacatgcttgtgagggagcccacctcgaagatgttacaaaatatatcctagccccagaatggcttaccttctcaaccttcttatctaagatttctttcatgagcttgcagaggttctcaaactttgccttgctctcttccatcttcttcttctcctcctcatcctcaggcagctccagaccctccttggtaactgagaccaggctcttcccatcaaattccttgagctgctgcacacagtactcgtcaatgggctcggtcatatataccacctcgaagccccgtttccgcactcgctccacaaaagctgagttggccacctgctctttgctctcacctgtagggtaattaaatgaactcagtgactaaaatgcctcatactgccagttcccaggaagccctaattgtgctccccactcctccaaaaaggcttcaatcagagtcaacgcaccagtgatgtaatagatggacttctgtgtctccttcatgcgagaaacatactctgacagagatgtcatctcatctccagactgggaggtatgatagcgcagcagctcagacaggcggcggcggttagtggagtcttcgtggattccaagcttgaagggtgggaagaggaaaaacaatccagcttaactacaataacttcactttcaatgtgaatggaataatttattgttattactaagaaagtggtaaagggaataagcattatttgcctttttaccttgagatttttagagaatgcctcatagaatttcttgtaattctccttgtcttctgccagctcagagaagagctcaaggcacttcttaacaatgtttttgcgaatgactttcaagattttgctctgctggagcatttctcgggagatgttcaggggcagatcctcagagtcaaccacaccacggataaaatctgccatcaaccagggtgagaaagctcagtaaaaaacagctagaccagacctggtccccagattcaaacagaaggctctaatagcctcctgaacccttacacctactatgtattgcagaaaactgttaccttagaatatcctagcagaatgcctaaaacctcccaagacttcacccaactaaattaggccaaggagatactcactgagatactctggtatcaactcatcacagctgtccatgatgaacacacggcggacatagagtttgatgttgttctttttcttcttgttctcaaaaaggtcaaagggagcccgacgaggaataaatagcaatgccctgaattccaactgaccttctacagaaaagtgctgaaagaaaccaaaaataagtggtacatttcaaaagaggaccttttagccccaacaccaaattatctaaaagtggaacaatgatcctccctaagcctaagggatagagcacacacaacaagcagctcctgagaaaactgagccttaatgccctccacgatctagatgggtactagctgtatgtagaaaacagtcccctctgatcagaaccctggatgtgtaaggctgccaatagacattacccagatttccataagaagagaaagtgaggtcattagaaatgatggcacttcactatgacagggtaatcagtaagtgaaatcacatggctatcacatttctgttatcagttggacaagttccgtgtgtctattacccaacactcttccacctaactcattcctctccatatgtgcatgttgagccaacatgcaaaggcttctcacaccttgactgccaagtggtcttcccagtcattagtgaggctcttgtagaattctccatactcctcttgggtgatgtcatcagggtttctggtccaaataggcttggtcttgtttagttcttcctgatcaatgtatttctctttgatcttcttagttttcttcttcttatccttaccgctgtcatcctcctcatctgaacccacatcttcgatcttgggtttttcttcatcatctttatcttcctcttctttctcacctttctcttcctctgcctcatcatcactaatttccttctctcgttccttctccaactaagtaacaaaaacagaagttagccttggagtacaaaacactaccagggaaagcaaaagccagggacaatgagattctccagaacaggaaacatcctgcacgttaagtgtaaaagatttaaaagtccatactcacataaagggtgatgggatagcctatgaactgagaatgcttcttcactacttctttgacccgcctctcttctaggtactctgtctgatcttctttaagatggaggatcactttggtacccctgccaatgggctcacctagaagagtcaattacaagcgtgtaacagggtaaaaagtatatgcagttgagaccagcaattagtaagtatcagcagaactgctgtgaagaactgctttacagacaggatgcccaaaatttctgctactggtgtgagcccagaaaatcctaacccaactaccttgtaacagaaaagctaacttaccatggtcagcacgcacagtgaaggaacctccagcagaagactcccaagcatactgttcatcatcgttgtgctttgtgatcacaaccactttctctgccaccaagtaggcagaataaaagccaacaccaaactgcccaatcatggagatgtctgcaccagcctgccaacaagtttaaagtcaatcacaagttttaaagaagcaaaaaaccaaagaacacagataagtatgaatgcctacagaactgcaatacctgaagagcctccatgaatgctttagtaccagacttggcaatggttcccaaattatttatgagatcagctttggtcatgccaatgcctgtgtctaccaaagtcagggtacgttcctgagggttggggatgatgtcaattttcagctctttaccactgtccaacttcgaagggtctgtcaggctctcatagcgaatcttgtccaaggcctggaaatacaaacagcaacttacttttgctctttccaagacagactcttgctctgttgcccaagctacagtgcagtggcaaggatgacagctcactgcagccttgacctcccaggttcgagccatcctcccaaccccagcttcccaagtagctgggactacaggcacatgccaccgtgcccaactaatatttaattttttgcagagacaaggtctcgcggttgcccaggctgccctcgaaatcctaggctcaagtgatcctcctgccttggcattacaggtgtgagccaacacgctcagccacttttgctttcttaaagcccgtatcttcaaagaaaatcttggtttacctctctcagcctcaaatctgattgccccctatcttgaggctttagaaccagttagttccatgagcccacttattctggacatagtcccttccaagttcaagatggccagagtaaaacccatctttttggaatagctgcaagtttacccccttcaatagtagtccccaacaaaggccaaaccactcctttcccctccttctagagtatcaaaaaaaaaaaccatgccaaatgtggaaaccagagcacctacatcagaagcattagagatcaactcccgaaggaaaatctccttgttggaatagaaggtattgatgatgagggacatgagttgggcaatttctgcctgaaaggcaaaagtctccacctcctcctctccatggtgcacttcctcaggcatctaaaataaaaatctcattaattacaaaagaacactaaggccccatgtttaaaaatcctaaaggtcatatcatttgttaggaccttagacagtgagttcagactggtttaaccggagtactatcccttcccaagactaaaaatgcattctcttaaagatctcagactacacactaagtgggaggcctgaaaattcagaaggaaaaagaaaataagctaaatattcttcaaccaaatgtcacagaacccacctacttaaagaatggtgaccagcagcctcagcatcatctggtagtatggcagaaaaatcataatgttggtccaacccaggtatctagagatcccaagtaatccttacacaaatttaaatgtgaaaatcactacctacagttctttatttgggggaggtcaaagtgactagtttaagataaaaatggcactaactttaaactgctccccctga

SEQ ID NO: 779 - DNA, 2948 bp, Homo sapiens
atgaatgatccgggaccggtggctcacagcctgtaatcccagcactttggtagtccgaggcaggcagatcgcttgaacccaggagttcgagaccagcctgggcaacgtagcgagacccccgtctctacttgtagtcccagctactcgaaaggctgaggcaggagaatcgcttgaacccaggaggcggaggttgcagtgagcagagatcaaccactgcactccagcctgggcaacagagcaagacttcgtctcaaaaaaataaaaaataaaaataaaacaaatgaattaagaaatagaagtgaaagaaggaaacagtacatgcgtggaactaatgaatggagtgaaggaggaagggggaaagagtgaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagttgc

SEQ ID NO: 780 - protein, 500 aa, Homo sapiens
MNQRRSESRPGNHRLQAYAEPGKGDSGGAGPLSGSARRGRGGGGAIRVRRPCWSGGAGRGGGPAWAVRLPTVTAGWTWPALRTLSSLRAGPSEPHSPGRRPPRAGRPLCQADPQPGKAARRSLEPDPAQTGPRPARAAGMSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 781 - DNA, 13821 bp, Mus musculus
  misc_feature (1)...(13821): n = A,T,C or G
tcctcctcctcctcttcctcctcctcctcctcttcttcttctatgttgggcccaggtttatgaaaggctggggattgaacccaggtcctgacacatgctaggctagcactttacccactgagctccatctccagcctctaagttgtcccattctaggacattgccttaggatcttatgagaacactatggaactatgcgatatcaattataacatgtaacaagtggaatagcgggtggatgttcacccctcccacagcttttaaacttcctcggttcttgcccatttaactggtcctactaaaatgaaagcaactgtgaaacaaaggcatgtagcataaagttctaacagttacctcagagttaccgccatctttgctgcagattaggtcagcctattgctacttttcagagtttgtgttttcaagtgtcattgagtttacacaggtcaggacacagttgggacatgaagataaacctcacctactagagtagatgtcatttctgggtaaggctaactgtgggaaacagagtgtgttcgctaaggaaaccttaggtcataacctccagcttcctgaaggaaatgccaaaagtgctcagaagacaaagggccgggaacaaatgcgaatgtctctatccatctgtctgctggggcggaaggggtgacttcatgttccactcacttcctcaggctttcgttagagagccaggcataatggaaaagtgtgtctattttgcttcagtggatgataaagctctgcttttggacttatctccaagcacaaggtgactcatgacatcggagcatagggtggctcattggtgacgggaggtcaatcttcttgcccacctctgagtacatcatcctgtggacgtgcattcttcatagctctgccagacagtggatcttgtttggagaaagcgggggcagttgtagatgtgtggaagccccagttctagtcaagacacaaagacaaagatgaaggggtctttggttgcatccattgtgtatatccgattttaattgagtacactctaagtagtgaggatgagaaaatcactcagtgactgaacacacacacacacaatctctacatatgtgcatggagacatagctcagttggcagagagcttttcttgcatgcagaaagctgtgggttccatccccagtatcataaacctggtgtaggtatggcagcaatcccaggaaggtgaagnnnnnnnnnnnnnnnnnnnnattgcctgagaatggactgtagcgataagagtggagaaaatgttgagtttcgtaagcttttgtcacagaaaatgactacaatgtctctagggtcccctcccccctcatttgttatagagttgatcaattactgtgcagactttagagtacttatttagtgctgtgtgtccaacttaagtagtgctgtgtgccctttagggattgctagttctgttgagaggaggcaatgttgggggtgtggggagcggaggaagttaaaagtgcccatgcaaacttagcagtatgtgtttctggaaattaatgtacctgaagttaaaacaaagtggcgtgcttcgttatcgctagcagggtgactttcgtgtgtgtgtgtgtgtgtgtgtgtgtgcaagtaagcgttggctaaagttaaaactttcttaagcaatcagttcatggagaaacgtctaggatttgctgcaatctcttaagaggggttctccgtgaatacctttaaacgtaataaatgaacttgtggggcggttgggtgaggcggaggagtaaagacagaagttttaaaaagaagaataggcagttgcttcacggaggcgccaagctttcctgtttacttcaaggcctggcggcccacaccacacctcgctttaccctctgaccatcggaccctcagcacacctgctcctagggagttattaatagagcccagaaaacggcttacttgtcaaatgacctcctacaaagctactttttttttttttggcatggtaatgagaaggtgggctggtctcttcgaggtgtgtgtgtgtgtgtgtgtgtgtgtgtgtgtgtgtgtgttggggtatgcatgtctgccctgcacccagaatgggcagttggtgccttctgtgagcaagcagtcgattttcgcttgaaggaatctcagggctggacactgaacgtggcaatgccagtggaaatggcgtgggctcgaaaactagaatgggtggctctcatttccatcttggtggatttagtgacccaagggaaggttttgtctcctcagagtctgggtaaattgttttttctacctctctttctaacttcatttctcttttgtttgtttatttttgttttgttaatagaaatgaccatttgagttaaaaaaaaatcctccctgtgtcctgtatccttaaaacaaatcatcaacaaagttggagcaatgccttggctagaatgaattatgctagtgtgctgggcattttccctgattcttttctttgtaacttgtttaaggctgctgtttctcggaggcctctccagccaaggaaaagctccataaaagaaaaaagcattggattgctcgctgacctggctttgctgtaactgaaggctcactcaacctcgccctctagcgtttgcctggagaaataccaccccaggctcctggggacacaattagcagctatggtgtccactagcatcccggaggttaaagctctccgcagctcagtctctgactatgggaactatgatatcatagtccggcattacaactacacaggcaagttgaacatcggggcggagaaggaccatggcattaaactgacttcagtggtgttcattctcatctgctgcttcatcatcctagagaatatatttgtcttgctaactatttggaaaaccaagaagttccaccggcccatgtactatttcataggcaacctagccctctcggacctattagcaggcgtggcttacacagctaacctgctgttgtctggggccaccacttacaagctcacacctgcccagtggtttctgcgggaagggagtatgtttgtggctctctctgcatcagtcttcagcctccttgccatcgccattgagcgctacatcaccatgctgaagatgaaactacacaacgggagcaacagctcgcgctcctttctgctgatcagcgcctgctgggtcatctccctcatcctggggggcctgcccatcatgggctggaactgcatcagctcgctgtctagctgctccaccgtgctcccgctctaccacaagcactatattctcttctgcaccaccgtcttcactctgctcctgctttccatcgtcatcctctactgcaggatctactccttggtcaggactcgaagccgccgcctgaccttccgcaagaacatctccaaggccagtcgcagttctgagaagtctctggccttgctgaagacggtgatcattgtcttgagtgtcttcattgcctgctgggcccctctcttcatcctactactgttagatgtgggctgcaaggcgaagacctgtgacatcctgtacaaagcagagtacttcctggttctggctgtgctgaactcaggtaccaaccccatcatctacactctgaccaacaaggagatgcgccgggccttcatccggatcgtatcttgttgcaaatgccccaacggagactctgctggcaaattcaagaggcccatcatcccaggcatggaatttagccgcagcaaatcagacaactcctctcacccccagaaggacgatggggacaacccagagaccattatgtcgtctggaaacgtcaattcttcttcctaaagcctgaagaagctgttgatactgagggaagcattctgacttgatcacccactaccccagcatttcaaaaatgtctctcgctctccactgctgcaaggaaggagcaactgggagcctgagagagggagggaagggagaatgtgcggcctggtgataccatgatgtaggtaggtagtaattgtgaacaatgcactgggaagggtggagatcaggtctggcctgcagtgggtttcctgcccccctccccccataccccggagctttgattttgcactgagccaaaggtctagcattgtcaagctcccagagggctcatctggtccctcctcaaagactaaggtcccaagagaaagtgttgtgatctctcactgtaatgtcaaagtaagtatgtgccctttagcttggttgggtggtgtacatgtccccaccctccgtttcttctcaccctgtctccccttaccaccccttctttatatcgtaactgtcagacttttgttcatcagaaggaggttgtggaggggtctatttcttgattatagtgagcaagctatttgctgggaaggctatttgctgaggccaaagtttccatgtaaactgggtcaagttgttgggaatttggtaggccatctttaagatgaaaatgtgttccttttttgtcacatgttccttattcccattacaaccacaatggttgtgaatgaagagtaacaaagaataacgaagtctactttatttgaattatactgggcagaatcttagatgatacgggaaaagcaaaaaacaaacaaacaaacaaacaaacaaacaaacaaaaatctacagcatgaggtgaaatgtgagagttaagtcatgcagaccaagagctgtttcttgctgtctttctctaacccctacagcacctttggcacttttattgatgatttcagaatgttgtgtgatccatttcaaccaactgggggagagttgtattttgtttaaagaacattttctgattttcgaatgtatttgtttctttgaggtcatcttattgaacttcttcctaacccgtgttaacaccactgaatgtgtagttcttaagaaagtgtcatccttttgtaccccccaccccccaaaagcattactttaactgacagggaacatcaggaattctttatttcggctgtcactaggtattgatgatggttataaatgttacagagaataaaaatatattagtctctttagtctggtgttcagtgagtgcaattaagccaagaaatgtcttttttaaaaaatagtatttaataggttcctgacttttgtggatcattttgcacatagctttatcaacttttaaacattaataaactgatttttttaaaagattcttttgtgaagaaaactttttaaaaaatcattcactgagatttggagttaaaggtaaggcccaatttaaaaaagttaagagaagttaaaagcttttaccttgatgaagtaaggtatgaaaaaaaaatgtggtttgtttagaaaccactctagctttttcaggaagagaaacttcaataaattagcattagagacacgtggagaatatgagaaaaaccatcaaccttctaagaccacagcaaatagatacaactatttcaattttaaagtgcagtgaggccaaacaaaactaagtgcgataattccatcctaaaatacagccttctgaagttcatcaatggagtcttaaatctattttaaattatgactaaaatgatcagttcaaacaccacagcaaaagcatacatacttggccttttatcaacatactgggaaagaaaaaacatggctaatgggtgataatgttaaattggtcagtgctgtgtaagtttttggtttgtgtattcttaagacaaggtctcatgtgttctagacttgcctcatgcttgctctgaagaggaatgtgggctgttgatcctcccacttcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgcctgtgttaataaactgtccaaagctgagtggtggtggcacacacctgcaatctcagcactctcaggagacatagaaaagtggatttcttttaagtttcaggctagcctggtttccagagtgagttccaggacatctgcagctacaaagaaaaaccctgtctcaaaaacaagtaaacagtccaaagccaaccaaacaaggaaacctgcccaacacatattgtaatacgtctaggactgcactttcttaggctttggaccctttgcacctatgttctttatatcaccaagattgttcacgtctaagcatttgtttggagatgctactcagaaaggaagacttccaacaaatgatgggtatttctagtgaatgctataaaatgagggcttgcccaactctcagtggtagcaatcccatgtttaatgggaaagcaggctataggaccagagtggctcatgttaaggcattctatgtacagaatttctaaagaccttcttaatagacactggctttgctgctgggcacatctataatcctagtattcaggaagcctaaacaggaagattgctgggagttctggttctcatttaaaacaaaacaaacaactaaacaaacaaacaaacaaacactcccccaaagaaaacaaaccaaaactcattggttcaaaaattaatttctagctagaaactgttataataagcatggcaagtatttgtaatgagcttttgtagtttgtttgtaatattattgtttttatataactaattagttacttttatttctttgagacaggatcttgtatagccaaagctggcatcaaatttattttgaatttgaggcatacaccatcacacctggctctagaattctgttttgggggcagggtgtcgtatagtccaggctggcttcaaactgctggaagatgagcatgaacatagtaggactttgctttgactgatcaagttccaagattacaggtgagtgctaccacacccagttgacgcagtgctggatgtagaacccaggacttcctgtgtgctagacagacacagacatgagcagagacactctattaactgagctgtattctttttttctttttctttttttagatgactcattccattcttctggtggtgttttccaaggccccctaactaatttttatcaaactaaatttgattgcgtttatttttagagttgagatgtttgcattatttttccctgaatagtttctaaagacactgagggaggaattataaatgaatcaaaaccaaaagaaagcttcacagatttgaaatatccttttcctgtgaacgtggtaagtagtgttggtggggctcgtgtgtgtgtgtatgtgtgtgtgtgtgtgtgtgtgtgtgtgtgtgcgcgcgcgcgcgcgcgcacttgagtgcgcatgagtgttaagatagggtctcaatctgtagttcaggctgtccttgaatttacagttgcctcagcttcctgaaccctgggtggcatgagtgaattaccctgcccagcacagtaagttcttgaagatgggaaagacataacaggttgcaccatctccctcatgtgttcgttcttcctacctactttgatgtgcttcccatcactcaaggaaaaggacttagttgagccatctgcacacgtctttgtttctgatgacagccattgcacattgactactactcagttactactaattctttttttttttaaagatttatttattaatatatgtaagtacactgtagctgtcttcagacacaccagaagagggagtcagatcttgttacggatggttgtgagccaccatgtggttgctgggatttgaactctggaccttcagaagagcagtcgggtgctcttacccactgagccatctcaccagccccactactaattctttaaacaatttgtatgaatctcaaagccattgtgtcgagcaaagataaaacacaaacaacaggccaatcttctacttcataagctcctgaagtggaatttggaagaaagcaaaactggcactggtgagatggatcactggttaacagggctaactgctcttgcagagggtctgagctgggttcccagcacccacgtaaggtgttttacaatccactgcaattccagtttcagtggatccaactcttctgacctctgctgaagttacacccatatgaacatatatgcactcatattattaaagatcataaaatgtatcttttttaaaaaggaaaagaaaaccagcttatagagatcaaaagagtacaaacagagacccaagcagagaaagaggaaaaactttcagattgttaagaatgctctatttatacctttttttttaaagaacattgattattcagatggatatatgtgcttaaatttatccaactatattctaaagacaaatgaaagctttaaaaatccaaggcagcaggcttctgcttgtaagcacaatggcagtaaagggtcttctcttgaaaattctgcagattccacacagtccaagagaatgtggcagaagtcccagagtattccatagacgagcatgtgatctctttgtatttatctcacgctccagaaacaaaccattaaaatactaaataatcgtgacccaatggtactcacttgcttctgtaggatgagaaaatgccttagcttctctgtgtgttatccctggagaattctgtgtgtggaaagagtctaagggtacagttaggctttcacaataaaaaattcattggcattcagaacccactcttatgaactcatgaagggctgtaagcattcttaagaagaatacaatttaaacaatttctatgaatgtagaagccagtaaggctttgactggtaaattagtactggaaacacacagccatggccacatgagtaaacctataaaaagccttcagtcaagaaaaggcaacttcctgggtataaactctgcataggtagaagtaataggggaagatttaaggggtaggcgaaggcaacactgagaccaagtacattgtctgcctgtgcacagccctgtctgagaccttcagccagctctaggtgtagtggaacagaggtgacatgcttcaggtgttccacaggtcctgtgacatgctgattagatattaatcagaactagaaacaggaaagcaggagaaatgccgcctgttctacaaggggatggggaaggtagtaagtgtcttgcttatctgtttcctgtagagacatcaaagagatgatgtggctgaccttcccgcccccacctcctcacaactcctcactgtccgttctctcgcctgcccggttagctggaacgcctgccctgggttgtgttgttgtgctctgggaaaatggcgagcagggttcttcttgtctttctagaacctaccaggtctattttttctgttcgggtgcatttgtggcctcttccctttgaggttaagggatgatgagatggcaagaaatacttctttttttttttcctttcaagaatgtattcagtgtctcatacttcctccatgattttagcttctctgcaagacttacttagacacttaaattggacaggcaaattaggtccaattcatggcgactcacgctgtaatcccagcacttgggaaaacaggacagaaagaagcttgtgctatacactgaatcctccagaccagcctgggctactgagtaagaacctgtctttaaaatacaaatgaaaggctgactgtatatatagctcagcaggtaaaggttcttgctaaatgaacttgggggtctggcttggattcttggctcctaagtcaaagtagtaagtttttgtttttttttttttagttacacattttgtctccaatattttttttttaatacaaactgcatatggttattcaaatgacttaagtggacctgatttacgggtccactgactccacagcacctgacctccacacatgcgtcatggcacacacacacacacacacacacacacacactgataaacaacaacaacaacagaatgtaaatcagacaaagtgtgcttcatgctgacagctttcctccttgccttgccttgccttgccttctctaaactactcacgtgaaatgccgtggaatgatttcatctggaagagagagttactagatgtgctgcaaaaatcagggtggagcttttccaagttgttcatggtcttcctgatgaaaagcatccagtttcgggtagatggaaacattttacattgttgccagtttctgcctcagaaactgaggcattgctgtctgagtgtgtgcttttctttctgtagcgctgctgtgaactgtagccatgtcgggtataacccttaaatcaggtccacttaagtcatttgaataaccatggtgggatccttatgcaatttgtattaaaaaatattggagacaaaatgtgtaactaaaaaaaaaaatacttattttattctcgtgtgtgtgtgtctgtgtgtgctcgagtgcatgtgtgagccagaagaggacgttaaatcccctgaagctagagttacaagtgttgtgagctaagatttgaactcaatctctggaagagcaacaagcccgtaaccactgagccatctatcgctccagccccttaaatgcttaatattttaggagagaaagcatgacatgtgctttcaatgatcagaatcacgatggcacaaactcgtggaatggaaagccctccaatcatctaagaatctcagagaggtgcctaggtagctctcgagcacgcttcctgctcaaatccaccagcagcccaggagctgtgaaccccagacccacacgctaaccctaatgaatgtgagctgacctagttacgtttgctaggcattgtgtttggttggttttgtaggtagggtcctactgcgtgttgatggcagaaaggacacttgtggctcaccctcccgagtgctgacattacaagatgcatcgccatgactgatgtcgcttgccgcttttatctattacttatttcttattttgaaacagtcttatgtgtctcagactggcttccaacttactataatatctgaggatgacttggaatgtctgattgcccactagcaactcccaagtgctggtgtcataggcgaggatgaccaatcctgctttatgtggtacaaggcattgaaccccaggcttcttgtgtgctacatgagcactctggatggagctgcaccccagccccatttgccatttttatgatgaggatttttaagaattcagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttctaatttcgagtttctcttgctcctgtctagacaacctcagtattaaaaaaaaaaaaaatcagatttagatcgtctgtaaagctatgttctaaaataagaaaagatttgtgagaaatcacttgtcaaaacatgagctatcagaggcctggagactctgctcacacagcctctgccctaccagaaatagaggttggttagctcacatgctgttctgcctcagcgagctctgcatgtggccacctgcagagagaacccttggtttctcttccttgtctagatgccagtcaagggtgctttgagaaaaacacagattttcatactcctttctcatgtgcaagtgagctggggtatcaaagaatttcctaggttgtttaatctagaaaataccttgtttttttggttttggctttttaaaagatttatttatttattcattaatttttttatatgagtacactgtagttgtcttcagacacacaccagaagagtgcattggaccccattactgatgatggttgtgagccaccatgtggtttctgggatttgaactcaggacctctggaagagcagtcagtgctcttaaccgctgagccatctctccagcccctagaaaatccttggttacaagagcaataagatgatcaggagggcaaaagtcctggccatgcaaacccaagtacaatgtctgaaacttgtatgcaaacacacacacacacacacacacacacacacacacacacacacacacacatacacacacatcagattcagtggcatttttctgtaattccaggacttatactgcaagatgagaagcataatcaggaagattgcccccaggcttgtgggcccactcttcaggagaacactacataacagaa

SEQ ID NO: 782 - DNA, 1149 bp, Mus musculus
atggtgtccactagcatcccggaggttaaagctctccgcagctcagtctctgactatgggaactatgatatcatagtccggcattacaactacacaggcaagttgaacatcggggcggagaaggaccatggcattaaactgacttcagtggtgttcattctcatctgctgcttcatcatcctagagaatatatttgtcttgctaactatttggaaaaccaagaagttccaccggcccatgtactatttcataggcaacctagccctctcggacctattagcaggcgtggcttacacagctaacctgctgttgtctggggccaccacttacaagctcacacctgcccagtggtttctgcgggaagggagtatgtttgtggctctctctgcatcagtcttcagcctccttgccatcgccattgagcgctacatcaccatgctgaagatgaaactacacaacgggagcaacagctcgcgctcctttctgctgatcagcgcctgctgggtcatctccctcatcctggggggcctgcccatcatgggctggaactgcatcagctcgctgtctagctgctccaccgtgctcccgctctaccacaagcactatattctcttctgcaccaccgtcttcactctgctcctgctttccatcgtcatcctctactgcaggatctactccttggtcaggactcgaagccgccgcctgaccttccgcaagaacatctccaaggccagtcgcagttctgagaagtctctggccttgctgaagacggtgatcattgtcttgagtgtcttcattgcctgctgggcccctctcttcatcctactactgttagatgtgggctgcaaggcgaagacctgtgacatcctgtacaaagcagagtacttcctggttctggctgtgctgaactcaggtaccaaccccatcatctacactctgaccaacaaggagatgcgccgggccttcatccggatcgtatcttgttgcaaatgccccaacggagactctgctggcaaattcaagaggcccatcatcccaggcatggaatttagccgcagcaaatcagacaactcctctcacccccagaaggacgatggggacaacccagagaccattatgtcgtctggaaacgtcaattcttcttcctaa

SEQ ID NO: 783 - protein, 382 aa, Mus musculus
MVSTSIPEVKALRSSVSDYGNYDIIVRHYNYTGKLNIGAEKDHGIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNSSRSFLLISACWVISLILGGLPIMGWNCISSLSSCSTVLPLYHKHYILFCTTVFTLLLLSIVILYCRIYSLVRTRSRRLTFRKNISKASRSSEKSLALLKTVIIVLSVFIACWAPLFILLLLDVGCKAKTCDILYKAEYFLVLAVLNSGTNPIIYTLTNKEMRRAFIRIVSCCKCPNGDSAGKFKRPIIPGMEFSRSKSDNSSHPQKDDGDNPETIMSSGNVNSSS

SEQ ID NO: 784 - DNA, 25348 bp, Homo sapiens
  misc_feature (1)...(25348): n = A,T,C or G
tagattgagataattattaacctatctgttattgatgtctttatgtcatactgacatattttgacctttacagtgtctttgttcatgtcagggattttttttgtgtgtcaaatcagcaggaaatttacctttttctagttctcatgattaattgttcttcattatataggttatgaacaatcaaataacatatgtttgctgtttctgttcaaaacatgcatcttccttttaataatgtaacatgctctcaatatgatctaaagtcagaatgatttttatttattcaattgctcatttttattgtttttgtttcatattttatgcatttttaatataaattttctctcaatcctttaataaatttatagataacaaaatattctttatataaggccagtctgtaatttctcatatatttcattgaaataatcctaaatttataaccaaattataatagctatagcatacgaatatatgaaaattttgattaatctttttttatgtgattcttattaaaaatggaaaaaaaggccaagtgtggtggctcacgcctgtaattccaacactttgggaggctgaggtgggcaaatcacttgacgtcaggagtttgagaccagcctgaccaacatagtaaaaccttgtctctactgaaaatacaaaaattccagctggtagtgagtgcctgtaatcccagcactttgggaggctgaggcgggtgaatcacttgaggtcaggattttgagaccagcctgggcaacatgatgaaaccccgtctctactaaaaatataaaaattaaccaggtgtgatgatgtgcacctgtagtcccagctacttgggaggctgaggcaggagaattgcttaaacctgggaggcggaggttgcagtgagccgagatcatgccactgcactccagcctgggcaacagagtgagactctgtgtcaaaaaaaaaaaaaagaagaagatggaaaaacaagtgtgatgtgtttataattatatatactgagttagtaaatatattctgagaagaatagaacttttgttttaattaggtgtcaatgagaatcaaatcctcaaattataatttgcatatggtattttggatgaatttcccccagactagctcctggctcagtcacgtgacaccagccctgtacttttgtatcatggcagccatagagggtagttgaaatagtcctataaaccaaaaataccttcaacaactccaaaatcactcctacacaagagaaaatgagacagagggaacgtcctaatggaagaagacagtgatctgtgtcagtcatagccaattttggttaaaataccatgcttttaatattttacaaaaacatataatcttggggacatattgctgggttccttccaggatttggaagtgtaggactcaagtttaagctacattggtttcaaagttaattttgcctctaacaatagcaataaagttttagaaaacaaactgtgtgtaagtggcttgacaaaccagagaaagttgagacctaagcccatagcaggaggattgtagaagcaaaccaaattcccactacagatcctcaaataagaggacttagaagctccaggtatttatgaaaatggcaataaatgcttatctgaaaacaagaagcctgattatagggtatccactatagcagtgagaaaatatttcacactcacccaaccacttctctctagccctgttgtagtcattgccttcattattttactttctgtttattttcctgtttgattttttttctttatgtcagatgggtaatgtgctgacatcataacaaggttcaaggatggcatatctcacacgtgcgtaaacacccagtgatcacgcttatgaactacaaaaggattcctttttgatttttaaataaaattgttttaattaaaataagctgccaaatatccagcccttcatctccaacctgtacaataggataagtgtcggtacgctcattccaggagaagactggaggtttcttctctgaatgggttaaatcagagggtcactggagtcagagacacctgatggagctgagtgtgtagagggggttcccatcatggtgattcagttcaaatctaaatatcaaatggtgaggtgttccctccttcactctcccacttttctttcttggttcactccggaaaatgctagaagtcagacaagagattttagaatttctgtctggcaaaactgacctgcccaaaacttgagaactccagatattgacatttggcatactcaacgaaagtgtttatcctgatcatttaccacccctccattgacaagcccccacacaaagttttaaattagctttctgatttgcctctattttagcctctgtttgaaatataaatggacggccagagatcatctgacaattgggaaagccaatggcacaaagaactgagagcaaaacaaataggaaagtgtgacaacaaagaaaataggagaaaatgtcaacaacaaaaacaacaacaacactctgatatcctcagagataagtaaagatgtggtatccctaacataagaacagagttctgtaaaaatgtaacattcagaaaagaaaaagagagcccttggaaattaaagtatgagagtgaaaagagagctattaactgaaggattgaaagtacaaaaaggaaaataaaataggaggaaatttaaaaatcaggctagatagatggtccacaatctgaatagtgggatttgcaaaaagggaaaatagaaaaactggagagaagatgaagtcattaaagaaataatttcagataattttcagaactgcaaaggacttagaaaatcaaggtatatcatcatgtcactctggaatactgaagagacagagaagtttctaaaaacatccagagacaaaaaatagtcagctgtgaagttttgaaatcagaatagctttatgctctttatcagtagccctagaaattaaaagacaaaagagtaatgctttcaaaattctcaggggaaatgacttacaacttttaacttgatacctagtcaaaatattattcaagtaaataatagaatatttaaaatgtcagacatgcaagaattcagaaagtttataatataagcatccttcttcaagttaattaatactccttcaacatggcagaaaacctatagatattgttataagattgataatgaagaaatggaggtataaaacatgggatttcaagatttgcaaatggctaccagaagaaaatcaacaagacttcacagtgactggaaaaattggtgaaccagggaacctcggaggactaatgctcttcttttcaagttttgtaccatttgatctctttaaaatgatatgcacatattattttgactttaaaattttattggaaaattaaaaagcaaagtgaataaaaaaatggaaagtgggatggtgaaagcaatgattgcacttaaagacagttaaagacaaatgtggtgcggtcaagtcagcttcatacctgggatgcaaggctggttcagcatatgcaaatagataaacgtaatccatcacatagacagaaccaatgacaaaaaccacatgattatctcaattgatgcagagaaggccttcaacaaaattcaacacctcttcatgctgaaaactctcaataaactaggttttgatggaatgtatctcaaactaataagagatatttgtgacaaacccacagccaatatcatactaaatgggcaaaagctggaagcattccctttgaaaaccagcacaagacaaggatgccctctctcaacactcctattcaacatagtattagaagttctggccagggcagtcaggcaagagaaagaaataaagggtattcaaacaggaaaagaggaaatcaaattgtctctgtttgcagataacatgattgtatatttagaaaatcccaccatctcagcccaaaatctccttaagctgataagcaacttcagcaaagtctcaggatacaaaatcaatgtgcaaaaatcacaagcattcctatacaccaataacagacagagagacaaatcatgagtgaactcccattcacaattgctacaaagagaataaaatatataggaatacagcttacaagggatgtgaaggacctcttcaaggagaactacaaaccactgctcaaggaaataaaagaagacacaaacaaatggaaaagcattccatgctcatggataggaagaatcaatatcatgaaaatagccatactgcccaaagtaatttgtagattcaatgctatccccatcaagctatcattgactttcttcacagaattgcgaaaaactactttaaatttcatatggaatcaaaaaagagcccacatagccaagacaatcctaagcaaaaagaacaaagctggaggcatcatgctacctgacttcaaactatactacaaggctacagtaaccaaaacagtatagtactggtaccaaaacagatatatagaccaacgcaacagaacagaggcctcagaaataacaccacacatctacagccatctgatctttgacaaacctgataaaaacaagaaagggagaaaggattccctatttaataaatggtgctgggaaaactggctagccatatgcagaacactgaaactggaccccttccttacaccttatacaaaaattaactcaagatggattaaagacctaaacgtaagacctaaaacaagaaaaatcctagaagaaaacctaggcaataccattcaggacatagtcatgggcaaatgcttcatgtctaaaacaccaaaagcaatggcaacaaaagccaaaattgacaaatgggatctaattaaactaaagagcttctgcatagcaaaagaaactatcatcagagtgaacaggcaacctatataaggggagaaaaattttgcaatctatgcatctgacaaagggttaatatccagaatctataaagaacttaaacaaatttacaagaaaaaaccaaacaaccctatcaaaaagtgggcaaaggatatgaacagacacttctcaaaagacaacattcatgcagccaacaaacatatgaaaaaacctcataatcactggtcattagagaaatgcaaatcaaaaccgcaatgagataccatctcatgccagttagaatggtgatcattaaaaagtcaggaaacaacagatgctgaagaggatgtggagaaataggaacgcttttacactgttggtgggagtataaattagttcaacattgtggaagacagtgtggcgattcctcaaggatctagaactagaaataccatttgacccagcaattcccttactgggtatatacccaaaggattataaatcattctactataaagacacatgcacacatatgtttattgtggcactattcacaatagcaaagacttggaaccaacccaaatgtccaccaatgatggactggaaaaggaaactgtggcacatatacaccatggaatactatgcaggcataataaaggatgagttcatgtcctttgcagggacatggatgaagctggaaatcatcattctcagcaaactaacacaacaacagaaaaccaaacactgcatgttctcactcataagtgggtattgaacaatgagaacacatggacacagggaggggaacatcacacactggagcctgttgggggtggggggctaggggagagatagcattaggagaaatacctaatgtaggtgacggattgacgggtgcagcaaaccaccatggcacgtgtatacctatgtaacaaacctgcacattctgcacatgtgccccagaacttaaagtaaaataataataataataataataataataataaaagatggaggtggtggatgggtgaagcattttctctgtagtgtagggaattctcacaggtatgtagctccttaatcctcacaatgaaagaggcaaatatcattatttcattttacagatgaggacactgaggttcaaggaagttaaaagaacttgcctaaagtcacatagcttagaactggcaatatcaaggctgaacctaagtgtctgttccaaggctcagtcatgttccactaattttgaatgttggcaaacgaggagagagagatattgggacctaggatgaagggaagaaagagtttttggtagagaaaacacataaacatttatgtaagttgaaagtaaagagtcctcagaagctaagaactgaaagtacaagggagaataagaataattgagccaagtctcagaaagtttggaggaagcagcatgctgacctgggcaagagtttgccttggaaaggagtaaagttgcttttatttctgaaacaggtgggaaggaggtaagggtgggtaaagttgctattaagctggagcttggagaggagggaaattgagatggtcatactatttcctccttgaaataagaggctagttattctcctgtgaatagacaagtaagggaaagcctggatttttaccagtgactgggtcaggggagggaagaggggagaaaagggagttggaaagtgactggagcaattaggaaagagagtaaggctcaggcttgtaatcccagcactttgagagtccaaggtgggaggactgcttgagcgcaggagttcaagatcaccctgggcaacaaagtgagactcctgtctatacaaaaaataaaaataataattatcaggacatggtgactggtgcctgtagtcccagctgcttgggaggctgaagtaggcggatcctttgagggcgggagatcaaggctgcagtgagctatgatttcgccactgcactccagcctggatgacagagcagagccagaccctgtctcagttgaaaaaaagaaaaaaaaaaaggaaagggaaaagagtagagttgcaatatttagcagataaaaaatatagctcatggctgggctcggtggctcatgcttgtaatcccagcaccttgggaggccaaggcaggtggatcgcctgaagtcaggagttcgagaccagcctggacaacatggtgaaaccccatctctactaaaaatacaaaactagctgggtgtggtggtgcatgcctgtaatcccagctattcaggaggctgaggtaggagaattgcttgaacctgggaggcggaggttgcggtgagctgagatcacgccactggactccagcctgggcaatagagtgagattctgtctcaaaaaaaaaaaaaaaaaaaaaagatagctcacacagttacatttgaatggcacatttatgacaaatttttgtttagtgtatgctccaaagattgtgtggtattttatctgtaaacttttaaagagaaacactaaagcatgtgtaaagaacaacaaagccactttgaaatcaaaaattggaaatggagcaaacttaaggtaggaatgttgggcttgacttctaggcagcagcagacagggagttgtactggcagtcaggagatagcttgagaatgcaatttttagggcctccttggagagcaatgggaagagacttatatgggaactagagacttggaattggccaggacgccattgctggaaacatttgcctactatctaattttacctaagttgatcatctacaattacatctcataggtgtgtactaaagatgaatattattaaataacaatctgaaaggtttttggactctgtaaaacactttatcaatattgaatgttaaaaaccagtggtattcacaagaaaacaactgatatccccaaggaaattcttgaacctgtttgaggtttatcatggtggtctggagtagtggttaagagtctgcagcctgtcccacattaagcaagctgcttaatatgtctgggagtcaatttccttgtttgtaaaattagaataattatagtgcctaacttgtcagattaaatggattaatatgtgtaacactatgtgcaaatactaaaagtacaatgttacatgagatatcataggcagacaatgagaagtttcagaaaacattcattaatatgcatatgtatacactttgtatgcttacgtagaaaatgagtggttttaaaaggacattcattagcatacttttatatgcattttgtagacttgtacagtcagaaatgcagcaaatgtaaaactttaaatctagaagtctgtttccctctaggaacatatatttcaattccttaactatttattgactgatagcgtttgagccacaaggcaaggcatttgcaatatttaggttttggaacccagctctgccactcactagctgggaaatctacaagtcaccttagttgtctgaatgacacttctctcaacaataaaatggccagcaatgcttacttacttcacagagcagtaaggttaaattaacctagcacatgcttgatacagactaggtgtgaaatttcactttgattcctttggctttaaagaatgcataaattagtgtgggtggaggcgggagaagggggggaatgccaagtcccccgttttgttgtgctgggtagacacaatatacctcttcccctttaagtgaaataagtcttcaaatccaattaggatctactctggagtcttagaggaccgttatcttggtttccacattatatgcactgtactgttgttgaagctgtgggtatgtattgggtgcgtcgctgtcgatgaatgctttaaaacagctgtgaattaactgtcacttcttttttttttttttttggcaaactcacaaaatcccagaagtcaggggtctgttgtttgttcattctgcctccttctgagtcattcaggtacagggtgtgtctgccaattgaaactgcacagcggaggaagtttttgagttcacatctgccgggatgggaacgcagtgcgaccagggactgggtggaaacttttacaacagtaatgcaagggcagaagcgtcctgtcctgagcttgtcacgcaggcagatctgaccaagtccgcctctcagcctcacgttcttaagtagcatctaagcaaaagaaaagggtgggcaaagtgctagtaatgagatttgaggcctctgagtcgactcccaagcagaatgtgagagaagggtgccggctcctgctgggcagctgcagttgctccgcagctcctggccgagaatctccccctttggaaattcctgagctgcccaggcgttttgaatctctcaggactcagcagcagcccaccccctcaacgacctctccattggccagaatctgggacacacagcctgactttgtgctcagctgagggaaacccctcgcccaacaccaaaaccggcgctggttcatttctctgtgcactctgggaaagccactgcccctcagaccgcagttgcgagtagcacgaggatctggggtggcggggggagtacaggaacctcccggttcattctccctcccgggctgcttgtctcctccgtacctctcgcagccccttcccagcctctcctccccagagcgccgccgacactcgccgggccgcggctcaggttttctgctgctcgcgcgaaagtggctcggggagctcctggccacaagctcagcacaccgatcctcctagggctgcggggggtgtgggaccagggcggtgcgctacgagactccgggccgtcctctgcctcctcagacttttcgagagaaaagttttcaaagtctctccaccttttttttttttcaggggctcgggagaatcctctccacagccagggatcagcgtctatctgggcgagggcagtgatttatacagtagaatccaggggttaccgggctccgccccttctctctctctctttttttctttcatttgttgtttggggaggaggggttcttttttttttttttttttttttttttgcttctgccccagatctttcctggacagtgcgtctcagcagttcagatccgggggcccccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgcatctctgggctactaaggagcccatctcgatcagattgttcttgggcacttgtgatttatggagttcagaaaaaaggttaattcccaactgtggaacctacgggtgtaggggcagtgaaaattgcagttggtcggaggaataggagggaaggcgttaaattttggaaatcctatagacaaagaatatggtgggtggtgtggagcgtgggtaatggcttaaattagtactgcccaggagcagggtataacattagttgggggaaaatgcggagcttcttggcttgagcagcctctgctgttcgcggagttgctgggattgttctcatctctattacctcattttattgcattgctgcattaccttgaaatatttaagcaacttagaagtagacttctgctgaccagtgccgtcttagaaagtttctttgtaactttctagtcctaggagaggagtcaacgtgttgggggactgcagtaaataaaactgcccacgcaaatttagcaatgcaccagggagcagtttaatgtgagtttctgaagagtagttttgcaatcgaaattagaaatgtggtagcatgtattatggctgtcatgagtagtttgatttctctcttttgtgtatgttttggctaaactaaacaaagcaaaaaatatttatgcaatcaactaatgtacgaaacttctgggattcgctgcaatctgttatgactggttttaactgaatacctttaaatttacttgccctgctggggtgggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggcgcggagggaggcgggttgaatatgaagaagaaagaaaaggcagtggctggacggagtcttctaagcttccctgttcacagcaaggcgggacgggcctgactgcccacacctcactgcgccctcggaccctaagcacacctgctcctagagagttattaatagagcccccaaatggcttacgctttcaaatgattttcctgcaaatctgatttcttgcatggcacatggcaattaggaggtggatgctagtatctttgacctggggggctgggggtgggcatgggggacagaggtgtgtgtcttcgccctcagactggcagttgagtcttttccgaggagagacgtgggctggtattgagcgtgcagctaagctggtgactgcttcagagaatctcatggctggaaatccgggggtgagggggtgtggggtggtgagagggcaggagtggagttaaaatggggtgtagttctctaggtttcccattcctcccactccttgttttccttttcatcatctttttttttttgtcaacccacagccaacatcgtaattcccatttccctttgagtgaatgtggccatagagtttctccctctctttttcttccccctcttccttttttgaaaaaagaaaaaaaaggaagaaaaaagataatttgatttttaaaaaaaatctctctccctgagctctccccaagtttctttaaaacaaatcaacaacaacacaattggagcagtgccttagctagaatgaattatgccagtatgctgtggctctttccctgactctctcctctgacttgtttaaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagatccctttgtgaagagcattcttaaaaataattattgagtcatctactggattgtgtagctctttggaatcaaagtgaaggacaaatttctattattctttaaaggatttttaccttaactagggtgtgaaaaaagtgtggtttgtttagaaaccactctatctttttcaggaagagaaacttcaataagttaacactgaagagtagtaaagaatgagataaaaaccaccaaccttctgaataccacattggctagtaagtagaattgtttgagttttaaactgcatttaagccaaataaattaaatgcaataattctgtcatcaaatatgggcttttaaagaaattatacacaaaaatgtggttgtaaatctagtttaaatgatgagactcaatcatcattcaaaacccatcaaaaaagcatacattcttggcctttcaccaacatgttggggaagtggggatatggatatgggtattaaatcatgtgttttttttttttttttttcaggacactgtcttggcttctcccagcctatcttctgaaccacatagaagtatacagtatcagtgaagcagctagctgtaaaatgtgggctgagtagcataacacttttatctgaaaaccttcaattcatagtatctgaaagcattaatattctcagtcattaatttttccaactacaaaatgaaggcactttgcaagcatcacagacttattgtaatagttaattcttgtttttgattattgtcatcttttgggggattaaagtgttttggcatgttgggctctctaatcttttcgctactttcagaatttgtgctttcaagtgtcattgtatatgcacaggacacagttgggacatgaagataaacctcacctaatagagtagatgtcatttctgggtaaggttaactgtgggaaacagaaatgtgttcactaaggaaaccttaggtcacaacctccagtttcctgaaggaaatgccaaaaatgctccaaagacaaaaggctggaaacaaactggaatgtctctctccatctgtctgctaaggcggaaggaatgatttcatgttacattcacttcctagactttcattacagagtcaagcataatggaaaagtatgtccattttgtgtttctgtggaagataaaatgttcatattctccgacttatcttcataagcacagtagtgattcatgatatggggaaagatgggataaggtggctggctttgggagatggggagctctttggtgacacttttccccctgtgaccacattatccagtgattagatgtactttcttcctggaaactccagactgtgcatttcattccaagaaagctgggtagtcatggactgtggttttcctgggcacatgtgtggtagagccccagatcagaccaagaagcaaagacataagaagaaggaatccttggttgtctcccaacatgaatatctggttttaattcagtgtattctcagaagtaagaatgagaaaaaaatcttagtaattatatgtttgtactaaaaaatacacatataaggctttgattttaaaattgtagtgtttttcaagaggagtgaaacagatcctggacaatacttgacatattcttgtaaaaagttcaattgactcaaaatagtcaggaaagttatgaagtaacatcatataatactttatccccaacaatattaaatgtgattacaattttacagaatattcaaatcaaaatgttatataagacaaattattattcttgcttttacatctccttagaaggagaaacattcaattgttttaaaaatgttctatttatttttcagaaatgaggtgttgccttcttgcccaggctagtatgcagtggcacaatcatagctcactgcagccttgaattcttgggctcaagtgatcttcctgccccaagcctcccaagtagctgggaccacaggcacgtgccaccatgcctggctgatttttttttttttttaatgttttgtagagacaggatctcagtatgttgcgcaggctggtctttaattcctgggctcaagtgatcctcccatagatttgtctgtgttttctctaaataggttataaataccttgagggaggaatcacaaataactaaaagaaacttttgtagagactatcagagtattatttccttgtggacacagtaaatgtatgatgatgagaaatcataataaactacaacattttctccaaccttccttcctgctcttttgatgtgtacttcacgtggtccaagaaaagggactcaaaatactttttaacatacaccattgccttcactgcaatactaagtggaactagagttgtctctcagaacattcaagcaagcaaggtttacttgaataactaaaggccttatatggattatctataaagaggattttaaaccggtggtttaaaaagctgggagagataggaggaagagcatagtgaggggttagacctgcatttatttcagtctttcacaatctttgacaagaaccaggacccagagtagtttgggttcatgttgaatatatctctcctaatacatccgatctcttgttccctacactttcttcttggattcagactctcaagtaatttctgtttttcccgtgctctcttttttatccctttgaggactaaaggattaaaaaattagacttagctctggttatagtcattagcaagagccaagtgtggactgtggacttgagtgaacaggaattgctacattttatgtaatccaaccttgatatatgaagtatcttcatatatccaaccagaagcttccatatcagtaatggataaatacaccatggtaaattaatacaatggaatattattcagcaacaaaaaaggacctactactaatcttgcaaccgttttcatgaattttaaacctcttatgcaaccacaaaagagaacatacgtcatgatttcctttatgtaaaagttccagaataggcaaaactaatatatggaggtataaatctgcacagtggttgcctggggtaagaggataaactggaaaggaacacgagggaactttctaggttgttagcaaagctctttatcttaatttttaggaccttgttcactcagatgtgtatatttgtctaaacttatgtaatcatattcttaagaccagtgaaatttaaaaatatcaatatgctagactttcacttctgagtataaggactatatgagactttctctgtgaaattgtgggaaggttccatgaagttcagtagaaagtggcagccgtgcacagtggctcacgcctgtagtcccagcactttgggaggccgaagcaggaggatagctttgagctcaggagttcaagatcagcctgggcaacatggcaacacccgtttctacaaaaaatacaaaaaaaattagctgagcatgatggctcacacctgtagccccagctatttggatggctaagtctggagaatcacttgagtccaggaagtggaggttgcagtgagccgagatccggccactgcattccaactccagcctgggtgacagagtgagatcctgtctcaaaaaaaaaaaaaaaaaaaaaaaaaaagaatgtggaaaaggttccaaagtgtttcataaaagggaaatacgctttttaagtattatcccatgacccagaaataaaactttagaatgctaaataattgtgacatgatgatactctttgcttccataggatgagaatttggcttagtattggtatttgtaatccctgaagaatttctgtgtcttgaaagagtctagagatgtaatgaaactgtcacaataaaagtttattgacatttggatttcagttttaggaatatatgatgggttgtaaatagccttatgaagaatggaccttgtatacattgcaaggatatgtaaacatattagtactggagacatacaaattggagtgtgccaatttcttatcatggccacctgaccaaacctataaaaggcattcattcagataataacactcgccctgggtgtaagcactgcattgttagaagagatagcagagcacaaaggatatggaagacaagcttatgttcctgtggatctattttttaataatttcagcttttatattagattcaaggggaacatgtgcaggtttgttacataggcatattgctgtgatgttgaggtttggggtgtgaatgatcccatcactgtggtagtgagcatagtacccaacaactagtttattagccattgtccccctccctctctctcccttctagtagacaccggtgtctattgttcccttatttatttattttggagggtctcactctgttgcccatgctggaggggagtggtgtgaccatagctcactgcaacctggaacttctaggctcaagcaatcctcccgtctcagcttccagagtagctgggactataggtgtgtgccaccacacctggctaattatttatttttgtagagacagggtctcactttattgcctaggctgttgccacactccttacctcaagcaatctttccaccttggttttccaaagtgctagaattacaggcgtgagccatcatgaccagcctgtttccatctctatgtccacgtgtacccatcctgtgagttttataagcttgcagccagacacattgttacctgcattcccctgtctgaggggtctttctttcagccatctctgggagtaactggacagagaagaaatgcctcaggtgctgcactgctccttggacagactgattagatacaaagcagaaatagaaacagggaagagggggcatggttacctcagctaacaaggagcagggagacgtaggaaattgtttatccatttccccagagctctactactattattactccacttttctgctgctttgttgataccagggcagaaagaaaaaccttggaaaaagttactggtgtgggtcatgcttcctactcccattcctcttgataggtcggcaaacttacccactcatccactcaacaagaatgcttgccctgtgctctgtgctgtggatctaggggcaaatataaacagaggttctgccttcctagagctcacaggattcattccttcagctctggcactcctgtggctccctctctttggggtccagggaccttgatatggcaagacaaaattctttcttttttttccttttttgagacggagtctcactctgtcgctcaggctggagtgcagtgatgcgatctcggctcactgcaacttctgcctctcaggttcaagcgattttcctgcctcagcctcatgagtagctgagattacaggcgtgtgccactacgccaggctaatttttctgtttttagtagagacggggtttcaccacgttggccaggctggtctcgaactcctgggctcaagcgacccacctgcctcggcctctcaaagtgctgggattatagacgtgcatcacggcacccagccaagaaacagttctttttttcccatgagtttgttcattgttgtacacttcctctaatatattgagttctttagcagtctaaaataatttcatttaacaaatacaattaatattggcagcttttcatcattggcttttatttaatttatatctctaaattacttaaaattaaataatgaagaataaactcatatttggaatggagagaagttccttgtgttattgggtggtgttgtaaatatcagtatttgtattctatttttcagcatctagtccccatgtgatcaagaagcaactccgtaaaataaaagcattcaacattgtcttcagtttctatctctccttagtttgtgtttttcttcctagatccctattgtgaactgtgctaggtggagctgcttggtttataatgtgcagatgaagtgtacgtttgaataagtcataggtggtgtccttattcaacttggatgaaaaggaaaggagagaaaaattcacaactcaagaggataagcagacttatctactagtgagccattgaaagtcatgtagaggacttgagagagcagcctaggtaggtcgtttgtgtgctgtatgttcagtgattgcttgaggccagggagctggggataactccttgtgcagcccaagaactctgcactcatcttatacaccagctctactgaatccaagttgacctgctcacatttgtgtgccatttctatcaggaagtctcttgagaatgccaatagctcagatacctgctcgccattaccagatctacccctcaaagcataatgtctgctggtgggaggatgagtagcttcagtgttttgtacaaaggagagtatatttatttctaatttcagagtttctcttgctcctgtctagacacttcagagaaaaacaaattcaggtcaccagtaaagttatgttctataataagagaagacttgtgctaaatcacttgtaaagacattaactatcatctgcctgaaaagtcttctctcaccaagcttctgcagatcttttgaggtaccagaaatagtggttagttctcacatgctgttctgcttcagcgagcttcatgtggccacctgcagaaatagttcttggtttctcttccttgtctagatgctggtcaaggcagcgtttagaaaaacacagattttcatattcccattcacacgtgcaaagtgaattagggtaccaaagaattacctagattattcaatctgtaaaatgctttgcctcaattgactgaatattttatatcaacactttttccagctacatatttatactataataggaacctatttttactatatatactatttatactataaaagtaggagttgcagaatcataagaaatttagggccgggtgcagtggctcacacctgtaatcccagcactttgggaggccgagatgagcagatcacgaggtcagcggttcgagactagcctgaccaacttggtgaaaactcatctttactaaaaatacaaaaattagccaggggtggtggtatgtgcctgaaatcccagctacttgggaggctgaggcaagagaatcacttgaacccgggaggtggaggttgcagtgagccgagattgtgccactgcacgccagcctgggcgacagagcaagactccatctcaaaaaaaaaaaaaaaaaaaagaaatttagaagacacaaccacaagagctttctttcatgtatttattaaggagacagggtcttgctctgtcacccagtctggagtacagtgtcgtgatcctagctcactgcagcctcaaactaagcgatcctctggcctcagtctcctgtgtagctgggactataaggtgcatgccatgttggctactttttttttttttttccagtagagatggttttggggacaggggtctcaccttgttgtccagactggtcttgaactgctggcttcaagcgatcctcctgcctcgccgcctaaaatgctgggattacaggcatgagccaccgtgcccagccttggaccttctaattgtaaagaagcaaaaaggcccatataatatacataatatacaccataatatatacataatatacatcatctcactttatatatccactgtattaatttttctgttaaaaaaactatgctcgtttagtgttttatgttgttttttcaaaaaatagtgattttgaattgtgggcctaattagcgaaaattgaaatgtattaaaataatataaacatctgtaagggattttgtatcaaatggagtctgctctcagttctttttttttaacttttattattttatttttaatacagacagggtctcactatgtttttcaggctggtctcgaactcctgagctcaagcaatactcctgcctaggcatcccaagtgctaggattacaggcatgagccaccatgaccagcctctactctcagttcattttctaagaaatttgatgcaagccagtattgttgctgaacttcataccagcgtgaagaatatctggattgcagtgttctttccttaaaggggtactgtaggcacaagagttgtgccgagatttatgtggtcttcagagatggagaagcgtttgattcctagaattatttggcatctttctacactcatctgggttttctcttagatttataaaaaggccagtgttgggcattctgacaaagtctaggttaaacgctaatcaaggcactagagtatatatttgaagtttgtgtgttaacacctatgtgttcggggcaacaaactactagtgtcactagttagctgccagtagttagctgctctgaacacttaggatacctaaatatacatcggatttttcatcaatcttttgtttgtcttctccaaaaaggaatcaattaatgaactagttctgcccccaaagtaacagtttagaataaatgtattaattcaatgcaatgttcaacattgtttgaaaaatctaaagtatttttataattttatttttttcttttccttttttacctttcacacacttgaatctaaacatttttacttgaagaatggacagttatttttctttgtgttttaaaatacaacatgtaccaggaaagggagatggaagtaaaaataaataaataaaatacaacacgctcttcagataggtggcttttggaaagcaatctatgattttctaattctctagggctcagagtctcttgtaaaacacagttctttctatataatttttgctaatggatagaaaaacttgtggggtatttggaggaattaaataaacattgaagatataaaagcacacaagggatgacttttattgtaaagtcatgctgtcatcaaatggtgtgatttcttccctggtgagggcagttttcagtctaccacacctgcctctggtcatgtcacggttgagttctggcactgccagctgatgttaccggtggtttgctgaattttgacttatatggaattaaatgtctgtgttaccatagtaagttcacattagtctttgcatttcattatcaagaatgcactggtaactggcaggaaacttctatttgaagcatagtaatcggaacattttcttattgttaaagtacttttgcttcttccctactttcatttaaatctatctaaaggaaaaaagaggattttgtcttccatacaaaagaagttttagacattggggcttactatagtttctctgtgttataaacgatctccattctttatgtcactccatgaacttttatttaatttggaggaaatccatagtattcactctatatcagaggctgtgacatcctggctaaagctattgaagttggcagcatcatttcctcttcccgaattccttttttggttaagtttaagaaggagcacaaattgagggtgcaactttgtttcccgtagttttgaactggcagggtgtccctgggatttgtggctgcctacttgaacaatcccttaggacagacaccattcacatttcatggctctcactaggaatcattaacagctcagtgcagagttttgcttttcacttaacttgtaagataatgaagaggccctgccaaggttcagaaaaggataacaaagcataagccccttaatgggatgaactaacgtaaaagtctaagtatctggagctctttcccacaagtaggacctgactcagggactggcattcaggctgacaaccaccatatacaagaaactgtaatagaaacgaaagtaatttccctaaaatgagccaagttatgggctttgggaaaataaggatctgttagctttgctaagatcaggatctttgatttacagtgctttccatgaaacggtatatttttattgaagagaatcataggatctagaaagcattgactttaagtgaagcactatttgaattcagctttaagtagactgaaatagctctttatatgattgaaatgtctccatataattgtttgttaattaacatatctcataaaatggcattttatataccatgca

SEQ ID NO: 785 - DNA, 2908 bp, Homo sapiens
tggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaa

SEQ ID NO: 786 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 787 - DNA, 127238 bp, Mus musculus
  misc_feature (1)...(127238): n = A,T,C or G
ggccatagtcagcagtgttcaccccatccagtctcagtgctgtgccagggcatgtgccccctggcttctagtcaagggctgcgcctgagaggcaccaacatagtccaagctccaggccctctacagtgatggtgatgagacttacattattcctaatgacacttttagatacatttgattcactgctgttcatttaaccgactagttcaggggacctactgggtgccaggctagcactgttgctgagaacacaggcttaggatcatattgcctgtgtttaatcccagcgctgtttactgctctgtaacttagcaaattccatggcctcactgtacttgagtctcctctgctatgaagtggaggcactggagtacctgactcatagcattgctgtgcagtaattcataatagagtgctggatccaaagcaactgtcctagaatataccagctatcggctttgttgtgagccaggagatagttcttgaattgggaatactgagatttcctggccttcagatgacctaatacgttgcaagttgagattatagaaatggggttctaaacttcattgatctctattgccagccctttctaataaaagcctccatctttgaacttagctttcttgtctggtcttatgtcctgaactgtcagcctttgaatagaaaacacccagcacacccaccgttcctaatattgcttattgagcttttcttaataactgccaggtagttacagatctgtattcattgcttctattaatctctgccaaatagaactggtccaggaacatcacattttacagatgggaaaactgaggctcagaggaaagcctcagtttataacatttctcgtgagatgttataatgctctgttgctgtgcagtttgtggccctcgtatgtgttctgctggcaatcatttgtaaacacctcccttccctgctttgggctttccctgacatatattttgagatctgccagaggatcagccaatgtcaaaatcagttctttctatccatcacccataaactggctatggaccttgtatttctgactgatcacagcagctattattaaagaggccagtgtgcaaatgaactaagtcactttggctaggacatctttcggatgccttgctcttgagtgagttccaggtgcctgacatttctttcggttttcttctctcaccctaagtagagccgtcgttactgaagcatgactgacagttttgcttttatacacatcatgattcttgttttaggacaagaggcttaatctctccagtaacatctgatggcactggttttttataagcacctcctccttttaaaacatgcaccctcaattttctgttgtcaagaaagagctctatgcagagtgtgatcctgtgtccccaaaagatagaatcaaattcatgagcaaataatacaattgccccttttacttttggtggcttgttttcttttgaaatatatcagaaaagttgcccatagctaatcttccaggtagaaaatctcattagtaatttaaaactataataaactgaaagactcaacctctttcacccacactgtgcccgtattttagaaatgtgttgtatgaaaaagccacatctttttacctggtggcacacagcagatgattttcaccaaggaggttgtaaactctgggtgaggtctttgcagatcaatccactgatggtgttggcttgaaaatgtagcacaagctataccttgctcagacgggatccccataatgtaacatttctctgctctactctgaaaatgaacggagaacttcaatcccttatgcttatcattcaaactgaaccaaaggattatttcctcttggatatagatgtttggaggagggagattttgcactaattctttatatggaggaatcttcctactttggaggcaagagtgattttcatatctgttgggccagaatatttaaggagtcctagcattcggtgatatgcaagacggctttccaggcttctagagctctgggttctagtgttaacacactcgttgcctttttgtgatttattgctccgagttcctgggcctcggtttcctccctagctgaattaggggtgggagaggctcgtctctaggtcttttccagctttgtattctctgggtctgcaaatcgccttcagtgtctgccgtagtctgccttggcagctctgtttgtcacaaagattaatccatcttaactgtaccttggagtgcacccgggagaggaggatggatggattgttttgcacctattattgcatcagaacttttgcctttttagacaagattgtgccatgcctaaaatctgtctgcctgtctgcccactgactttgtctgtgctgatctcttgccatggtgcctcttttttgccagcatccatctccctccaagatctagattcggcatctgactgtacctgtcttgttctctgcagcatctgtctgctacacttctagaccatcgttaataaactttcacacatgacacacaaacccccaatatgccggcacctgcttacaaatatctacgttttctaaaactaggggagaaaactgcatttttttttaaaaaagacccctatctagtgccatttgtatctgcactttttgtttagttgtaagttttaatagttcccctttgagggtttgtcagtacgagcagtattgcttatcagaacacaccaacagtctttttgtaatattcgctttcccctctggttcagccgagcctgctgacagatcattcaaattcaattgttttatgtctaagccgaacagctaattaaagtagggatgattaacctgactggcagtgtcgctctccctcttgcgctctctctccctctccctttctctctctccctccctcctgttccaatcagtctttttctcacacactctctctcctctcggtgtgtctctgtctctcccctctctctctctctccctctctctctctctcctccctctctcttcctctctctcacagtctctctctccctccctcgtttgcgctctctctctctctctgtctcttgctctactgttttttttccctctctctctctctctcctaaacgtggtctgcttgctgatggcagaatggcactcggagatttgtgcattgtgtctggtttcctacgggcaggctgacccagtgcctccagggacttatcaatagaccactcagaagagacacagacaggagagaggaggaggggtggggggagagagagagaatcaatatcaagaatagaaggagctccgaagccattttttttttaaagaagtatcgggacttgggagagggtgacaaagaaggtttttcaaagaggcagtggaggaggttctaataaatttggaaggaaacagttcccctgtcttgggaaaaggagaactcctgactgattagcattcacaccaggtatgagatgttctaccccttatcactgtgtcgcaaccgaggtggaaaggcttttttttaaggagactgagggagcatgtattttgctgtgtttgttgttggggggtaaaaggggcggcgtgaaaggctgtgggcatttgtgtatgggagcagggagaatggaagcagtacacgggggtgggagagagtgtggagtgtgttactgtcttccctgtctttgtgcacccctggggggtacccaagttcatttctagcaggtggatttagacaggagttacttaacgcttgaccgccagttttgaaaaaaaaaaaaagaaaaagaaaagaaagaaagaaaaagaaaaaaaaacgctgcttcctatgtctgctaaaaggaagctccaatttctcctctctctctctctctctctctctctctctctctctctctctctctctctctctctctctctccccttctccctctctgtctctccctctcccccatccgtcttcccctctctcttctttttttcctcttctaaccagacagcgggagggttcctggctcccagccagcccaaaagcctctaagtgttttgcacttgtttcagggagtagctgcccggggatttttcagcattttcactggagaacaaagagttctttacaaagggaagggggggcttaatgtctgatatatgtttttctatttttattagtttttttgcctaaaaaagaaagagtcaggaacagaacattactctataaaaacacaaagacattcaaaagaaagctagttatcttttctctccatcacccctacatatatacatgaaaaattaaaaggaatgactaattaagttggctgtgttgctcttttctcctcctctagtctttctaaattcaactgctcctctgcccgctttgctgttctttccctactcactgcaaaagttgctcagggtgcatcttcccttagcatgtctgttccatttttgtgtccctgaaatcttgtggaagaaagaatgagagtccatcaaataattgatttaggggcaagaacatcctctacttttgccacttttttgggtaaaaagttaattatggaattggagctcccaaaataccagtggggtacatcagctcatttgatctcccaagtttttgcatccatctgtgtaaagggcatctctgtgtcacttgtcagttataaaggagaggtagtaagggagtaggtgtttatattttgtttctatgatataaattaccaaactcccagagacattacttgtcccatctatgatatattagttcaagcaaaatgtagtctagacggaggttttctcaacaattctgattgccatgtagctttgtattctgtttgatgttttgcctatgcgtatgtatttccactatgaatttgtgtttgtagtaaacattctagaatgcttatcactttcaaattaatcctctaacaaaagaaaagagaaatcaggacgggaactgtatgagcaaagtatagtaaacagtttatcttttaatacatgctgtacattttatatttttatactaatatccttaacttataatcccagggaaatgctttctttctgaaagttctgctcttaatgtgtttatattttgagtgtcgtttggtaatcatttgaggtacataatggacactaaactgagcagaggggaaatagctacaagcgccaccacaaaaccctgaaaatgcagactaggctgagcacctaagtgtggctcagagggaaacaactacaacagttgtccacgagtcagaaactctctcctcctcttcctcccatttatggaaaaataaaactcattcattatccctggggccggacactataagaaaaactagaggtacatatattttcccatgtgtatgaactgtacgtctatctgtgtttctaaagggcacagtgcttatggggcagagggcaacgcctcactagtcagccctcctggctgggagggctgaatgccttgtgtttgaagtaacttgataacaaggggtcttttcgggaacccgtctatgtgtgtgctccttcagtaatgaccctcaaattaagcctggcactgggtggccaagctagtacttgacctcatgggaagatactagaagtaagggaagtctgggcaaatccaaaatttctagggccggtcacttgtcacagttgcatgttttcttgcgggaaattcttgaattccactcaaaagtctatatttttgtagaatttgtaaacgatcctaaaatgaaagtcactcaccaaaaataaaagaaactaagtctttaaaaagttttagcttaaaggcaagaggcttggggatttttttctgcccttgctccccaccccagcccccacacatactttgcttggtttctttttcttttcttctctttttttcccctctcctgaatccttttgttactgcagctgttgtacctgcatatttggtttgtgtgtgtgagtgtcctctcctcacccttcatctctctccctgtctgctgtttggggtggccagaggattttctgagagggacagagggaggactggaagaggaagaggctgttgctgaatgcagcagtaccccccccccccaagtcaggcagccccgtcagctagctgtgctgggagagtacagtgagaggtgatagctgtcattctgggattcttcgtaggtctgacctgagagtaacacactcaacagtcgaggagaaaggggaacatagaggaggaagaaagaaacgctctttgagctggaatacactggccctttcttcctggaggcaatccgctctggttcttggcgacgtgtcctgcactatcagatatcatatgactttttatttagatttctttttggagaatggcctgttaggactctgtttgttttcttttatttaatttccttctcccttcacccgctagttttgtgtatctgtgtgtcagagtgtgtgcacgcatgcatatgtgtgtgcagtttttatctttgtttttgttctgttgatcggatgctttatttaaggacaaagctttaattatttcagtatagtggtttaatcatttgccaaaaagaaacctcattccaggcttttgggggcttggggtccatttttaaacacatccattaacccaggaggctgcagctcctgatgcctgctggtcagaccttggcccactcccccaccctcacttacccctcctcctcagcagcgtgcacagcagcgtgaggtaggaaacacctgtgcggagttgtgagggaaataaaagtagaggcaacttcttcaaatctgggctcctgctttcactttaataaacttttttttccgatctttgattttttttttcttttctttttggcaccctctgttgagcttgaaaacatcagagatagttaaggatatgtccgtggcgcttttgtgaggccagctgagcaccactggaaagtggagcaggagttgcaatctattcagagacttaagattaagtaagagatttaaataaggtctttgagatctgtgcgctgctcggtcagggtttggtgataggtggtagatggggtatttagggtattcaaggcagggagagagaaaatcccaaactggagaaagacgagcagttttgctgcaattagtacttttaaaaccttaactcaatcgaatttttattttatgtatctcaaaatttagctgaccaatatgtgatcagctatctttccatgcttgctgtgcaattatactgacaattcttgctgaatttaccctataatttcatgtatttttttagttttggagagttcagattttagttagaaaaaaaaaaagcataacttctctcgatatgcctaaagtggtctatacattattcttgccatactgaacatactagattctgattgtatgtgtatgtttttgtgttacaacacacaagactgccttaaagactcaggtgaccgctacatccttcagacctgtagattttagcttcttgttacttgttctgaaattatttttcatggacctttaatgtgcaatgtcttttttttttataaccaattgtgagttttgttgaaacttgaagagaaatttattccacccctttaagagtacccaaaagggaagggagaactattctctttcagctcaaaaaaaaaattttttttagaaacctttttcccccaacggaaaactccaaaacagctctgtctcagaacgttaaacttggcatgggtaagaaatgtgagttttgctttgtttgaggaaatttgttttcgagacaacaatgttataaatatttttaaattgcctgctgagcatgcgctgtctctgactttattcatagttttaaatacacaccaatgcaatcttctgaatggccacaggtaaggctgtcggtttgtgggattcttctctgaggcaccttcagtgagtctcctcagttttccagaagggaaaggggcaggagctgagctcagacctggatacccttctaactatcctagagaaaaagtgaattgccctctaaggcttgcacactgtacttaaggtaagtactattcaacttttctttcctgtatgagttgcctgccttaactttctggcttattactagcagagtaaatggggaaattttttaactcaaggaggaatttgcctgaaacagaagatttgcagatttaagggcatctattgtgcataaatttagggatccgcgaatttgccagtaaaatgctagcagctcagtgcttacagagcaaagatgtgctagtctgaacatgtctgagctcatctggaatcgaaagctaaatctaggtgggcctgttataatacccgaaaaggaacacatgtgtcttttgtacaggctttttttttttttttttttttttaaagccagccttccaaaggcaagtgacaaaagaattggactggcctcttgctcagttggtcctgtactttcctcctgcagatacacacccaggtgctcttgctggttcagtgtgttgtcatagctgctgaggaacagtctctccagtcagtagtggaaacacttcccacttccagaaagctttatctccactctcgatgtgatgttgtctcatgtaggcatcttctgaggtctgcactgttgttcgtaagcttcacagttctcattgctcctgctcgagtgcagttcgtcattagctctctgttatagtcatggtagagatttggttttcattttgggaggcctttttaactattcaaacaagttaccctcgaggatgaaatttctcatacttgtgactcggaagtgaacttgtcttgaaaagatttgtaaaacaaatctaattagctgtttggattttgttgttgttttgttttgttttgtttttgtattttaagttcatgaattttaaacattataataaatgtgactgatcggtttttaacagaatatattttgctatgcagtgattttctaattctgtcttctttgtgtgctttaagatcaaatttgaaaattcagcgtgttaaaaaagaaatattaagaagcctataggtagcctattgatatttgcaatacccactttgaagtaattcagagttttaactttctttcaacctactacctttcattgccaatcggtataactttatgcaggtgtgtgtgtgtgtgtgtgtctgtgtgtgtctgtatatagttatagataaacatattaatgcatacttacatatacaataaaagatacacaaagacacttaatatttatgttaattatatttttatataaaagaaaaagaatccgcgaacttttatcatttttctgtaattttaaaatcctataaactgttagttctgattattatatgtttataaacatgtatttatatccttataagttaccttaatttatatttcataggttttacacactcctccattttatgcagatatattaatgttgaagtttattcaaataccacttgctgtgttccgtatctgttagtgtgttaacaagtggtttggttttttgtttgtttttttctttaattttgatttattcttctctaagctagacagagtatatgtttctctatgtcactgatattctgagaaagaaacttgtaaaactgtgatctcctggaaagctttcaagtgaacaggacatctatatgctctttagcttgcttctcctggatccatttgtccatgctgtgccatcagcaaccctgagaaaaacggcgctagtaaggatggcacaatgagttttctgatcatagacctaggaaggaccaaagaaaattgtggcatatggaggaacatgccaagaccttctccaataaaatcagctgctttatgctggtgggttggattttttgttgttgttggtttttgggaggttttttttttttttttttttggtttttttttttttttatttcctttgaatttttgtttgtgacttttttggcttgctggagcatttccctataatcttaggaagccacagcaaattttcaatgccacagcaacactgtgcagccaaggaggggcccagagagctgatcctggggggctggagcctttcagcaatcatacaaggtagggggtaaggaagctatccttttctctgaattttcctggtttattcagtctgccagggacagggattttcttcgcgtatctttccttcacttacttgaggctctcccttcaatgccaatggctttctattgcttctgagagatggttcacatggcagagcacccgcttctgttctatattgaaacatggaaagctttgaaaactgggaaggacaaaggaaaggggtcttagggcatctgggaaatatcaaaaagagcattaggctcacagctagtttttgccggtcatgtctgtaacttctctgttctctacagggcttctcagtgttagagtactgaaggggataactctagggtgccagcgaggatctaactgattcagtagatggagctcttcgccctaagtctggatttaaattaaagtcccactgcagttgctgggactctctgtattaaggtgtgtcatgatacacacataaaaccaaagcttgtgtagctgcaggaagagatttcctggcactttttaaaggcatgaagcatgtgttccgaaacacaaaactgcaggggagcagtaaagatagatagggtaggaagtgaagtttacctatctaaacttctccctgtgggtttgaatactcctaagtgtgaagtaaaacccagttaccatacaagggactggtactttatagactggtactccaaacctagaaaaacagataatgtgtacaggtttggctgtgtttgtgacaagcctttcaagctgtttgaactgtacggctctccttttatttgactccgaaaaggaatcttaatgctgaaatgcagttgtttcatctagttagtctagagaatctgacgaattgtgacagtactgtggacagcacagcagatttgtaaggtgcctttataggagcagaaatacccaacagtgaccgaaaatggatctctagtgtctgctgtaatatagaaaaaaacccacttatttatcaatttttaaattaatcaaaatgagtaattgccatagcattcttgtcactttgtattatcttcagtaccaatactaagtttgatcattgtccctccttggtgccaggaaggaaggtagatgtatgcaagatggaataaattatcttccttgatctaatgtcttctcacagattagaggtgttattgagaatctcttgttaaatcttgataagatcatttggccaaaacagaactggcaatggccttactaccaaaataaaaagcatttttaaggccttggatttcctttgcacaccacgtgtctgagtttgatacagtccaggaaaatagagaggatgagagaaaattattcctaagcagccgccgtaggccaaacactgaaacagtgccagcccggaccaatcaggggggcttcttaggagatgtgtgctttgctgagctcttctgtgaagagaagagggaggaagcccttgaaactgcattaggatgaatgagtcttcactaatttcagcaaagtccatggcagtgaatttgataacttcttccttctgtagacatctgaggttcccaggccagcagagactcccttgtcatcgcactgacacatcttttgaacaaaagtatctttctgagtttaaacaagtgaaaaacttctcatagagagcaaagagtaaaattaatggaaactcaaaatcaattccaaccccatttctggcatgatgagagtaacatttgtgctgtgtttaaagcagtttaacacaagaaaatgataaagtgatcaatatacttaaagccaaaattaaccaggagagaacaatctgcaatccgttcccagcccgaaactctacactttagattaaacacgaaataaatgagtatatattttacagagtggtactataagccttataacataaacagcaatgctgagatgccagctagccagtgtattatttaagctatgttttcagagcttgggataaacatttctggagctaaagaattgtgcatttatttatccgcatgcacatactatgaccataaaaagaacaaaagttaaaaggtatgtgcattgtcagtagagtacattgccactctacagccttcatactataaaagaaaacaacaacaacaacaaaaaccaggctctaagtaaagcaaaagagtgttttaggctacgtcagcaagtcaatgaatggtcagtgtggatcagatttaattttttttaaatacttaaatgctttttaattcattaaagtcaataaatatataggtgcatattgtacatattttatatctattattttaataaattaatctgaaggactaagttaacaataaattctgaacctgtggattcaagatcaatgaaatgccactatctggatttataaaattcttgctagtcttcagattttgttcccaattagcaatcttttattactgtatcagagtcatttggctgacaggttatttattgatcatgtaaaatgacacatgtagttgaaacttagctgacgaaataaagacaactacgtgcaaacacgtttactatgttgactaaggtgcagtaggaatgatgatgattctaacaagcaccatgacgaatgtaactacagtgaagcatgggtgattacatccatcagactgaactccatgagcaaggtcaagagggagacgggagctgggacgaagtggggactaatcattacttattgcagacgtttgaagcttggggccgggtacagaattaatagatatggaaaagaagagtcaatcaatttcaaagatgggtaaagaggcagtatttttcctatagggtgtaatcaaggacataattcagctcttccagggaattacagtaacatcgtaagcgttggttgaccagtgtgataatggttgtaaagagctgttgtgcacatctgcttaaacagtgcaactgctagaacaggttgttgtgctttaaatatccacaaagcaaatgtcagcatcatagactcagaatcattgtatctcaaagaatggagaaacccaaggtatctcagtgaaagaatgttggaaagatgtaagaccatgtaaatttaatacctatgtgtatgtgcatgtgtatgtacacatatgtgtgtgtggtttgtatttggaaaacagaattgcaaccggaaatcttaagacagaggaagtggagctgcattgatttatctggaccggggctgctataccctggttcctgggaagcataggttctaaagagggaagagctgcaggttccacggagaagctaacagagtgattgtatctggaattaaaccattaactattccaatcagaaaacttacacagggcacaatggaagattgttctcagaatgagaaaggtaaaagtgagatgtgaagggaagttccctgaccactgtgccctcctgccccagatgaacctgcagagctagacagggccagtactccaggtgtaagtgaagaggagagcaaaggcacatagccttcggcttcctgacttgggaccaataacctcccccataaatgtggcaggggcagaggtaccctctgtcttctggaagatattaaaaagtaccaggcatatcctaggggctcactgaagtttacactactcccctgatcccaccaaaaacaagaaaagaagaaggcggggaggaaagaactttgtagtcacaactttcttttcaaaagaagtcaatcttcctccctaggattctgctgtgcacctcatgcatttgcctcccagactctctaaccaggcagtgctgacgcaccgagctgatgcccagtacaggctgggctctccttatctcctcagcattccccacctcttctcatctctttctccaaagagtcgcagacaggaactcctccttccttaatgtctatggtactttgtatattttagtgactcttgacatattctatttcatagactagttgctggtttttgtgtaaagtaaaaaacgattctgtataatttggggtaatgtatatacttttattgggcctcattttccatctttgtaaacaggaagatagtggcagcttgcttgggtagtataacgagcctaggaaatgtcatctataatgtgtctagcacacagttaccactcaatatcagtttcattactactgtaactaatactctcccacttctagggttttccctactaatataatccttaaagccataaattagtttgttatctcattgatcagtgtacactatgatttttacataataggatctggataaaagtgtatagactctccttctacaagcctatattccatctgttcttccctccctaccctaaattttctcaggagctttagccagtggtggtcatggccagtaccagctccaagtacaccgtaaaaggtgtcagtgttatctctgtggactttcagcgccatgttatgtttcgggttccccatagaccttcagccactagcagtggctctttgtagcatctccacagtgtctgcttgtattcctggttatgtgattaatgagcttgttatagctctgtctgtggcttgaactagaaacttgcacgttggagagcaggtcaagatctcaaatttcattttgcttgcatctgttataagccaattgtgtattcattacatttatagattccctcttcagccatatattttcatggccgttgagaacacctgactctatactgaatgttcctagattttactttggagacctgaaaatatagcaatgaggcttggtgatggctagctatcatctttgacattttcttctcttaatcgtgtaatctcagctaaatttgaagaggagacaagaaaggaagttttaattgtccagagtatggcattgtaattcttgattaatgagatttatggtcattatagtttttgtacacattgctgtttttccaaagatgtaatcacatattgtgcaaggggaaaaactactaaaactatggaaatgattttttaattgaagcatataaagacagagatagaactaacattaaatgcaagggttcagctgtaggcagggtagcacacaagggaaagtgggtgcgtttggatgttgatccttccaagtgttggtgagaaaatgaagtagacaatgtggtcatgcaaaggatagactggcatcgtggcattctcaagccaggaagaaagctgcctttaaatctgccagcattccacttatgtgactggtattagtgaggaaaacaaggccacattttggagagctggtaattcaatgaaggattccaactttgccggagtaatagtgttggcatcaaaagaaaaaagttttgcagacttttgtgtgtgtactgctgttactggtgttcctggtgggtggctgaatcatcctgatggcattcaacaggaaccagctgctgagaatatgaaaatgcatgcatttagtcctctagagagacaggagcatctgcaaagtcctccctcccgtcctgatagtgcacataatcccaaggagcgctctctagtagttttaactctattcatttatccatcttctcttcctccctttcatgggaaccccgagtccagataatacagttatctggagtatttgagtcccaaatctacaccaggttgccgagtcaaacagtgaacacttggccaagaactcaggctttgccttgaattccaagctcaaggggagaaagtggcactcccctctctgggactgcctggcttaggcagtcacactcaggttcctgcctgcacagagacaccaactcctcccgtcccataccctggccagaattttgaattctggacaggcttttgaattttcctgtctacgtataaaacctgtggatcctctgctgttcttgtgcgttgattgtattcttttcttttgtaattattggtggattttagcttaagttttggttttggttttgattttggttttggttttaggctagcatccacacctgaggaaaatgcaagtgcaaagagatctgcactccagaacccgcccagtcttcccatctctaatatttatgaataatgtattgaactgatagaaaaaatgttgaatatgttcattatgaattatattcatcagtgtgttgcctggaatataaaagagcaaagcagttgcagtgttactacttccttacaatatatgcactggtacaacagagctctgtgtccgttcctagtccactgtgtgccatccccaaaagtgcacgctgcatatctgtgcagtaactgaagaggaggacctgatgggatgacagacagcagaggttcaacggcattcagagtaggctcaggctcctacacggaagcagccatggagagggattgatggtgcagtggcctttgaaaggagtcacgttcacacagcagacattactcaaatgtgtcaggtgcagagaatgtcaccggtcctaccatcaaaaaagagattcacaatcttgatcctgatattttttccagattaatacaaataactaatttgttgccatttgaaagtaaacaagaatgaaagaaaattcataattaaatatttataaggaatagcttcaaaaattcattttatgctttttctttatggttttccttcattatttcattatgtttaggatttgttgggtttggggtttttggattttgagggtttttttttaaaactgtatttcctaggcactcactagatgtcatgagtacacactaaccagaaacatgacaacaggagagaaatttgggtgttttttagttagacaaataatcaacagaagaggcatcagagttaatataattttaaaatagtctatttctaccctcatgagagtagaggcaagatagatcatgcaaggtcagggactaattgggcacagcccagttgaggacatttccgagttaaaacagtttggtggaaaggtaggacacaagctctggcctttcttgggctctcaggagaacagagggtattgatgagcacagactgcctcagagaagcctctgcctcctcttttctcaactcagatcccagatgctcagagtccaatgcatcgttagaacctatatcaacgttacagagatcacacagcaaacaacatatcccagcgttatttacacttacacattttagagatgttctttctctcctatgatctcttcaaaggctaaaattcataatacctcattaaaaaacatgcatacacttcaaaacaaacacaataacaagtaataataagataaataaataaataaaataataataataataaaatagtttataaaagcacaaagagagagaaagaaagagggatgggaaaagcatgcttgcagaaaatttatcctgtccaacacttacatccagtcaggagaaacaatagcagtatgacaaaggagacagtgtgatctcctgcgcttcctgaccatgtcaaacaaatagaaagccatctatcccctctgcttcacagcaggactgctaaagctggtggtacacacatatagaaatgtacatattacagctttctgtttatagcagaggagaatccttttaaaataaacaactcagggttttgagtatatttgttatgaaggtcagatacttttttatataaattctaagaccttcactgctaattaccaatagttaaaatacttgaaaatgatgagtgagccgctaacacctcaacaaaacaggtttttaaaagtagggggtcagtatagagatccaaacatatctcttaactgaagaatcataatgtccttaatgaacatactacaaactcatttaggcaaaataaaagataagctttgccaacagatagctttgaaaatgctaaaccctggatatggccgttgatttgacaccaaagtataaatggctataggagaaggctagttgtgatatgttataccgcaggcatggtatgacttatgccttcctgacctctcagcagctgtgattacccacaaaagacctgcacaaggctaggactgttaactttacatcatggaggggaggagaaattcataatgctgcccttctccccagggattgatggacaggtgacagttctatgcaccccatccctagacagtcatgagttgttgggaactaggcattttcttcagtgagatagccactttaaagttgccttgtgcttctgtaagtaaacccgattaggcatatccacgtaccagggattgagtgagatatgtgctttggtttgtcattggtgccctatctgaggtgaatagacatttgatcatctcccccaggaaaagttcagataacatgttttagaaaatgagacaaaggcagatatacaaagaacaagggtagtcatcagtgcctaccaacatctgtccaagccatgggactgtctcaacaacaatcaggctcagtgtatagaaggcccctaagatggctgagaacgaggccatggtcatcatactctgtactgcaattattcttttgattgttgtggctctttaatgtctctttttcccattcagccctggctgtaatggtaatgacgtgaggagggcaggtgaagataaataaatgtgatctttcatatgactgctaccctctaatggcatgtcctccagcctcttccaagcatctgggaaagagaaactgacttccatggagaatgaagtcatagctccagcttagcctaagcagaggagagtggaggaggactaagcataccgttagtgaaacaagtgagtttctgctgggctggaaccaaggtctcctatttcctctatttttccaaactgaaaagaggtactgtggggactcacctgtacttctgaacccgtatgcacatgcctaagacctgatctaggtaaggccaggcagaaagaaatcaggacatgcttgcatccaagaaacccagctcctttgtaataacttctgcctgttttggtttgtgttttgacaagcgtgcttcagttcccagtcattgatgccctgcacatcctcagatcatgacaaagtagggatcagtgggtacaacaaaaacagcagagcccagtgcattctgggccatatcagacactccaactgggtcatcaccctaagaaagcaaagtcaacctcgagctgtgagagccgagggtatggctccaggtttgaatcttggtgacaatgggacaagaaggctcggctacagaatggtaacaagccagggctggctccatgagtgcccagcatgtgttcctgcacaaagccctagcttggaagggccccatgctcaatgtaaagcttcactgtggctatctcgagattcttaatcatttctaataaaaggccacacagttctgtacttagccctaataactacaaattatgtagtaggtcctgcctgcctggaatttaccgtcctctggcatgccaactgaaggcatcagtctcatgtcttctgttagtgaaaatgatcctcttttgattcctcagacgctcattcccctgttaaactctttgaagattcctctccaagttaggtggctcaaagaacccatctcccttcctccctccaaatacctcaagatgatcatgatcaaggtgatctttcgtattttataatcaaaaactctgtagctgtcttagccaccttgtttgttttgtttgttttgagatttgatgtgtttggctgattgttttactaaaggctaacaccgggagaaatagttatatcatgtagtaaagtgtttgctgtgcactgctatcgaaataggcattggccgtcagactggagaacggcatctagcattttgattgtcttacctgcggtgtttcttagctgtcatgtaatcaaatacatcagtctaatgaaaacaagttgatcttctagtcctgaccttggtcttcagccctccacctccatgccactgctggttgtatgtcctctgccacccttgtcatcctgtctctcaccagttattaaccccttgtggttctcactaaaacaacagtggtcttattaaagtgggtctctccatggcctactgagaataacttttgctgagtgtgagacagctacagtaatccctgcctgtcccttggtaagtgtgagttacataaccacacggtctggagccttttctcagtaacagccttctcagaatattctggcctcctaacttccagtcaagtatcctttccaatcccctggggagggaaaggcaggttgtccacattcctgaaacataaagttcacatgcctggctcctaaccagtctccaaacagccatagcggagaggagaagaaagtacttttatcaaacctggggaagagatcattatgtgacaaaagaaacctcctaagcaggtctgtctcagaaatgcactggagagtggagctggcctcgcacagcttggttcactgactgtggaagctgggcagaactgcttctccttcctgcctctcccccttccacaacacctcttcacacagtgccctcctccctctaaagggaaagagaacagggggaatctaagagagatagatgctaagctgggtaggtttttttctaattcaaattgaaaggaaatcaggtttacctgcccttccctgaagcttgcaagctttcccaggatttctggcctcctggctaagaacaacataaccaagtcaaccctggagcccaaaggctgagtgaggctttccagggctcaccagacacaagcaagcccaccacccaaaccacagagttctgggcttgaccacccctgtcatcctctcctttgccagcagagcccacggccctgtgttaatctgattacctccttcaactttccttatccccaaattgtctctattcccctcctcctcctcctcctcctccaccaccaccaccaccaccaccaccaccaccaccaccaccatcccccgatctggcccagtttaaattcaaaacttccttccactgctgtaattgttggggttgaagtggtcaaagcatcaagacatgatgagtggcttaaccacaggatgagatgtttgcatttcaaaagtgctgcaaattaaaatgtacttcactaacagggggcatctcgggcatcttgcctacagtgggtggttattccttctgagccaaaccaggctgctgagaattagccatcgtcctcaatgggagcagatgtgctcacctcggccatgtcactgtagacacagactggaagcaaactcagaaaaacaagctgatcaaaggaggaaatgtagttttatgtggtaaataatcagccccagcatggctgctgagggtctcctatgaaaaataagtcacaatactactttttggttttacatgaaaataagttcctactttaaagtcaattccctatgaggttaggctacaagaagagtgcaaataagtttaaaacctgaatacttggtcaagactttggcctccagagaatggtgagcatttcacaaattagaaaaatcacttgcttcagggatcttatttacattcttcttcaaggtcatcaaacttagcagtaaaactgagtttggatcccctgggcttcttaaactatctagattttctccacagttacagacactgctaagagaggccaccctttctttctagtctttttttccctctgtttgttgttcctacaattccagagaaaatgttaacaggagaattaaagaaagactgtgtggcattagaggaacattagcaactattgaaaaagacatttgacctatttctgtagttatcaatgtgatagtaagtgttgccaggcaatgcaccattgacagctgggagcttgggctgcaccagcagcctgttctcaggggccttccagttacagaaggtggtaattctagttaataaaagggtgaacttcaaacacgttttaaccaaatcaaattgtagcaggaaatatcatattactgatgtgcaggccgactcacagctggtaacattagtcactatataggcccaaattctgacttttcagcattttcagatgcatttctggctgccagagagttccccaggcacattgttatggaggaataggagatttttaactaacgtagaagctagaataaataataaaaaaaattttttttctcattagactttttattagattgtcagatattcaaatatataaccaagccaaacttcaggtggtcgaaaggagagatttagagccggaggtttttttttttttttttttttttaattttttttttgttttgttttttttttccatgacatgttggcaaatgataaaagcgattcactctgctaagcagagatgctgggcagaattcccccaacactgattccatgccatgaaatgcacatggagcctggcctggcaaggcacagtgtgcagctcagcctttgtgtcctgtggctcgcatttgaatcctagcttagcccctctgggttctgtgaccaaggaaagtcacctaagccgtgacccttaggattgccatatagaaaatggcactgtacccaccatccattggtttggagggccaaataaggtgacaggtggaaatgcgcgtgagaagatggtgccagacaggtgctgaagcagtcaaaggtgttgatggttatcttcctccattttgctttttaaactgttattttaaaaattaaattcccccaaaaaacccaaaaccctatattttactatgataaaaatactgctgcccaccctgaagactgctcaggtcagtccaatgtgtaaatagctgtagtcacctcatcgtaaccacagtgaggcctgcacccctcagtggtctgtactgggttcgtgcagtcagaacatagagggaattctaatcatgaccgctaggtcccacactgcatgtaggcatctaattccctggagcctcatgtttgtcccttgtcctggtccatggaattaggagacctgtcagacacctttctgcagattgtctactgcggcctggattttttatttctaaacttttcctctgtacctgtgtctccattttcacagagattaattctgatttggttcgcctacacttttgatgctttaaaagctttccattgtgggcagattgtctcaaataccgtatttgagggtggaaaagaaaattctgcccaaatgtaagcaccacagaatcaaagaaacagtagtgttttttttttttttcaattgcattctttgaggatgtagacaaccttgaattctttacaaagcacatcagtaatgccatcctcccttctcttacacatgcacacagaggggtggggggggggcattcttcaagatgtaaggagacaaaatgttcaaaaggaataaaagtcgaaagatagggttattctcttaaaaaacaaaactagaagtcagaacatgtgaattctgtttctgtctccccttcttggttgtatctcagcctgtccccctctataaccccactgacattacctccagggaacatggagtctcctggctcattctcttgggggaaaattcatttgttactgttttgaaagacattttgatacctgtaccaagggcactttacgtgggcaaagcctttgcctcatttgaaaagatgaagacctgaattatgcctcccatcactcttcagtgggtaaaagggtgaacttttcacactagcacaggaagaaaacgatgtcatttgaatgccaacttctaatatggttttaataatcatataaatgtctatacttggtgcagaaacactggccttggctggccttcaagtgactttcactttacatgcctgtctttggtaaacattagccagagagggtcttggggggcagtgtgtctctcctgtagcccaccatgtacactgatggctacttagtggaaagcctgatgtggtgccttcctttgttgtgcattgacccatttagtgtgtctgcatgagggctttgcataaccagggggcttacttctgaacagttaaagtgctgatttacacgtcacactcgacactgcttgttccctgttctgtcccagtggacattggaacctgctgtgtgcctcgtaaacagagttgtagttccctagaaggtagcagcagaagtacaaggtgagggctggagagagtattacttaagagcacgtgatactcttgcagagaggaccccaagttcagattccagcacctgtgtcaggcagttcataactatctgtaactccaactctaggtgatcaaaacctctgcaggcacacgcgcgcgtgcacacgcacgcacacacacacacacacacacacacacacacattactttttaaagaaataaaagatatattgtgaatgttgcaatttaaataaatgaaattaataatgacatgtgaattttgggcaacaaattgtctcttctgaactccacaaatgaagctatctcacagagatcattgttcaattatatctgtaaagtgtaaagaatttttaatttccatttcatttccaatttatagcttatagatgtcatttcttttcagcaccacatgcattgtttctggcttaccttgggttagctatgttgctgaaattagtctgaaatacctagactcatgtaattttcctgcctcagcctgctcagtaactggagcattcttctccattcttgatatttccacatttctaggtttttaagtgaatgggtgtttatttattaattaacataataaattacagagttttttctttattaatatagtcatgttgtttcagttacctctttacttcagactttgtctatcccataacacaaagattctagggttttcatttgagcttaaaaaaatcatcttgaattataatttggcctcctcctctggattcacacaagacagatagaaaattactttttctttgtgagatgagggggttttctctttcatgggactcttatatagttgaatgacatagctctctggataaaaaccttttaattcctagaaaaaaataacacatcagactcataaatccagattgaggaagctttggcatccccacacaaataattttatacatcctacagttcaaatttacaggtgaaggttttctcctctgagcttttaggataggtgcagacaagccgtaatgccagccattaactgtgacctcagtccaaacgaagcagatgatttaaacgcaaacgcttcactgttcctctccagcctgtctgcatttcatttgcacaaagtgatctgaagctagtaccctgatattgggtcacaggaagcaatacagcgaagcatttccaaacagacacatcactctaccctgtgttaggttcttcctccagaagcctgtctagcagcaagctagcaaagccagtctctcctcagctagcattctgttgagtcatgtttactgtcccccctcaaaaaggttccaaaagcaaatgcaagaggttgccgaatgcagggacatgtggcgtgcgcaatactgaagtgagaggcatagcatgcacctgccttgtggctgtggcgggccatcttgactgcgccatgccacaagttagcattttggatgagcaattgccattctgttgttttcttctcaacacatggtgttcaaaaacagttaaaagaaaactgtacccatttgctcatcccagaaatctaaaatttcaaaggcgcatgccaaactaattttcacataatattttccaagctttttctttgcactgagaaatgatacttcactttttgaactcctggtatcctggcctggggtaagtgggtgcagtttctctttaaatggcattaaacatatcaaagcaggattatatctgtcactgtctttttttttcctttttctaatggaatcaaaatccttcagggagtgtcccaaatccacattaatgtctttgagtgctaatgtctccgctgggaccttcacgttagcaaaataacaagtgtgtggttcccctgtgctgtctgagttagaaagagctgaaccacgcatccctgattctccatggccttcagctagaagatgagtccagggtccgggtgttgctgactcctttttggccacttctctcccttgtgcagcttgcccacaaagcttctgtgagagctgtttctaccatgggcgaagctacggagtgccagccatgaatcgaatcaaaagggccaagcttcgtatctaccagtcttgctttatctctgttctgaatgtggaaaaattgtgaagatacccagagtcataggacatggctatgcatagttttgtcgcggctgtgagggtatcaactatgtgtcactttgatgctaaagaagtatcatgctcacccattcccctccctctttttgtctccttagcaaagcaattgagatgattccttttttatttattttttattttttaatttttgtcaacttctaattatcaagtgttggtgccccatcatgatgccatagataataattataaagagtagattctaatgtattaataaataataaatagttactatttaatcttaaaaccgaccttttatatgcatttaatgatgttctggaaatttgaggtatttctttgttattgttgtggttttggctttggctttttgatgcaaggatactactctacaaatccctgacttgccttgaacttacaatgtagcccaggatggcattgacttcacagcagtcctcctgcctcaaccttccacatgactcattcacaggcatatacctccacactcagccatggcactccttagatatttgttttgtttgtgtagagagcagggcaacatcaggttttgagccccagggtatcatggtcaaggctgctaggaagtgtttggttttcccatcttctcaagttctagagcattctgagaactatcctcctttcttttctttccaccctttttatcctgtccatttttttcttctatgtcctttcgggtttttttttcctccctttcctacaaggaagaagagaagatgaagagtttgaaactggccgtgtttatatgtgtggaggtgctcatgggagagttcagtctctgactggccagcctaccactaggcagggataaaaggttatctcagatggcttctctctgaaggccttcacgtgtggaagaaaactcttgacagttttttcttctctacactttgcaaaagtagatgaagtggaaatgtcaggatagtgcaggcgatgtgttcacctttacatatttttgataacctatttactggaactgaatgcagaattaagtgggacagatttttgtgtggttggcacagattttctggtacaagttttagagagttatttacttggttttttttgtttgtttggttttgggtttgggtttgggttttttttgttttttgttttttttgcttgtttttaagcattgattccataataactttgcagtatcagataaattatctaatggaattggaaaaattgccttttaaacatgagtcacttaagttttcttcaccactactcagttgggtaggtctaatgttagtgtgttcatgctagcaggtttaaatggtaagatggctaaaagtaagtctctatgcttacactaacttctgcactaacttcacattgtggactagatgctcacgtagaagatcaccagtggtatttatattgttttcatctttgcgcttcctctttcatagagtttgccagagaatataagctgtacagatcaaatggtgatccaaatgtgagtgccataaattaccctttagatttgagtgtctaattaaagtgaagcttcactctgccatggttcctttgcctgaaggaagggaagtgaacattgctgctctgaaggtctttagacattgaggaaggcggcttgtatacagcctacggcacctgagctttggtgggcactcctaggctgttctgtcctctcttcccctgggggaatccttggggtgggggtgctcttgcctttgatctcacggttgccactagtcatttttctcattaactagattgagctaatgatactcattagtttttagccactgaacttttgtttatcacaaggaagccattgttctctgccttatattacagtatagctggaagcaaactggcttggagactgcctgcagaccagttcctgcttcgtccccagttctcaccttgacctacattcccagggctgaagagcagcaaagcagcaagtcccagaggcctctgttctgcagctcctgagggagggcagtggatctgggataggttcttaggtacatccaaatactcagagcagctgacaacagcagcttatcctgagcttccagggacttccctgatcattcccagtgtcagagtcaaatacaagcacagtttatacctcctctcatgagtcaaaagtaatggtcatgaccaatattaatccagtagtaattaattgtctatagctatttgaggtatagagcagatagaaaaccagtatattgtaaaacctgattagatcgaataaaatatgtctagctatgtgtttttgctttcataatacttgcacaagttgtgactcaacacatgtttattgaatgtacaaatgtattcaatcagcagctcctggccatgataatgtcaattaaaacttagtttccagccgggcgtggtggcgcatgtctttaatcccagcactcgggaggcagaggcaggcggatttctgagttggaggccagcctggtctacaaagtgagttccaggacagccagggctacacagagaaaccctgtctcgaaaaaaaaaaaaaaaaaaaaaaaaaaaaaaaaaaaaaaaccttagtttccactgtttactgccccagaatataccttacacatctatatatttatcccatacttcttcctctctacatatctgtgtgtgtgtctgtgtgtgtgtctgtgtgtgtgtgtgtgtgtgtgtgtgtgtgtgtgtgtatactgttcaaataagaggccttggaagatgcaagatattgtttaaaaatgaggtcataagagactcagttgaacctgataacttcaaatctgtctttaaactcattgttgctgagatcaacagctgtgtagtcacctctctgaccattagtagatcctcagtttcctcattacagaatatctaaatgatcaccacttccaactccagaattccatccattctccctagtgagaaatggtgtgtacttctgaaaagtgtgctattgtggaacatggtgcaagtttgtcctcaatgtaagagtcacaaatggacttcattgagaggctgggcacttctactgcttttatggtgtgtgtgtgcacgtgtgtatgtgtgtgtgtgtgtgtgtgcgcgcgtgcgtgctcgctcgcatgtttatgcaagtgggtacagatgagagtgtgtgtgtgtgtgtgagtggatatgtgcagtgtatacatttatatatttgggtgcatgcaagagtacataggatactatcagttatcttctttgatttctctccaccttcttttttttagaaagagactctcactaatcctagaactgacccattagactaggctggcttgccagtgagctccagggatccccaggtcactagcgtttcagctctgggtcccagatgtgctgctgcacacagcttttacatgagtactggtgatctgaaccgaccttactgactgagtcataaccccagatgtaggtacttacttgactgtgtttgtggagggctgcatgtgcatgtacagtgtatgcacatgtatatccaggggcactcacttgtgcttgttgaggtcaaaggtgatcatcatgtgtcttccattgcgcttcaccttcttttatagatttgtctatttatttatttatttatttatttatttggcgggcgggggggggggaggggaagaggccacctgggccaatgtgtaggagtgaggagcagaagacaacttctgagagttggctctttccttctgccatgtgggtctcaagtcaaactcaggttatcagacttggaaagagataccatctctctgaaccatccccctggccaactccacctcctttttgagacaagttcccttgaaattttggttttcgtagctagccagcaagcccttagaatcctccgtgtcagcccccagctctcgagctgaggttataggtgcgtgctgcaaaaagagacggagccctagccaatctcctttctccgcgtcccactggagtagacggagccctagccaatctcctttctccgagtcccactggagtagtgctgcttttgtggagctgaggttgcagcccctgtgtagcttgtggattccaaagggatgctagatgctggtggccatgggttttagtcacctccccgtgtccagagtcacttcttcctggtggaagtgacttgccttttcccttttgatgactgcatatttaatgctgaggctgatagagcctgactgtctccatcatgaaaaggtttttatgtcattaatatgctgatttggttcatgaaatagagagtaaactgccagtgtggttcggtgctggggtggctcctttttctcttccttttacaaggaaaaaaaaaaagactctaaattgtgctttacgaattatctttctccccttttatatttgactttgaaaatctgtcttaaaggaacaactctgaaagtttccattccaacatctgcctttggatgtaaccctttgagtgtatatattccccatgctagatgactttatggctttggacacctcttccttttagttgtcatgagcatgctgtgccctggacttccctcagggtcactttggcatctaaaggacagtgactgccctagatggtgccttttggtatccaaatgagtcctctgcctctgttgccttccctctctcccagccgctcctccccctccattcctgaagaagagtcttaaaatttatgtctttatgataaaattcaataaacatccaaccactagattatgatgagtgctaaggggaagactcagaaaacacatacccagtctcattttggaggccacttttcaacataaacggacagcccttgggggaagccagcctcccacatgtgagtggaaaagaaacagaggtgttgcctcctctgcgtcaggacctcctcctccctgggctacagtgcagtcctgctcttgcttaattaatccattaaggtctatcttgaccctactcggtaatgatcgaggggctcaccggagccatctagaaggggggaattagatggataatgatttctgtgcagatgatgtgttctgtctttttatatagttggtcccatgagggacatatttcttcggtgtatccctgatgatgttctcaagacagatatattacagaggaataaatcaggctattagacattgctagtgtctaattcttcatgtgtaaagtctgtgttttaaatatcaaggctttgtaagatgtatttttattaatgtaatggtaagtaaggtagtaagctaagtttgagaaatttcatttcagtattatttttcctgcactcaggtgctcttatggaatatttatgttccccgccttgtcctgattgctccctcctacatcagtcagtaaactgtttaagagggttcctcctcaatccaactcaacaagtgtttactgatacctgaagtgggcataacagttgacaattctaaaaaatcaggaggcttaaatgctttctacagcttaaagtattaaaacaggacaagttgttgtttgttttaaacagttagttgaaatcaaggctaaagttgaggtcagcagttcaatgatattgagggccaactgtatgttttcttaccttccttagctaacttatacgcaactggaatatctatttaaaatgcactgtatcctttgtaaatgctgtgaggagaggcagctggagtagttcttaccttgatttagagagctggcagtaatcacagaaatctcgcgcacaaggctctgccgtttgacttgtaatgtgaatgaagggaggatgttcttcagtgcctagggattattccagagatgtggcctcgtgtgagaaaagtttagaggtggagagagaagactctcagaggggacaaggcaacggcagcaatgacttacttactggattaaggtgggcccaggtggcaccagttgatgacaggttagaagagcaaacaagtctcataggagatttgagtacagggcgtctagaattcacaactgagatgacatagcctaacaatccactggaagacagaagacagagtgtcagtaatcagacatggagagcatgtttagggtaaggggcacttttcgtatcctagatagagtgtgatcagagccagtcaaggagagcagtgaaagggtatacattagttaaggtcaatctagggaattttctagattttatacccaggtatatagaagataatatctttttttaaaaaatgtgaatctttagcaaaagattgggccattggatgtgacatggactatagttatgcataatgtaactagcagaataatttaaacatgaaaatggcatgatccttgttatgtagaatttgaggtgctaacagaacagaacagccattctgaaaaaggaggttttaaccaagttaaaacttatctacttagttcagtagcctaggctatgagaaagtggatatcttgaatgtataaacaaagaagaaaaacctatggtcctgaaatggtgccgtgagtaacagcctgttcaggagatgccaaaggggagatcggggaatcttggaaaggtttgagccaagaatttaaacttcagaagccaaggacagggaaagaagccactttaagttttttcagaaggaaaagtgaagaagagaaagaaaggagaaggaaggagggaagaaaagaaggaagggagggaggaagggaggaaggaaagaaggaaggacagagagtgtaataagggccttacaggatcaactcatctaccacctgaactataaatgggagaaaaggaagcctacaaaggaggtggtggcttggtccaagaaagtagagcaactttcagagaaaccaaggtgtaagctatgagtcttgatcatagctcagtgctccttctactgtgctgtcctgcctcagtcaagaactccagaaactgcccctgcacatcacaagtaaagcaaaggactaatctgagaggaaagagccagcacaatctagtagagctgtttctgcccccatctggtctcctaaatgagccattcactatgcttatagctgtggttacttgtctctctgggcatcttttcctctcctgaacccattgctgagagacagggaggaatgttaaactccctgccactgtgggcaggataactagcagcgtagtaaagggtttcaagtaagtcagaggttcctttctcacttgctactgtctggagcttgtgtgcaagagaacacacacaaacacagccatgtagttttgcaactgttttcaacataatatcagaaaaaacacaagggtgcttgttgaataaaaataatttaaagtgagcttaggcttggtggatttaaaaggagaaagaatgaaactgaaaactccctcactgtaatcaaaactgagaagctggtttgctttggaccttgactgcctttcttcagcaccacaatgcgaggatttggctaatctgtggtctagaaaatgggccatgctttgcttgctaactatcattaaattggtccctttgcttcaggaagacctcctaggtttgcctggtaagaaccataaacttgagcccatactaagtataactgcaagatcttgcagggatgggagagatgctgtgcacttgtgacatgttgaaggggctcccctgcataatgtgatccctgtctttaggaatagagccttgctcccatgttaatacattctggaaattgctcaagaggcagctttggcattagaatagcaactttcaaagcagtgagcgtcagcacttctatttctccttcttcttggcgtgcattacgtggagttggaaggactaattggctaaatgaagggactcagtgtggcagagttgaaatcctggcatgtaaatggagaggtggggagagacttagcatgcatatctacatggcctccctttgtgaattatcataatagaaatggttctgccccttctgtagtttccctgcgagatgagttggggtgtgaagtgcatggcacaggaattcagcatgctttgtatctgtgattacttgtctctgtgggcatcgtttccactcctaaattgcatgtttacctaaggttgctgaataatacattgttttaaaagatgtgtccctgaattaaggtttttatatgacaattagaatatagctgcatacagctgacagctgtttttaaaaatcagtaaatatcacttgcaaaagcaaacagaggaatctcatacctatttcatagatgttcagtttgcttccttgacctctaccaagcacttaggaagcatgatcaataaagagaccaggcagttaatagggcaccgactccctgtgacagcagtcaacgtagcatgtggggtatagaaatcctagaatcatccaccagcttttcaagagcagctcctccattcattcttcaagcttttgtgtaaaaccacagtctagaactcagttggctcatcgacacggacatctaccagctcttgactaaaattatcacaggcaaatggggaccaactgtattttcacaaaatctgcagtggggcatcacagtgttttgtatggtttgacttccgaagttcgatctgagctgcatgtaaggagagtaaggtagacagcccatcatctcactgatgatcgctacctaattacctcttaacatgtgaggcaaggcaggaaagttctttggctttgctctctaccagtctttttttttttttttttttaatgagttgggcactttgaataccaaggttggtatcaaataggaagtggatttaagttatacattctttttagtttggccttaaaaataagccaaaacaaaacaaaaacctaatatcttactgtgtagctccagaactcactttgtagaccaggctggccttaaactcaaaggcccccgagtactcagattaaaggtgtcacgcttcatcattttatttatttatttatttatttatttttatttttatttttttggttttttgagacagggtttctctgtatagccctggctgtcctggaactcactttgtagaccaggctgacctcgaactcagaaatccgcctgcctctgcctcccaagtgctgggattaaaggcgtgcgccaccacgcccggctcatcattttaattttaaaccattttatacttagtgatatttgtgaaaaccaaagctcactgcagtaatggtccacagtgtaagtaccttctagactggttctttttccatacactgttgatcactgaaggaataatttgtagtcattaggtactagagtatgaaatgttggggttaaactgttttatggaagtgtggtgctaaaaaacagacttaggggttcatttataagctaacagaacattagctactttgatcaaatttgagggtactggatttgatttaaagattcaatattaaaatgctgccctttgccttaaaacatggtgggaatagatttgcctagaaaataacattggtacggttaagccacaacagccaaataatagaaaatgacctttctagattggagtctatccaagggggtgacacacactcccagttctgccattggttaaaggtcaaggagattgacccaacataagtactaccaattcttttcagtggcttgtgccataattttatcaccttctcagtaagtaaatagggatgtccagagatcattctccccaaaggagaaatgaggaattctgaggctgtgagggcctgagtaccttccttgcttagagctatctacataatcagtgcaagaaccagaagcagagatggttggtgaccagggctaggaagaacaagttatattcattcacattaattctaatgtggtttagactctagaaaaaaaatgttacacaaatatgtggttgtttcatgttctctatagatttccagaaagggaacagcaattgagagcataatgttttgctcttgcagtcttatcagctaagtcaccagaaaattcatatttcacttcaaattcatatacagtaagtaatatcaactagaaattgttcataaagagaaacctcttgctttcttgttgtgtgttcctcacatgtcagactaaaatggcttttctaagctcttacagattactgcataaggtctactataagccacaggtttatagatctttgatactcaggaggtaaaaagcagctattcaaaggagcatctgttttttgttgttgttgttgttttgggttttggggggtttttgtcttgagtatagctttcagatgagctttgtacccactgcaagaaacctccaaaccccagcactcagacaagtaggaaagtcttgtcatgttttgagcagaagtttgagaggtctaagtaagatctataccttctagagcctgttatcatggccagtgggaagagagcagattccaagagctgagattccccaaaattttgtcagcttgaacattcactcaggatagtaaggggctcagttcatgccttactgtacagtgggcctcagccactccaaaaatgtacgctaagattgggccaaaacaaagaaggctaaaagcaggctatgtcagcaagatggtgggctttagaagacagaagtattttccctgagacaatattctaccagactcaacgagattttaacacacacacacacacacacacacacacacacacacacatgttttaaagtgacttttacgtcttatttttttcttctccaagaaattagcattcagagagttgcgttccgactgtggcccgatgtgtgccttgatcaggagtgcatttttatgactgggttataaacggtcataatagtgaggggttgggatggaatgccttcaaaagataacctagacctactgcaggcttgaaactctattagcctagctattaaaaccaggaggacaaactgtttcttccctggatacaaaagctgttaggctacagcttgacccagtacaaacttttctgaatctctctccactttacaaaccgtcagctcattgctgccgtctgcagtgaggctgtttacagctctgtgctaagtggaaagttcaaatcaattattgtccattagagtttaggtataactgatgaaatatccccagaggagtattgtaaatgtatcaagacgtccttccccattatagaaatggggacgcatagtgaattacttaccttctctcttgcccttaatgcctctgaaaggctgctgggcagacagagctcctcttgtgttgctggggttttgagtgaggacttcaccatttggtgagcatgtgtcttgagctggcaaatgtctagactccaacttactgtctactcttggtaaactttcgtgtggatataagaaaataaaaaatgaaaatgaaaaattgagagactgtaaaaattgattggaaagtaagtaccgggcaatcaggttccctttgcatgattgccgtctcactgacaatcaagtgagagacgctttgacgcagggagagttggtgctgggccactgtgcttgtgagaagcttgttcctccttgttctggttctttcattcagtcttctaccggacagaaagggagagtcattcatagctaagcatcttcaggctctaacagtgatatttcaccccatgaaagccagaacccccacacccacaccccaagaaaaagccagaacccagtagaaaacaaagatctatttgcaatctgctctaatgggacttgctttggaagatgttttttgcttattgtctttcttgttgatgccctgagccatctccttgccccagagatcccacggctgcaatgtacagactcttctcatacaaaagtctaggtgttcttctctagagggctgtgactttttttaaacaccagagaagtaatagaggaaggtcaaagagacatcattttcctggtcaggcattctctcctgaccccatggacacaggtggagggacacctttttattctgagttagtcctatttggctccaatgggctgcctgtgtgaatgtagcagcacacagttccaccctgactacagttagaatgaagagaagattcctatttaaaatgcagcactgatttccctgcgttgaacaccaaggagaactccaaaatgtccccctgctcgcaggcttatcagttatcttaacagtgtttaccctcagctctcatgggacttccattcatctcactgtagagccaccaataactgaacaggaaatctgactgagaagaagagagagcacttagaacccttattgggtcatagtatcttaggctgtgctataccattttcttagtctgttgttttcttctcttttggattttttacatttattcattcactgtatatgagtgtgtacttacacgtgcatgtgtgtatgcgtgtgggtgaatgttagccatggtatgcatgtggaagtcagaggaaaacttgtagggtgttggttctctcctattgtgtaggttctggggtcaaactctggttgtcatgatcggcagtggacacctttaccgactgagtcatcttgctggccctggtttctttgcagtgacccaggaatccttagtctctgctttggatatgccgaaccattgcttttttaccaaatcacagactgggaaggtggtctcttgctcagcgggtatgtgcctgggtagatgctctcccctgagatgtgcagccactcacacatcaccagcttctaataattcctgacatttaaagagtcagtccatttcgaccatttctttctgcatatttgtggaaagagccaatggtttgcagcattcaggaggcacaggatgtgcaccttgtcgtgtggatcgtattcgttctgcccggtttatcggttgtttgttttctcttaggattttgggagacttctttaacatgttaaatatggggctaaaaatagtgactagactgtaaatcatttgggggaaaatattaataagatacaaagagaactgccttcccatccaccctgtgtcataatgacaaaatgctaaatgactctgcatgtctgactccctcgtcactggaggtgaggcctctggattctgtgccatacaaacccccaaatgtgagagccttaagtgcaggctgaagtaccaagcgtgggtttggatttccctttcctgccccagtactctgaaagcatgtttactcagccttccctccgagcagggtccctgtgctgaagccggtctgccagcccacttctgagtaacagccaacacccccatccagcgccgccgaccgatgggcttgctcgaatttaaggagcaggactgattttcaagtttcttcgagccattatttgtgttccaagttatcttcctgcatccgtattaattttctgtttccaaaagtaagccccatgtatttcaaggcagcacagttgctttttcacattttccagggaactggtgtttttaatgtcatgtgaggacaacattacacaatgggtctttggcagggacacacagaaatgaataccgtgtgcgaacaaacattaaatggcagtcttaattacagagttagactctgttgtttttaatgcccttcaattttataatttgatggaaaatgcatcaacacagctattttctttctaccctaaatgattaaggattgatatacccccaaactgcagtagctccttagatcagctaatcaggtaggccttacatgttatccactagagggcagtagggatacacagccactccaaccaatatgtgcaacatatggtcgacgtggaaacatagtagccatagctttcatgtgtatgaaaaattcccattgcagtgttgcttcacttataattatattgaaagtaaacactaattcacagacagactacgcatatttcaacatatccctctagtgttttgtctattctagtttaaaatgccctgagtaatgaaacttctactacttcccttgggaagctatatcaaaacccacttgttttacatgcctgtttttttttacaaacacacactcaagatctattagtcttccttcaagttcatttagacctctgttgcatactccattttcccttacagcaaagctagttccattccgcaaaagatgtttcctgagtatccattgtgtggaagacatacttagttgagggatgtccacagctggcgagcattgcaaggctgcggctgaaggatttgcatgactccaagctacagaagaagctcgtccaaaccaaacatcagaagaagatgttggcctaagttctaaaaggagtgacattcataaaactgtcataacaggaaaaagtttagttgcacttggattttctgtattgaaatccagagtgctagtattgcatggtgacatctaacatcacctgaaaaactgtaagctctctggctgacctggcggtgagctcatgccaaggagacgacctgggttctcaccagtgaaagctgatcctttggccgatagatcagattagcctagaagtttagaaccaattttggggttctttatacctacttatgaaacagaggatatggtttgtaaatcccaccaacaatgttccgtagtctgcttttcgttttttttaatcatcgactcactgggttcagtcccagtgccgctacacacattgcatgatgggaaagtaacccaagatcacatgcagtactttgagtttgcaccactggtcttttacatatacttcgatcatatgtatctgaaggagagggtaggaaaaaaatccaagccaagaaaatccctttaaggctagaactcacagttacactgttactacaaggtttccccatttacattagagacagagcaaagttatttgctctgttgggtctttttctcagatacatttccataaggctgtcctgatggccaaggacatcccaagtagacatgtccacgggtgagagtgttctgcctccaagtgcagaatgaaatgttgcagaagttctaggaatgatacatacctctcagtgctctttcacatcctttgagccaatgtagaacatagcctattctccagggtctttaaaggcctttcttttgccaattaggagggtaagaatgtgctggataggctgactctctgtaggaaaagagaagggaaggatacagaatcttcatgggaatctatacaacaatagtccagacttcctatcacaaacaaagcttacatccaaaatttgtgtcacctgtaatgaaatccacaggagtattttatatggaagtaattaagtgcaaatgtacaacagccatttttgtgtttttgtttgtttcaaaataccagaggtgattaggccatattatgaactaattgcttacttaatttatttaagttgaaatgagttcttgagttatacaggacccaaaacacgaactcattactccattctgcacaccactgaaaagaacaaaacaaagacgttagcgcctttatttcattatgttacaacacaccaacattctgagcactgatgaggacccaagtggacagaacatctgtatttggtaagaaaataaaataaataaatgtttgctccatcatttagttcttccattgatgtgctgaaattcaaaatgaatggccaaaggtaataaagtggcatgcctttttttgtacactttcctatggaaagtttaaacgactcttcaaacatatttgaaaacagtaaataaataacctacaaaattcaatattttcttaaatttggaagtaaaccacagtcattcctaggcttgagtctctgtacaccaagtttcaaaccaaagcatattttggtattttgatggttgacttataaccccctgaaaagaggacctgattgtgtgcagtgaggacagctgcccctggaactccgtccaggctactaaaataaaacactggtgcttaccagtcactgctgaccaggagatgcgagaggcagtactctgttctataggcagtgagggagctctgtcagcagtgcatgcttgccgtggccagattctagacaaggaaaaaaagagaaaacagtacaccccaaagccaaaccaaagccccaggtgttaaaagcaattgaagatgccaaaaatcttccaggttctagtcctgttcagtatttttaaggtactgctaaggaattctagttaaggtctgtctgaccatgttagcgaggtagctggtggtgttgagcatctctataggtttatacgttcctttgctcatgattatctgaagcaaaatccatggagcttttattgacgctttaaccactgggcgccccacacattagcaaagtatatgccaatgttttacaaagacatagtggatcaagctatagtacttgttgacttaattgtttcccacctctcaaaagagttggggtgactgcgatagaggtaaatttctgttttcccatgtgaagaatgaagaaaatgaatctgtcattttcataccccagctagatgctgtgagcatttgatggactggtaatataatcttaataaactcagggagtttgctggtgattaattatgtctttttggaagaggatgctaggaggagcactctctcctgatgtgaaaaataccaaatggtcattgtcttgtcttgtggcatagctgcttttagcaataccacaacctcaacatgagtgagagtcatgtcttgaattattttgctcatgggctcagacaccttaatactgatacccagtgttcttttttggcagctattcattttaatttaaattaaaacctgtgactatgaaatgaatttttttttctgtatcccaagacatttactcactgaataaatatttattgagaaggtactcagtagaaaatattatactgagccatatgatttgcttaggaactaaatctgtggtggtaaccacattaaatccatcttgtaaccaagtaaaccatccagacaactttcacaaaactggaactgactatttgaaaggagcccttcactgcacagttgagggcatttggaactggccagtaccatgaattccttgcactctgcacatgtggttcatatagagctctagaggcagagcccaaagctcctggtcatagtgtgtgctgggttccagccctcagcatgcctgtttatcacgttctcagggatgctgcagggatgcagtcagctctgatgttttccctgcactatctttcttctttgatgctgatcagttaagcagtggcatggcttttctgagtttagtaatgacacgtccccagaccatttctgcagtcctgtcatcacattggtgtcgaaggaatgtaagcccttatatggacacgttcttaacaaataaaagcatttctcaaagatagattctcttttcttaatgatatcaaagtctattaactttctcatccattggccactggtagacactctctgagaggtgtgcttctgagggaatatttatgtgaattttaagttgctccacagagttctgagaacctactgcatgtgtggataaatcctgaaggaaaaggaaggaagagcaggaatatacatgaggaagaggccctggaaaagggtttgaaagactttgttataaactggacctttactactaattacttgtaagcatatataataatatataataattctgaatatttccaggtgatggtggtacacgcccttaatcctaacacactggcagaggcaggttgatctctgagttcaaggctagcctggtttccagagcaagttccaggatagcctggggctacacaaagaaaccctgtctcaataaaaacaaaaaaaaaataaatcagtactaataataattctgaatattggaaaataaactgtttttcatgaatgaaaattaagatacagatgattctgtaacatagtgtttaaaagctcactaaatgtcccgacagcattgtgccattgctttaggttagcaacttctttgcaagacagccagactgcactaaaatagaagaaaggcaaactcatttggatggacccagttactcttgtagagtaaattctgaactttcctcctctgccttctccccatcccagtatttgtcatttttcatccttcaatttgaaaacccatccaccattacaaacacacacaaaactatgcagtgtgatatttgttcacttcttagatattccttctattcaactatgtgagtttaggaaaactatgaacgtttaggaggtagagagaacaacttaccattgatatgcataggctgctaaacttggttgtgataccctagttgtgtgtggtagtagctgtatgccctttctcttgtggtcatttgcttgctcctcttgttccttcttaatgagctctagagctatcattgctgtaagatgtacacatgatttgctaaccgaaagctactgtgtgctgtttaggtaaagggaaaatgaagaaaaggacctggtagctctgaaagatcaaacgagtaccagttgttggtacttcaaccaagatggctgggccccgagagcatttctgggaagcacagcagcatatgtgttcatccatgtatgtgcacagttcgaatctcagctctgccacttaggagccatgtgacctgcgctttgcttctcctctctaaaggtctctgctccatacctctcccacctgagtgagggaggtgttactgcagagagagtagtggggtgcgcctcaggtaggagggtgtagaccactgcaggtttgcagacattctggccctcctgtgccgccttttagcatcataattgcctcagaggatcttgggagtctgtggttttaagaaaactccactgggtcaggctcatagtcctttcaggtcagcattcagtttctgaccacaggaccagggagtgttacataagtcacaactgtccttgtcgctgactgcaggagttatttacttcccttcccataccctagtttctctgaataactctggacttgctacccatgaatttagctaaacttagtgatatatttctgcggtcagtcttcaatgaactttgtttgcaaccttgtgtgtaaagtggttctttgcttaaagaccaggaagatattcatcatcacataacagaacgtgataagaaatccattttccattccccggctttccatccccttacagacagtatccgatccctgtctggatttgaccatctaaatagaaagcttcattggttagaatcattgtgatttaactcttcccttcccctgtcaaaatcctccagactccaagcgggatggtcttagtatgaatgcagttgcctctgagccagagttcagcttagagacagctggcaaactgttcaacaaactggaccagagaggagaatcatagcaaaaacatgatctgtctggagcaaagtgaaaaacttgccttaaggaaaaacaagaggcatttcccctgctgtaggagaaactaaataagggttacagagcactttcccagtgccttgtgcctctccagcaatactttaggcttagaaccatagtgaggttaaactgaatacactgtgttgctgtcagagactgatgttccagagtgacaaggcagcaccagtccagagtgacaaggcagcaccagtctagggttaaagagcctcgtcaccttagcatcctcactccacacaaagatttgagcttgaagtgactcatggtgagtggatgacaacctactgtggaggtgctctgtgacccccaaggtcactttctaaggagaaagtcctttcaggtggtaactgatgcagtcaggcagctctgagcccgatacccctgtcttctcagggcctctgacacaccagcccaggcatggcaccactgtctttagaatcaaacatcctatttgtccaaagcttcatagaacctgtggacaaggtatccattcatttttttctctttgtgagctgttcccttctcatggatgaggggaactaaattacaggcacaagtgtggctgaacacaatggagagggtactgaggtaagcgccatggtatgtcccagcctgatgtccttgcctgtgtgtccaccataaaaatcacaaggtcatttccagggtcctgaagtagaagactgagatcatcctaagactaggcttttttcacatgcaaatgacacagacttccttaacctgctcacttggagaaatcttaggaaaccaacaccagccttgtgtccggacaaacagaccattaaagaagcctttaacggggccagtttttgctgatttgttttagcttcctttccaaatagtcttcacactgcttaattcaaaagtgcttcatattattttaataagctctaccctgtatctctctgggcccttctcttcctccctgaatgatcctgctaagttctgaaaagcctttgccaggcagataataggtgaagatcattgtatttcggctccctgatccattacactcctgcctttcacccgcatgcagagtgcagcgttgttttttttttttttttttccctaacagaataaattaaatatgaaaggaaaagactaatgtaattcaaataaacatgttaatgaccctatttttccatttggtaactagaccggatgtggtggtatgccagttttttactgagcctgtaatttaaaactttgaacaaggacactttttcccccttttatttccatcctccattcccaacctcttttattcttacagactctccttactgtccaattagtttgggaacatgaaaactgtcctcattgctgcctggagtcttaggcgacctgggtggtttatctctgtggggtggcttgtgagtttgcagttggaccggtgattaacctgtcagagcgccgtacctcttccagggcatgaggaagaagggcactggcacaccacgcacctcctcctcatggcctggcaggcgattttgcagattgtacatgtgtgtgcttgtgctctaggcggtacttcaacgctgagatgtggggacagatgaccccttaacctgggaactagccatgcattccaactgcattttagtcagttagctccatgtcttaagaactttttattgctccaactaaaaccttagctaattccatgtaccctcaaataacctctagtctccactcccccgcggcctctcctgtctcccttgtacccagagcaaccactttccacaacactctcatccaacacacacacacacagaggaaggagaactaactgcaaaacctctcctgtcccttgtgcctctgatgcaccacctgtctgctgtagtttactctagtgagctcagaatcctgaatttctccacactgggtgtgtgtaatctattcctcctccgcccctggagtgcagtgtccccttggcatttgcaagctagaagccgttatctcttgtttcttttactttagtcacttcccagtgtttgaagggaaactttttgatgtgaacatattctggtttgggttttttttttccctaactgacgctggcgggcgggaggaatgaaggggagagagggctctggccccgttacttcctgtttgtttttgttccggagaatgcagaccatctgtgtctctccaacgcttttcttctgcagccactgttctcattcggatagttaatgttcttagttttcctcatttctcactaaacaatttcctatttctcttccagaaactcctaagcccctcattaaatctttcttcctgaaatttcttatcttaatagcacctctggatacagttcggtccccattaaggccaggatacaaattaagtaaatgataatgggagagaggagaagggagagagggagagaggaagctgtaaatgagaggggaaaattaggcatgctttgaaaatggagtccgaggattctcagacccaggtcctgagtcctagcacacactgccaactagaccctctctgtcgggtggactggggcgtttctccatattgtggatgtctgtggaaactgggccttctaagcatggctggagagtgttgctcccaggcttgcttccggggcatcagataatggctaagattaccctttcttatggctagcaagtgtactttctcatagttatcagaatttgtagagatacatttttcttggagatgcccataagcatcctgtatacttcgggatggtttgtcttgtttttcagtgtagtttcactacacgagatctctaagctacttgagcctccatatcttttgctgagtaccatcttcatgtcagatgccagtgcgttttagagcatcggagtttccccactcatgtttaaaaacaaaagtcaaccctccccaccccttagttcttaaggccaggattaaaaaattaaatcaattccaaggtccagcctcccagaattacgtcagtcagtttgagcctaatgtgtgttcccaacagtccacgggaaagcaaggagtagctgtggccttcccagactgccagacaagcattggtcactggtgtccttctgtttgtccctgctgtagtgccttcagccaggcacataccatttaatcagtgatgtattaaaatgggcctggtgtagtcagaaatagctaggcaaaaatcgactggctatttttacaaagaaaaaaagaggagagaaaattggtcttttaatctgggcaaatcaaatcgtgcctgcttgccttccacctgtagctctatgtgggcttgccaagaggtctgcttgaaggcagtgctttcgtatacttctttatttatgctgatccacatggggtcgtaacaccaaggtatcttcaaaactgagttttcccattcacatgagaaaatgtgtattctatttctctcaggggagactacaagaaaaacagacctcctctttgccactcttagaagatttgaataaaaacataatacactcggcctcttctgccgtttagtttttttctctgtcaagaaatcatatctgagtatgacatcacagcatgctgctccaggctgctgggtgatggatgaaggcgagggccttaattgggttaacagggcacaccaggggcgcagggtggagggtgagttctgctctcccagttagagctgctccaggcagtgtgaaagaaacacagtcatgccagggaggagctcctctccccagggactaggaacaccggtgctctgtcttcctttcatatatcaccaaccaacgaaattaatcttttgaaaaggaaaaatgtaaactgtgctttgtttttaatctgcaagaagagttgggggtgggttgtgctggcaggtttgttctgtagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaatttcaatactatccctattctacctatcacagtttataagttatgctaatgagccttcagggtaactagaagaaaagatggtcagatgacacaccagtgaatatttcttataatttcttcttagtctctttaggtttgtcagataggccagggtcctatgcaaagcctcagaaaacattggaagcccagaaattctttctaccatggctcctccatcctttcctgcttctgcttccctgatgaagtcaatccctcctgactctctcacctgacccaacaaaagcacgcttacttctccttggccttatgttagtcagctgcctggggaaaacaagggactgaattgaaggatcagatacctaccaaataaagtaattaatgatgagtttctggccaagcccactgaaaatagcccctcaataaaagcacacaattattaaactgtgttacattctaattcctcacaatccaattctgacagtgtacacctctgacttacacctgtaaatcagaataaacaaggaccttcaagtgtccaaatggactccaccaagtctccaacaaatcctgcattcaaaagtagtattatctctataggcctcatgtatctgatttttccattccaaagctggttagagaatacacttagcatagaacattgggaggagatggttctgggaaactgagagcaatggcgtgtggctttggcagtggagagtccacgacacacagttccgtctgtggcagagaggttgaactgtggagaagagggtgattctccaaagaaataggaaaaatctatctctgacaagcaggaatgatgagcgttcacaaggataacccttcatcataaaaaatctgagattgtaccagtgtagtccaacaggagcaggaacctctgaagggcctccgtattctaacatttagtgtgtgtatcagtgctcatcatttctgtcacttatacttcggtggagcattttatacatacaccacttttatttatttagctttttttttgtcaatttggaaaatgcacacatggttttgtacggttctgaaaaacaagccagccaaagttactcagcgtggacaccctgagagagaggctgtttactcctgagtggtttgttctaggtccaggtctctgacaggaggcctctctcccttccattgatctgaggtagatagtgtgtgttgtcgtctggaggaaggcagagggaggcatgtttgctcatatccagctgctttgctttgttaatgcgtcaatgtaactgaccagaaacatggtacggggagttgtttgtgtttgttctttgcttatgcaactttccaagcagacagtgttcttgagaccagatggtaaagaacagtcaactgcaagctctactctgcagatgtattgatgtttcatgtcttcttgaagcagttcaaatacatttttgaatttttgaatagtaacccttgtatttctacgaggtcctgtttaactaacaaggaaaggggctggaatatttactttcatggtctctgggggcagctgagcagtggaacagcaatgttataaccatatggcattcaaccttcaaccagacaaacgtccagcacgtgttattttgtacagggtggacatcaggtcacagtgaacaccttgtgttggtcacaaacacaaacctatttccaacatcgttgtttccaacagtgtactttcttagtacattttttcatttattttttattttatttatccatcatttcaacttggcacatgtttgttggggttgttttgttgtagttgttgttgtttatctgctcagcaatttggaagtttacttggaacacagatgagttaagatcaaaagctgtttttcaaaaaataaaatgcctctagtaagtaaaaatgaagatgctatatctgaatgaatgtggaaagttgtccctctgtatatttttaaagcttctcaaactatccccagttctcagccaaatgcagcctacccagattgtctttaggaaagtagcaattcacagggatttgcagttagctgcatatcaaagcacacactctcttcagtccctgctcatagctccaccattttagaatatggtgagagatgccagagacctaccatctgtttaatgggctaattatgtttagcacatgcctacttcacagtaataccatgagtgaggttgccaaacatcatacaaatgtatatgtttgtatatattgatatataaatacacacataaataaagtcgcatacatatatagtaacagtcagtgtttctcagctttactctaggctctccttctgagatatattacagcccttcacttgggcattggcagagtttgtatgatgtatgaagggtgggtcagactgagagggacagtgatgaatatatacatacatacatatatacatatacaaatatatgcatatatatttgcctatttatatatatattaaatacatatattttcctgttttagctgtactccatattttcccctcttaaaatcttaatttacctctatagtcagcacagccaaacttcatgacactgtttgtttatgtaccaaatactttagctcctcccttttagacattgagacttacttttactgaatcccttcagcggaaggctacagcttttctcttagatgtcgtaccttctctattgagtctgttgttaaagcttgcatattattttcctctcatgaagcttgcacagcctttgacaatgtttctggtggtctcagggactctagtcattacggtaactagctgccacatgctagccaagaaaattatcactgggtcccaagttgggtcagcttaagcagattcttagacatgaagcttacagtccaggtccagagggtttcagaagtaaaagagacgcagacagagggcattccaggtgaagggaatgaaaccagcaaatgaatagggcagaaatggaaaggagcgagtcatgggtaaccagagtgcctagtcaggatatgatataaactctaggtaccgagctttctgtgtggcgcctttgtctctgtaaggccagctctgcaagctctggacctgcttggctttgagggtgcattggcctgagagctattgggagaaatatccacgtctgcattccagactataaaaccaatctgtagcaaaagatcacaacatagggaactctcctgggtacatttcatatgtacctcccaagatgaagtgtctttgtaaagcttcctgctcccagcagtagaatgttttactacatacactgccttagctagagtaaattctttagagctttttcgtcctgtttgtttgtttttgcttttgcagatttatgcttactatggatttctctaaccaagttagatggaggggaaatagccaagacataaatagtccaatcagataggcttgtgtgaacagggtggagctttgtgagaaaataaactcctgagtaccagaacggttgttttcatcttaggcatcagtctgatatgaagggaacattgacaggcaaagaaaggcagagctagtgcttatattttctcttggatagatgaaaatagatcaccttgctctttgctatgtgacttcttaaggtggaaaactcaacaagtcatacaaggtacacagaccctgatcagaagaaagcaatgtttatctgaataagaagaggaattgcctctccatctcttatgtagcaccatcaaacactatggctggaaggactccttagagccagcccacctagcatccctgttctacatggaggactacgtgttgcattccttgcctgtggcctacaacaatagagccatggatagggatccaaaatcttctgagatgctcaggtagcactcagtcaaactactccatagtttttcctcagttcctctgtcttagatttagataattctaacttttcttcttccagctacactgcttttttatatcttgattacctactggcttctcaattaattgctttggagacatttattttataataattaattgctgggttcctataaatgagtctaatagttaagatagcctctcagatgtatcctaattatttcacaaatacagttaagcttgccagatggacacctccatcttctttttggatgactgctgaaatacctgtagaactgtcttggacaatactagacctttcggattcatctctagggctgcagacacttgctgggaggtataaacagtatggtcagagttgctcttttgccctgtgtgagctgtgcctaggatgtgtttaaattgctgtgcctttgtaaggaaggaattcccactaccatcaatttccccagttcctgtcatcagaccagttactacaaatggattgcctgtcagcctccaaaacagctggacttagtgtgttgttgctgttttgttcagtgtaaaggagaaagaacacgatgagtgtctggcatggctaggttccctttcatggataagagtccatcactgacaacagacattcaataaaaggggcagaaaaataaaagtgtttaaaaaaaaaaaaaaaaaacctttgagtcacttgaagatattagctccaagcttctgatacgatgccgtgtggtctgttgcccacatatggttattatgatctacttgtcagcaatgagccagaaatactcttactgttgcaatgcaaagatacataataatccatttttacactgcaaatgcatgtggcccatcaagtccttgctcagatgccaaactcaccactgtgaaagaactggctgacatagtgccctaaaatttcaggtaagtatagttacctcgcacaggcatggagtgagcctggtttttgaagccaagagaaggagaagcaaaactctgctcttccctaagtacgaaccatttggcaatagtcgcagtagttagagggaatagccttttgtgaagaaaattgtggtgtctcagggctgtttttattaaaacatttagcccaccagaataccaattttaagaataatttaattcacaaagcatatgaaataaacagaagagtctagtcccaacagctgcatcccaccactgtgatcctgctgtgatgcagggtgactcagtggtcaagatcccttccactgctctgcatttggatatttgtgaggggagaaaaaaaaacctagaactcatttcctttaatatccatatggcatgtagcaaaaccaccagagaatactgatcaagattttttttttttgccaattctacccagatgttcaggtaacaataatagtcatctcctcctccctcttattttttttcttcatgttttcttctccgatctaatgtgttccttgcttttctggattggaatcactccttaaaggaagtaagcaaagttcatcccatttgcaagaaacatacactactgtgactggtagtctgtctcgttgtggctttttgtagcctatgcaactgaggagcacatggaagagccagtcagtactcggaggacatggtttagcttacctagtctaatccactgtttcacgttacagaacaatcgaaggtcctaccccaaatgaatagcaggatgtaacctctctatgtctgtaatttccataaagtcctccatgatatctgggggtattggctcctagggatgcaagctttaaaagtatgtcctggcaatgatgtcccacaagagggaaatgtgagttggtgaaaaagtacagacatagatatctttgtaatattttttctcataaatattttaatttgctatcaagaccccatttgatcttcaatcaaatgagtgatttaaagaaaaaattatctttgggggctggggagatggctcattgagtacgattgcttgctttgcaatcatgagaacttgagttcaaaaccccagtacccacataaaatgctggacgtgactgtatgcgcctgtaatcccagcattgggaagtaagagacaggcagatcccccggcactcactaaccctcagccttaccagaacagagaactcctttctcaaagaaataaggcagagatagtgacacaagaacaggtagacatcgttttctggcttttgcacttacagatgaaacatacatacatacatacatacatacatacatacacacacactttacctttgtaatttttctaagtcgtatttcagtctttccttcctatcactgggattttgggtaatcgtcttaacaggtggctgggaggaagtcatgtgtgaaaactcctcatagcttatagcaaaacagaagatatgctcaggagagaagtgaaaatccataaatgcagttatccccccaccacaaagagagtagtttagggacactgtgtgatgctacatggcctgcatggggaaacactgaagccatgttttcagttgctttttcctccctggaaattcatgcaataaacagagccaagaaactttggaatatactctagtgaaacataaaggagatgagaaaaaagtcctctgaaactccaatttaaccagtgcatgctagcagccaatccagtgtataactgcctcctttgtccttagggtttgacatttctgtacactaggaaaaagagaatatatatgcctggtgtgtttggagcacttggctgtttcaaatacttttaagatgaatacttgtttcctgcatttccttaaacaagctccgttaaacatatcagttatcccacaatgcatggttattcagtaaattgaaaaaaaaaaagaaaaaaaagaaaaaaatcaatcggacnnnnnnnnnnnnnnnnnnnnttgccccctcctgtctgtcacactgtgtgaggagttgagtgtgtgtgtatatatgtgcatgtgtgtgcatgagtgtgtctgggaggtagacagattccctacctggaaatggcttgctattattagatgttcagttaccaggggttatgtaagacaattgaagctctgttttttaacagagacatgattcatgctgcttgtagtaacagtaaccacctccgaacgagacagaaaccagacacagacaaaggctggagaaatcaatgccgactcactgcagcccctctcccgataccctctgcctttcaatcagggcacttaggttatcaggaaaggaggctcctgctaattctgggtctgatctgtctcctgggactgccagataaattcatgtgtctggagctagacacagggaaaagtaggcttcgggagctgtgacatctgagccccctccctaggatctcgccagcgttccccacctggcaaggaatagggcctgcacctgtgctaggcacagatgtcgtcgctgtggtctacttagaaaatttaagggcttgagtgttaggatcgcccactctcagaacttcccctccggtgatgttttcagcttgtcaagagaacaaagggtgggatggtattaaagccgctacccccatttccccaaactccaccagactcggacttggctgtcagctctcacccagatcaagacccttctctgggcccttcagaccacaccacctccacagtatccaaagatttgcacatcagccccacagctgagtaggacaggcagtgaatctcaaccacgacttctcaggtgcaaatgaccttagtgcttaacagtggtggtggctgtgattttatctataggaaaagatttgcagctgggaaagttggtggcctgaatagcgacatgcaactactgtcagatgcagagagaatatgcacatctggttctttgacactacaaagtttggtggtaaccgggacatatattttttttttaggagaaattaaaaatttaaaaacaaaaagcattttctcctgaaaacttttagaccacactgtactactcactcagcaggcagctcaaaatcttcccctcccctctctcctaccccagtcccacaggtcccatttgtgtgaatcatgacgaaaactcactcttaatgaaagtctccccatgcagtagcacgtccctagcagtgtctccctgtccctcccggtgacatcccagaaagatgtggatagcttaggcttcccccagaacctggagacaaactacttctgctgcaaaaagaaaccggtgcttgactagaaggctcgcatgaactcagaaattagctgtcctgccccagttaatataccccacaggcaggccgctgccctttactctctctcaaatgtgtaaaccacccagaaggacagctctgagtgtagcagcgacagagaaatgtctagccatttagtttcatcaagtcaatatctcatgtgataaaatttcatctttaaaaatacttgtattgattactagtaatgatcaatatcttgatacattcttaggactattgactatgaactataggaaatctctgctagtacacatgttccttacctttcaaggtaaaacatttaagtaagcattctcattttatataaaagagttttaattatattctctgtataccacgtctttaatcaagaacagcagtgaactatttcacagaccccagatcatgagcattttcttttctgctaagataccaaagtcttctgttccctcggttttaagggaaaaaagctgtactcttcctgcacacagtaaaacctcctgctcctgcatcccgggactatacttctagccccagtcttagtacaaactcactattaggaaatacgctaagtctctacttcagataacatctaatctgcagaactcaaagccctttgatatctggttgttatgcactggcctgagaaaacctgccctgggctttctgtgctgctgtagaaaccagttttatggggaagatggacctcactgtttgggggtttgtgttgtccaagtggctgccaggcctgccttagcttacacaacacagtgtgtctccagactgactggagatagaggctgggatatgggtgaaaggtggcagagaattctagacatttgctgcatgccctggtgatatctttcattttcatcagactaccatgatttaatgatcattaataacaattttccttgacaaaagcgtgttccaggacttcccttcctgggctgtttggtgttctttattcttttatctttctctctggtaaaaactaagcagtcttgcttatagataagaacagggcagcctttgcttttctcggtttagtcttatttaaaagccttagagacatgtggtggcatttgctgaggtgacgacaataatagtggatggtaggtttttcaacaatggatgatacattctacctgaacctttaccatcctaaatgatcccctgcagaaatcagagttgaattattaggcctctaagtactctagtaaccaataacatgattagaacatcctactgtgtgcataggcctgcagtagatgttgatgtttctgtaaactactagacctctattctctagaggactgtgacacactcccaatgatacatagagcaggcagtaaagagtaactatttatctaaatcctagtcagtgtcagaggtcaacatcacccaaagcattcttcccaacagagtttcataaggactagttcacatcctgtgggccttgaatgggaagaaagtttaggtaccaatgaaaggcaacaaagatggaatcctataaatttgaaaacagtctgttcaaaagcttaggggtacaactgtatttgtctttcttccccctaaaagttaacttggtaatactaaagggagtattaacagaaagaccctattttatagacattcagtggcattcatcataggcaaaaacaaaacaaacaaacaaacaaacaagctttcccttgatggtcctctggcattttcttaggtaaaataatgtcccattagtccagtaagcttgggcaaagcatgtagggattcctaaatttatttaaccaaaaaaaaaaaagtaagatttctttttaagtatttatttatttgtgcaggctgaggggctgggtggagacagggcaagcacccatggaggtcacacttgtggcagtggtcagctcagggtttctaactcacaggtcgccagagcattctcaggcttagcagaaatggccttcacacactgagccatcacactagcccaagtttttattaaaaacaatagttaagggctggagagatggctcagctgttaaaggctaggctcacaaccaaaaacaataatttatgtgtgtgggagctttgtctgccatgcatttctgcacacatatgcatgcctggtgccaggagaggtcaggggcgaatattggatcccctggaactggagcctcaaaaggctgtgacttgacttgtgggtgcggggacttgaaccagggttttctggaagagcagccagtgcttttaaccatggaggcacctttccatgcctcccttcacccacctctttttttcttatgatgctttttaaggtactagtgtcctgtaacctcactctgaggcataccacctttaaaggagttgacggtgcagagttgaaaatcataccatgttgtaatgatcagtgctgttgacaatgaacggaccactaactacagagaagtttcagaggtgaatccagcctacacaataggtgaggactgcagaggagaatgtctaaagcaagaatcaagtgtggagggaacaagaaagaatggttctatcttgagtaataaaaatcagaggtgattaaaagagattagattccataaacttagcacgctgcagggcagctgcataggagctatgcttatcaactgagaaagaaagcagaatgagcaggacttggtaaaatacaccgaggttcgaatgtggaaacaaggagcaggtttggaggccaagattggagcagatagagggccttatttccaccaggggcagcactgagcaactcgtggtcatctggattcatcagtgaaaacattaaaaggaaatccagtacataaaagtggagacagacaggaaacccaaaggctaccaaggagagaactccattacaagctgctataggccacacctcagggcagtgtgacaaaaacctgatgttccatcctacattgctcctgcttcatggcctatggcaaataactgtatctttcctaaagcatctcagatgccttgtctggatgtaaaataggaatacaatacctttgaagagtgaagacatgaagttaagcaatgaaagaaaatgtccttttaccatgtgctacgcatttagttaggggtagccaaaattggcactgaggtgaggggatagaaaaaagaaagtgaaattctctcagagtgtgttatctgggacaaagctactgggatgtgtcttcgtacctccccccccccccaccagtaaaaaaatggttagtacagaaaattataatgcaagagacaaagtataaaaaacggatataccagaaaacattctggcccgcagatcacgtaccagtgggatctgtatttcagaatttaaagaaacctcttatccagggcctgtggcaggctttctggacggaatgactcagggtgggtaagaaggggtgtcctgtcaccaccatatatctatcacctgatccccaattctcttaatttaaataagaatcaactacctgaaacactaaggctttaggggatatgcagttcttattaacagagtttgtgaattgtcaaaaaggaatcaggggtctctgtggagaacattaccgtaactcgctgtgacaaacagttgcactgcgcttccactctctgtggcaggaccatcccaggggtctttgagccatcgggggtatttctcctggacatgagtattagctggtggttaattaacaagctacattttaaaactgggagcagttctcccagcatagagaagctgaagccacgtccctgatcagcctgtctggccatgctgcctctcatgccttacttgttttaatggtttctcgccagtcttcatcagctgggattagtgatatcgactagggaattggtttcaggtaattagttaaaaaggtaaaagtcaaatagatttctttaacatggttagtggcttcctaggttgatgagctctgtaattcccacagttttcttctcaggaggctgctacaattttaagggaccttaaaatcataaaactcatcccttctttttacaaatggaaaaggtggtcactgagaagccagatgatttgcctaaggtcacccagacagttctagaattttctttcccttctcttagtcttactcctttgagttctctttgaattctctctctgcccccccccccccgtgtatacacacacccacacacacacacacacagagagacgctctattcccacagttacctcactactggccctttctgttcttgcgtttgcccctgtgctgtgacctcctgcgcctcagcatatgagctaaagggtcttgggcagccagttacacactccccgccccccaacacacacacacacacacacacacacacacacacacacacacactgactcgatgcttcacttagagtgaagaaatgagggaagtggaacaattttaaatttactgtgatcttcaagacagctttttctacacctgggaattgctgttagacaattaaggttagtaaagctcattgcatttctcagaggaaaggtgttatttattaccagataattattgttaaaaataacaataatgtaaaaatgggactgtggcatgtttgagacgttatcattcttaggttacagacgttgaggggagttattggcaatctagaaacaatagtttgttgttgttcacaacatactccatgtcagaaactcctggaattctgatgtctgatgactggcccaaaatcagaagccatgttattcagctaaactgcccctccaaaaacaaacccctattagaaaagagaatgtcagatgtaagatgagtggtatccagacctatagtatcagcatcacctgggaacttaccaaaatgcagaactgcagactccacctagacatactgattcagaaatactagtgatattaaaatcatgttctacagagagagagacagagagacatcgagagagagagaacttgagactgatataagacattcccatcttcaattagaaaggagttacaaatgaactatgcatattgacaatttcaaggccagttcttcccctgtgactcttgactctcaaggaaatgacgccctgtgggaccatggcaagaggcactaatgcacctgtacattgtgagaattgttttctagtggcaagaatacagaagatctgaatttgaattctgtcttcactatcttcaagctttctaatcacagacttttcacgagctctctgagttcctcctctgtacactgggcatagtaatcaacatagctgagaaggttaaatgagaatattttcatatatgcgaatctgtggtccctgataaaatgtcgacattcataaatagctgttgttgctttcacagtgccttttatgtgagcttctaccccaaagcactcacccattttatactgacttgatgatctctgagaagtgagtagcagtggccacactgaagtcagacctcagcctcatgtgatgcatggcattgtgttccttagcagctcaactcaactggcttccaaggcaggtgtacagagacaccatcaaagctacaggcagaaaagaagtgaccctctgtctgatctgcatctgacaccatcatgaaacttgctgggttctaagagcagactctttattatagtgctgatataagaggcagggggaaacagatggatttccagatactaagtagaatttgtggcatgagcagccctttaaaattaccttttaacttaaaaacttagtacactggatacagaagtcattaaaagggaataaatatgaaaccctgcgaggtcattttcactgagtctttattttaggagtataactattctttaagcaataaaacatgagagaccatgcagtagctctgattagtagaccctcaggtgtatgcaggtacctgagaggggaaataaggaaatagggttagaagatagtctgccaaaaaagctggaagatcatagcggcgggatgtgaaggagaaggctttgattaaaggacaggaagattatggctctgtttaattacaaatttcacacttttagtaaactattgtatgcgctgaacatgtacagttacctaattacatagaggatatctgtatattgccaagtaactgttcactgcagtgtgggagaatattgatcagtgattttctttattatcttaatatagttgccagaagattgaaaagttcagtgggatgaagagttaataatctctagccatatggtgggttagaaagaacaatgaacaccttgtgggcccagttttgctggttatgtggctgctaaggtaaatggttcaatgcatagcacctctccaccataccagtcaaaacttttgacaaatattactatcttctttctctgctgggaaacgatgagttgatggaacctttggtaccgtagactaatatttaaaaggaagccatcctgaccaataataaatgactgataggccctggaagatctgttttatttgctatgataaacaccactatcccaagacagttgttttgggtttagttttcgtttggtttgggttgtttccttgttcatttgttttgttttagcttttcatttagaactaagaaaagatgaatctgtttgaggtcagaggagaaatggaacaaataacactccttccatctctggaaaaaagcaaggcaaaaaaaaaaaaaaaaaaaaagaagaaatgagaagaggcttggggcagccccgtacacatttctatgagtaaatcattaaataaggagaaaaataagtgcacatttaagttcgcccagaacacagaaagtgagcaagcctgctgggaaaagaagcatcaatgtagcaagactgtcaaacggctatgatgaattcaactgcagaattgatgtagcctggctctgcgaggaccatagctgaagcagtggcctttcaagcgtgaggagcctcattccagccttcagtcttggtttatcagtccagcggtatttttcagtattgtcacgattgttactgctggtaatgttagaaaagctgcttctttgctgttgtgatccaccctcattttaaggcatatcaaaacataaagtgctatttattctctcagtctgttgaagctaataagtgaaacaagtttgttatttttgaaacataatagacacccaaaccctccctgtctctagtctgatcattgctcttggtggtctggtgaccttattgctattcagcaggcactgacatatttaaagatacaagaccttttctatcagttgtccttgcttagttactaacaaggagaggaccttgagcaagtcggctcccttaatcccctgtctgggcacaaggacagtggagcagatgagcttcaaagtcctttcagttcatcctcagtttctatgacttctaagcaaggttcttcattcctttggaatcccactcagccaacctcagctgcacacacatccatatggtaggcattgcttatgcaaaaccttgtactatggaggcaggaaaagaggtgtgctcctgattctgcgcaccgtaaaaggatgctgccaacacctctgtagccaaagacagtcataagagaaaagttcaagagatgcattagactacaattcctgacactagagatttcaggatgaagacccaggatccagggttgctgtcagtgtttgagctggctggacagtggacagctgtgtgggaatatgattggtcaaaaggagtgtgacctaatggtagtcgactgcgcacagaaacccagcaagtcctgtctgttcagattcttgctggcctctctgtacagcattccttctatctgggtataacaggaccatttcttaacctggggtcttaagatcttctcttccaaaacaggtatgtcagagcctttgtagccttttcctacatagaaaggcacaggaagagtagaacagtatctttacgcatcatggtctgcttttagggatggggttctaatgtctatctcccactttgcagaaaagagtctcttgtttctgtgacttgccttatgaggagaggggagggcaagagaggggagggcagagagaaaggttacttctgaagcctccaccctggggttttgtctctgctttctggaaatagggagacaaatggtacaagtggtgactggagttggaaaatgtgccaagggatcctgcaaatcagtgcttgaggagtcaagggcatttatttccctttgagaaatgcttcctaaatgaggtggcgtttagtggctcttaaagaagttatatgttgacactagagagagaggaaagtactgtgaacatgtatggaagaatggggctttgctgatgtatagaatgaaccatagggaaaagaatcaaaaattggattggagctaccttataacagtccacaaggagttgttgctcaaaggagtgttatacttaggctggcgttgtagaacaataatgtaacagtagaaaggtttaatgttggtaaagtggagagaaactacaagaatagaggcagtcaggagatggtctcagatgttctgagagcaggtggtagacccaatagattcaagaaagctggccagagaaagaactatagggttggtggctgattccataagggaaggcaaaaacatcaggatagacatcactataactgctcagctacagacaaggccctgagtagaaatggcagcaagagtgaggaaatgaaaactctgggaaagcaacaggttctgaggaaagagagcaaggcctatctttactttctaaattaaaagagtctggtactattcaatggcaaagctcgttccacagcgttagagaccctgatttgctcatctttcccaagggtctactagacacagtgtgcacactgggcgaacagatggtgagtacactggtcactggcggagtacacagtataggtctggtgcactgcagaaagcaagagctggagagagcaatggagactctctgagaacgtgtttgctgaggtctggacaagttttctagacaaagcctgcagtgagaatggtaaagaacttatctatcgagggaaggggagaaggaaaaccagccagtgcgggagacagaacagcacacaggagaaagggagatagtcagggtagtgtcctgcccctatcacaaagctgggtaagtttcagggacaaagtggaccctgagcaggacccagaggacaggaatggggtggggaagaaccagtgagctggggacccctggagacagatcataatctgtgctttctaagactgtactccctggggttaaaagataagaaagggagactcttctgttcttctgaagggggacagagagaaggcagaaattcaaaccaggtaagtggctgtcttcaggagaagcaatggctgagcattagagaggcagagacagaagggaattaaacataccagaactgtgatgcacataggcactgtggagtactactcagccttgaaaaagaaggtgagcttgtcattgtacagcatgagtgagcctagaaaaccgtttggtacaatgagccaggcacagaaatataaatatggcatgctctctctctcatatagaatccaaaaaaaagtggactgctcaaagcagagaataaaatggtggctaacgtaggctagagggatgttgttcaaagaatgcaaattttcatttagacatttttccagtctaaacaaaaattttattcaagacaagacaaataagtttaaagattttttttctccttcctttctctattctcttcctccaggcagctactgagatttacagtttgcctgccctaggatttaaaataattttttaaaagtaatcattatcaacacaaaacataaatatgtgaggttatagatatgctaattagcttgatttgtcgatcccacaatgaacacaaatctcaaaacattgcgttaacattatatgtgctacaaattggtataatttgtgtcgactaacaaccaaccagtccatggaaaacatcacagaatgatgctaccccccactctctcctttctaatcccctctctgcttcccaaagccactccatctgcactgcccgggtactctgatgtctcagaccatcccaggagtcagcagaaacactgtggggacaaagccccttctctgccttgccaccttctggagcaaagatgcggacccagctgcagttgtgttccttagctcatctcttgaaaacactgtgaaagaaacaaacaaagcatgcaatagtcatgtcctactcagctaatgaccttgtttgttttgttgtttgtttatgctagatgcagccactctctgtcccctgccccaatgaacatctgcactaggcccaagccttggagtgatttacctgaagagtgacaccaattatctggaaactactgtaagtacattatgcctctagtgaactcatttactttgtttaatggatggtggtggtggtggtggtggtggtggtggtggtggtggtggtggtgagaaaccatgcaattgtaacagtgggtaaaatttcacatagcttcatctctttggttcagcacagtaactagtcccgataccagcagcagagtccagccaccagcactcagtgcatgcatacctgggtagcattctcccccgcccacacctggcaggaagtaaagctgttcagcttggtcctgttgcctcttcccatgatggctgtggctactcttgctgtgtatacagctcatcatttgttaatctacagcctcatgcttatttgtcatttcatgtcaccctggtcaaatctgggagccagcttggcttgcccgtgcctacatgatctctgaaatgcataccatgctattgcctccctgcaaggataaggagccaagccttgcctttgggactctggccccttccaccatatttccagcccatcctgccagctctgctctgtcctctggatgcatggctctgtgtagctgattgggttccttgtacactgggcatttatgtttaaatacagccttcacaggaaagtgtgcacaaataagatagggcaggagattcaacatccacaggaaaataatgaaaatttattaactatattgaaactaatagatgaatatatgcttttttatactaagaaaggctaaagatgtgaattgtttagaagccatgcatacaaaataattacgcatgaaatctcattttaattgtacttacaagtttttctgtacagtatgaggcatataatgggataatgctttttttttacttaagtctctgttactggaaaacactaaacatgggaagctaataatcttcttaggtaccaggtaggacttttacatccatagtacctacctttgtctttagttgttctaacatacctcaaaaccaaagaaatgaagctagaattttgttttgcgtgtttttacctataatgtgtttggtgtcgtggatggtagttgctgatagctggcatataggtgatgggcaggcctggctggccaagacgggcatgaaggacagtgaggactgcggattgatggcatgagaggagaccacacattgcttcttcagtgtagtcacacagagaacttacttgcagactttatccttacgttcaagtacaagacgtgcacgcttctcacatcggaattttccttcagcacagagtaaagcctgtgtcagcactgcagcactgctagggtagcacggtgtgtgtattcttcgctgctcctacattctcgtgctgcagagaactcagacctaacaactggggtctaatccttcttagaaattgcaaggaaagctacagtcacatgttattgtcacagaaaaatattttgccttctcctgagctgcagagacagggcagactgagttacaacccaatagtctctgctgttcagaaaactgcttccttacacacacaaaagacataattcctaaggtgggaaggatataaacatgaactttgaagcagtgtgtccttcctggggctgcgtgtgctctgtacctgttctcgccatttgtgaggtaatgatgaagcagtgctgatttgaacacattacctgtacacatgcgcagggctgcctgctgacactcactgttgtgataattaaatgagatggtgtatatatagggtctggcacggcagagatgagtatgtctactcaatccactgagatgtactgagcgctcagtgggtgtcactattctgggcaccgcgaagtgtagcaaagaacacaaacaaagcctcacttattcagtttgccggctctataaatggcaaacagacaaaataggttcatggaagctaacagaggactgatctgattttattttgctttttccttccagaaagtataattgagaggaacagggtgaaggaaatgcaaatgcgaaagggaagcagtaggtacgctgacgaatcttgccaccccatctcccattccctgtcctaatgcatgacccagcgacctctcgggactccagagcccatgctctccaagtcagactgtaagaccccaccctagggccatcctgctccttcagagaaggtaccgctcttgccttccagtttaactgattcaaagatgagatcaacaactcttcgttgtctctctcccgtgtcttcaccatgctttgagcatcccttagtctcacccacacctcagacatggtcccctccattcaactcccttcagttaaaacctttatatgtgccatttatttcctgccaggatcctgactattgtgagggaggaaagacactgaaaaaatatttcaaatcagccctgccaagaagaaaggggggaaagattgagataataaaatgttttaatcatgaaaacattttaaactaatgttagaatactgggccatgtcttgaaaggctgaatggtaagaaggcgcgataacccagagtcccgtaggtggtgtccatgaatagccacagtgttgttcaggctcatggcccgccgcagcttgcttgaccctcagctccaagggactgtccacacagctacagcaatgacaggcatgtgaacagaagggggcagttaacattccttctccattgatggcagttagcccctgaaccagatattcaaaatactgctaagatgaagatcttacttatatagctaacatgaacaccacaggactaatatttttcaaaaagccccattctccagcacttggttctggaccagcactgtgctaaacacaacctggctcgtctcctttattcttaatcacagcccatagctggaaggcattgctgttcccattttacagatagggaagataaggcctcaaagatgcaaaataacctgcctcgggcacaaggctgctagctagtggagctcagttttcctaaattcccctccctaggtgggagtgtcggtggctttttccttcgtccctctccgtctgtccgcagacactctacagttaaacagcagagtaagtaaggaaatggttccgactccagaaaggccaagaaaggcatcactgatctcaattatcttgatcccgcgactgcgtaattatttatcaaagggaggttctgactaattctttcctctccagccaggctgattagtggaaagcataatctgcagcagagggtgggagcccagtggaaggagagaattggaggagagagggagaaagatggaagagagcactcgcctctcaacagaccctggagactgataagagctcgcatggataaaatatttatttttccatatgttgcagaaagcacttctgccactgtatgtgtgcaatatgtgcgaaggagtgtgaactgtatacatccaacaccaccgatctgccttgttcccgtgcatttaacaggcttaatacctaacagcgcatccatatgttttaatgcatatttctctgcaaaaacaatatggtctagtttgggacgagccagcagcctccacagcctcactcactgctatgtttcagccctcaacttactgccggggccagcacagggagagttaaagaccagaaggttctgccggccagctcagctgcccttcaccttaaacgccttcctggttcttaaagcagcctttttctcataacaaaaatgttcacagtggggagatgaaaatgtttttgttctttggacaattgggacatgttcagtcagaatgtcagaactgaccgttgaaaggcgggtgcctgcggccacacttctctctctctctctctctctctctctctctctctctctttgaatgcagagctgcaccagtgtggcgggaggaagtgcacaatgattggcctgtttttctgtagaagtgttcagggtacacccagttttgctttgcatatatttgcgaaacatctgcccttttcttgttctgaagtctctctccctcacggcccctttctcctctcccccgggttttttctttgttgttgttgttggcttctctgacttctacgtagaagttttcattttctggttgagggacaacctcatcagagtgtatagttgagagagagagagagagagagagagagagagagagagagagagagagagagagagagagagagagaatatgaatatgcacagcaggcggggagagaacaaacttgaaagagactgagaggccaggccagagagagcttggcacaccagcctttggcatggtgaccaggaggaaggttctggtagtttaggctctaaaatactgcctggagtcagccagtgtgctgctgccctctacaggcgccaggggatagtgcaaactacttagacttgtacagacatgtcctcagatgtgccatgtttatacaatcccctttatgcaaccaaagaaggcattttcagttaattacaagagagtttgctctttcctccttaataaaccacaaactgaaaaaaaaaattggtcatagaacagcacctgtgcatgtcagacagactgctgttttgtgttaacgcttcttggcttcagaaaaaggaatcccagagaattataaaagaggttggaatgggagaggaagtgctccaacgggacagtgtgcagggctctggtctgtgacgttggagcactgccgtggtaagaggagaagtgaactggcaggaagcaaggaagggaaggggccaggcaggttgggtttgaatgtgttctactcgctgaggtggctacaatgtccctgggccatggacagccaccaaaggtggtcctggacataggtggggcacagaaaatcaggcatgcatcaaactctaattcaggacaagaagtaagggcataagccgtgcaatttctccagggttagacctcatgggtggcttggcagtacactggtgcaagagtgtgctcttaattccatgaaccacatgtcaaaagctagctgaggccttgtctgtaaacatagagaccatttttttttctgctacataatgatggccattggtgttttgtccctatatttaggtgacttacaaggaccagccactcttactaaagactcttcttgtaatcaatgaaaaagcaaccaatccaggttgattcccctgccgcataaaatgaggaagcttaattgagattcaaactaggactggtctccaagtatatttaaatttcagctctatttaattctgtcagcaaacagttcgcaagtggctgctgtgtatatggttcacagtatggaattatggaataggcagtaaccccaggaggacaggaccaagattgctcagcctctgtggcacatcacagccacttagtctctgtaccgagagtgtggatgggggagtgggggaggggagcagaaaggcggagtaaagaaagggatgaacaccagaaatgggacaactgctaagacactccccttccacagaaagcccattctctctgagagccaatagcacggaactgttagtgaaataaagagttagtgagtaaggcaggaatcctgcaaccactgagggatctcagagtgatgcagagaggagccatcctgtctgaaagaggggagtcacagcagtctagcatagagacggcatttaataagtgtgaaggaaggttcctctcatttcatcggcagagatgagaaaaggcagttcaaagcaaggacagtaatgagtaaaggtaaagagccaagagtgtacattccagacccctgggaatgataaacgcacaccaaggcagccaatacacgtggcccatgagataaggtagggcagataaggaactgtcctcagattccaggctgccacggtgctgcgggatcgagtgactggaaagcagcagagctagggtcttggaggaaggagaataagtcagcagcgcagtagggaaagcattgaggctgccgtctgcagagggagcaggctggtgaagacagctgggcaagctggccacggggcaagagaaaagtgagcaaggggcttccagccgatggcaggccccagtggcagaaacaggcccctcagaggaaacactgcttctccaggggaaacagacagtgggagggggcagttagacagggaagactttgatttttaatcctttctgaatctgaaagaccagaagagcagatccttgggggtcctgataggcacaggatttgagggttagccccagacccccatcagcaatgaataaggcactgcggcttgtttctgttatgttggctttctccacactgagaaatatatctgaaagcccccaactccatcctcatctttaccacgctgtctctgcctcatgccctctgaagaaacagatttgatttcacaacctgttggactaaaaacacagcatactaatcataacaccatattctgcgagggcagatttgactacccagtacaacacatttcaatacgaaatattctgtatacaagtccaaagccatgctcatagaaacaagaacatggaaacacagcaatttacaacagattatgtaccacacataatctatccaaaaaaagggggggggggacccatactctatggtagcatagtgatagaaaaagacacaaagccacagaaactggggacatgttcaagaaggatctcatcccttttggggtgtccatgcgctacataaatgccgatttgctagttatcattgattgtcatggagaaaaggatcctgggctgactgatagctgaactatttcacattctgttcctcactaaatcacaccaccaccattctactccctatcagcaatctcttcctcagaaggcacataaataccagtcatgctcctaaactctgggagcctatactaaaccaaagagcatggagaatcttaaggctgggatggagagagagagggaagggtatgtgtgagacaccattcatctttgcctcttagaacctacaccatcttaatcgcttttcacttcctactttacagtcacctctgccactaccccttcctctggacagcctgcagatggagactaggatttgaaattctgtgttgctttcacataaaactaatagtaacagatttaaagctagaaggagcgtgtagggccttctaatccaagccctttattttgcagatgaggaaactgaagcccagagaagtgaagtgaggtgcccaaagccacacagcaagttgcaggcacagctagttccgtagctcaagtctcctgactcccagtccagtgttcttcccattactccacgggtcctgtctctaagcttcctgacaaatgctagaacggtaaacctccactagtatttttccagaccatgttaaaaatctaaggggggaaaggatgctttcttggataatgtcagccatacgtagctcaagctgtctaaagttctgggacagggtctttttatacagccaacagagtccaaatgtggtgctgtttgcttggcccatatgctttcgtgtgttcccagttaggccattactggagggaaaaaaacaagaatcagcttgttttaaaacaagggacatactggactccctcccatcccccttcagaaaaaaaaaatcaagttatctttaacagattctaaaaatgccttttcccaaatatgcagtcagttccttcaaagggccctttgtttattctcaggaagaaacccaagacagctgaaaaccagaaggcatctgaggagaatgagattactcagccgggcggatccagcgccaagccggcccttccctgcctgaactttgaagctgttttgtctccagccccagccctcatccactcgacacattcactgacaaactctcacgctcacaccgggtcatctgattgtgagtaccgcagtgaggtgatggtgtcttcccaaagcttggcgccgtgcttcccccccacccccccaccccagggttctggctgttttgcattcagagcaagctgtttccatttggtcttccaaagtagccaaaagtagcatgccaccattttgatccaaccagcatctatatattttcaaagccagagaatattttaaagccaggtaaccagccacttggcctccgattggtgattaattgcatgtgaccctgttctcttttgagacattaactcaagaaaagaagtgatatgccacttcctggtgttctagctctcggtaacagcacttcgaccaaccgttactaagtagaataaccaaatatggacctcagaaggccagtgagacacaaggaaacagccatttccaaattacataacccaagtcagatttgcattagttattggaatctcatgtagcttggctgaatttcggtctttccagttcttaatttattttgaagtggttaaaggatggcatacatttacagaagaaaaaagaatggcttccaagaattcaaaagccacccagacttcgaatagccaataagaatgcaggttaaaaatattttttaattaaaaaaaactgcctacaagctaaatttggaaatgggcacttaatgcaagtcgtcactattgaaatcacttctttgctgtttatttttgccatcttctcactaatctagaagtcacttcttaaattctattttaaggaagttggtagatcacgtgaggaggctgttttttgtgtctgaagtgtaacccggcacttgagagaggagcacatgttgacaataccaaaggacacagcattcctgttagctaagatacccaacagctctgggaactgatctctccacaggacggctggtaacaggcagagagccgacatggggatgagttaaatagaccaggaaagctttattaccaaaaaggactccattcatcctgctcctcacagacaaaatttaaaaaaaaaaaaaaaaggaaaggaaaggaaaggaaaggaaaggaaaggaaaggaaaggaaaggaaaggaaaaaggaaaaaaaagaaatctccattaggaaatgagattccaaatctcttgctattattttctggcagaagaaatataaaattctgcaagtaggacaaaggtgagtgggtctaggagactcctcccccactcactttgccatcttagcctctagataagggggtatgagctggggcaggggctgggctgtagccacactcaactgtcactagagaatgggaacaaagtgagatccaagttactcaggccaagtgatctgtaccatcagactacggcttctgtttagatacagggggcagaagcagggacttgttccctggagcatcttggtagtcacctagtcatctttcttgcctggaagtctccagcctaacagtaattacaggaagaagttgaaaataacctggcacgacgcccatagacatgtgcacactacactgcccctgccttccagaaaagtggcctttggagctggtgaaaggcctggagcctcagtgtgcacaccttcctggcctggctttctgccatacctatggggaagactgcctaggatggccctagcccagaaagctggtacaaaccaaatgaatgtctttccaagtggaaaaagcactatgcttcacatactgtacagcaagcatcctccggctaggccttacatgccctactagcctagcatatgtagaaggaacagcaggacaatgctgtcactgcagaccccttggaagccagaagagcagagcttaatggggtgtctgaatgcagttggaaagagacccaaccaggaggagaaacctaatctccagctgtctagaaagtcactttgattttgccattaagatgtgtaagtaagtctctgcaccaacctgttgttgaaattggttatagttctctccaaacgtgtttggattgtagtttgtcctgatttgagcctacactgaggggaaaattgtttttaggaaagattcacagaaatctgtccatttggaggttgcctgagagaagacaggaaaggagtttattttaagctgttaaattttttggatgctcttcttgcattcaagaagatttttttttttttactttcaaatgtcattcttaccatagattaatttaaaagcctaatttctttaaggtaaaatattcagttcctatttagaatgaacagatttggggcatttaaaaatagtgcccttgacttgttagtccctttaacttgaggaacattctaccagtatgtggtattctaagctttcacaagcgcttgaatttccatagcacctttttgttttgttgtgtgcttagcaaaattattcttagtcatgacttaatggccacttccagtccatcagcatggttcctcccaatttacagatgagacaacttagaaacctgacacctaactaggaaggccttgcctgcagtgcactcatgtaagtgccaatgagtgtttatgaatttgctcttcttctgagcatgcagaactcatggctcagcacacaaaaatggcattcctggctatccacgggcaccttggacatgagtggctactggtcatggtgatgtggtcacctgacaaatcttacccacagacgagaattgacctctactgtaactaggaaaggtggcaagccatggggcttctgcatgcactgaagtaaagatggtcagtccagcagcttaaatggtcttaatgatcagttggcagcgtattccagtgtgctgggggcacttcctccttgcccaaagagctggtgatgttcaaaagcagaagtagctttattgagatgctgctattatcttgccacagaaatgcatgctgtttggcggtgcacttcccaacacaattttctctcagcaatattctgccatctctgtggggcttgtcacctcaccaccatttctgagagcgtaatggcaagcaaattcagatgacaataatagaaggcattacggtgaatttggggatggaaagagtgcaagaaccctaggtgtttgacagagcacttaacccacctaacgggctgagtggagccaagttctcccttcaaggacttaagtaggactaagcagtcaggagagcagaggaagcccgtcctgacaactctcgagtgtagacatcacagtcatgctcatgtggtagacgcagccacaacttttacttgcatatcccttccatttttgccccccatctcccatgaggctcccatggtaggaggaagggcttctccctttagtggtcctcggggctcctgctgtagagctgcattagtttctgtcatcggaagctggaagctgacatccgtggtcacttaccttccagactgtctggtttttctgtccttgccaagatgcatttacacattaacagtttttatttatttttaatttaacctttacacagtagcaaactgttgtgtgggtgggtttaagtttagctgtgtaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctccctccccccccccttttcccttcactcatccaacgccctgtgattaaatttttagtacacttggatcattttgaacttttaagcaatttctgagagaacaaaacaaagaggatttttatggcaaactccattaatgccacattaaggctgacattttaattacccccaagtcaggaaatgcaaagttcaggttcccacagcaacagaaactgtccccttgagtgccgagtgcagcatcctagcccatgcttacacaacaccggcatgaggacatatgtggagaggagcagcctttatcctttgtgtctcttcagtaaccacagttgaggacatgagcctttagcacccctccccaaaccatctctatgtattatcctacatgctctacatgtgcacacagacaggattaaagttgctgtggggacattaactctggtttccggacttccgtgccagtcacatttagaccataatgttgtaatttttggcatgtaataaatgtgcatttcatgtacacagacagaaagaagcataaaatgtattttaaagagcaattaattactaactttgtgattaaaaaacatttggtgcatgttccttcccatttagcatcagctgctggtcttagccaggcctaatagatgacatactgtgtcccatcctggatctcagatgtacttactgtatgttcctgttcctctagataattaattccttagtaacgctgtagggggaaaacaaaatggaaggaatatgcacgcatgtaaatagggtaagggagactctgaaggaaatgattcattcctgcaaataaacctctgagtccctgataaagagccagaaatctgctaagtgggtggagacaaaggtttctggccaccttggagcatctggtcctgggccgtagaacaacttaaaagcagatttttccccccatgaattccaggcttggccagtggaggagtgatttcctaactctttaggcttcagaaattnnnnnnnnnnnnnnnnnnnntaaagagttcaggtaaaaggtgggctttgcaaaagaactcctcacgcagcagacatagtttttcctcccgctacacattactctggttgacccatttgtgttaggaagggcatgtctcaaaataactgaacaggtttctgagtaaacagaattatttgcaatacattatggcaaaatgtttggaaatgcaagggcttgggtgtgcagtgaaaatcaggagacataaaaactgccctggaaaggtatgtggtggcttaaggcccagcacagcctccagcagggcatgctcagtgaggcccctcctgctatttgctcattgttccctgtcatgcattcctttttgctcagtttggttgcatatggtatttaacctttaagaaagaaacttcagtcttccagagctctgacttgctgtacttgggctgtctctaagtgtgaatgtatgtctgtgtgagtgagaactgctcaaggagtttgaaggcctctctggcaaatttgactgcgtgttcagaaagtttccaatcggaaagctgattcagtataaaaccttccaaaaacttcctgaggcacctgttcacatggaaagattgggtttctgttggaggtgctcagaaagcgatgtttgtaactgaagatctctgtttggtgtgccagaaaaatgagaaacattttggccccagaaaacctctataaatgttcaaaatgtataatcaaacaaagacttcatttggattccgatgcatgtatctcagcagatgtgtctaaactaactggaatcccacaggggcagctgaactggattttggtatgtcttgataactgaaagagttattcttagaccttgcaaggacaaaaatggtccatctgtgaagaaccgtaatagagacatggcaaaaaacagcatcctctgaaagagttatttatggaatttaggacaagttggacaatcctgaaaacattttggggtcacactaatttgcaggagaaatgcggccaaaatggaaagaggggtaacaagcacagatagttactatcctatggcctggataatttattttctgataaatcatatatcaattaagtagtaaatagggcatctgtactgtaccaggagctgtggctgcctccagaacacccgagttctttctcttccgagtgctacgaggagctgagcatttaccttcgtttcattcctaaccgtgtaaactgagttcctgccattccattagctgaatatacgtgggtttcgtttctttagaagaggctttccctttttgaagaagtaagtaaactgtgagctggttaacaagtgctatctttagagttgttgttatggcctgttacacacctcttattcaggggtctgagtggtgcagagtgcacctcacaggttagaaagccagttggttttgtttgctactgcagcagctgctgctgctgctgctaatgctgctgctgctgctgctgctggtggtggtgtcttttttcttgctctgattttctagagtttgtatttattgtgtttaaggtcatactttttctttttaattacatctttgtagtctcttttcttccattcactgaatgtggcacctggtccaagtctgcttccgagagagcttactgtgaagggcagactcaggactgctcaccagtcggtgactgagtgttctgaaggcagagggcctcaggccaggtgttccgcaggacagtgtctaacaagcttctccagggcttggagacttggagtcttgtaatggagaggaattaccatgagaaaggacggctgcctgacagggtggttcaaaattcatcctcgcaccaagacctcggcatccatgcacttgttcaggccttacatgtagagtacatgtatgttgtgtattcatgtggagttttactgagttccatgagtacccaaaaatgaaaactagcagagccaagaaccttaatatttagtctatgtcttcaagccaccattatcttagaactcagaatggttatgaaatacactattattcattaacatctcattaagtttattgaagaagttccaattgacctcttttgaaaggtgaacataatttcattgaatatggggcattagggtaaagaatgacaggtttgcacccgagttcaaaactacaaaaccctcaggaagggtttttaagggacttttcaccatcaaagctctgtgtagataagatctaatttagcagccagtatgtggatcgtgcagggatgggaggagccaactggaagaggagagcgcccaagagacattatcagtagctcacactttagtgacctgaagggagctggagataggagtagagacctggggaggtagattcatagactgagatgaggctgagaagggaacttctcagagaggactccaacaaggtagcaaaaccgaagatttagggatttgggcctagtggaaaaggcctacaatccaagctactccgtaaatacaggagtaaacttcaaagaagacttcgttgaaagaaaaaaggggaaatagaacctgaggaatgtttacactgagtgataagaagagaacaaagaatcttcaaaggagacaaacaaaaaagatctgaggagaaggccaggagagtgaggggcataagggagggaacgagtgagctacagaccacagagaacagacagtgcaaagatcacctcaggctttggaacttgcctgtcatgagagcagaatcagcctccccactctctttctctcacacacacccttccatgcagaggagttcggggacaaaggagataagtggtaaatgaaagaatgttaaagaactgcaaaggtgggatccggagtatccttacgaggccagagtttcagaaaacaaaaatcaagaagcacataggaaggaggactcctccatggaaggaccagtgagagggaactagatccatccatagtgcagatgtgagtgcacagcccagtgaggcagtgaacacacctgccctttccccaccgctttctttcctttctgctgaatgaaaactaatgttttctaagagttgtaggatgtcttctgtggaagacttcacctatacccacttcatctgaacatttagctgaggacaagtatcagataccagaagtattcaaattcctttaaagtgaattcctctcctgagggagcctgtacaaatggccacatagttaccagtaatagcacacactcttctggatcaagcatcatgagcatccccagcttcatttggggcaaggagtttaaaccctgtgtgctaagacaccacgttaggaatttcaagatgtgattaccagattaacctccctatgtttctgttcccagcacacatactgggcagctcacaaacttctgtagcttcaggtacagtgggacccgtcaccccatttggctccaacaggctcccaaatacacacacacacacacacacacagagagagagagagagagagagagagagagagagagagagagtattgataaatgttctccagcacacctgcctcctataagcactttcggcaaggatatttctggccccctcccactggaaagaaaaaattagatgcaaaggccttagaccccactgttccagaaagtgaagctctcttaggtctgtgagctccctgagaagagaacgcatgcacatggggtcagagaattcagagaaggaaagagcagtgtgtccagatcatatcccaatcagtatctgtctccttgaacctttgctccaagagttaagtcaaatgcaagaagtcctatgcgaacattcaaatctagcatgactcctgataaagggtgaggaaggtctggtaacagacactacagcagtggttcctacctgcctaacactgccaccctttaatacagtttctcatgttgtggtgacccccaaccataaaatttttgttgctgctgcttcatagctgtaattttgcctctgttaggaatcagaatataaatatttgatattcaggctatttgatatgtgatccccaaatgggttgagaaccccaggatgagaacagctatttcttgggtgtgttatttgtgggctaagattgagatcatgtgttgttcaggaagagatttctcaacgccatggtctagttatacatggactttagtctatgaatgcagtttaacacacttctaattaccgtcctctattgtgatttccttgtatgcatggcatctacacattcataatatacatgtcccatgggctattgtgcagacagattaggtgcagggttgtatggaaagctccaaaactgcacccgcaccagtggctttgaccttcagctagtacctcttcctcttcctcttcctcttccttagcttcagttgcttccacttttattattcttgtattttttaagcagcgtctcatggtccaggctagacttgaaccttggatctttctgcctcctcctctggagtgtgaggattacaggcaggtggcactgccatgcttagtgtccatttgggtgttttagattatgaagaaaatgtcgacttgaattaaagcaacctaaatgacagttgtatcagggcccaaacttcctgagagccactgaaactcaaaaacctcagtctgtagaagaaatggcttcaagtgccccttctggactcaggtctctgtgggtcaggaagtctctccactaatcttctggtggttgttttgacctctaaaaaaacaaataaacaaacaaacatacaaacaaaacacctctacatttgttgatttactttacttaaaatggaaaaggactaatatttaataagtacccagtctatgtcaagtacactgtcagcatccttataaaacaccacatatcatagataaagaaattatctggtactcagaaaagtttaaaacaaaaaagccttccaaatgtcttttttcttggtgtgagaaagctttaaaaaataatatgataatgttgaatgataacattacccaactgagttcctggtgctcacctgcattcggatcagtgagagagtttcaaataatgggaaatggaatggagaggtttactctctccctcagatgccagcctgcacacaccccgtgtaagcttcccatggccagattcatgaagatatcatagatcaaaccttaaaacaggcagaccattgttctgccatatcacagagccttctgcagagagaaatccaagcaaaaatgtgcgtgtatacacatatgtatgtatgtatgtatacatgtattatgtatgtatatgtatgtatgtacacatacatacatatatatctttaaaagacagtcttcctgatgactttagagtattttgagatcattcaaaatcaggtgcagttagaaaaagtaaatgtgtttgatgaaaatgagaattattctcagttacctggcttgggtaccattttcatttctgaaacagtttgcaatagttaggaggaaaataaaacctgaagaataaattcaatgaggcttgctgactttgtccctgcttcctgtcctgtggtacccacatagtttggggcagtatgtggagaggttttagacatttgcttctctttcttcctgagtgtttctgctggtgggtgtagaattgcaaggacacacatggaggaacttgatcttcaaatcttccagtaatagctgcagattgaaagccaaagcagattatgtgcaagtctgtatacatcccaagtcagagctttaaaatgataacttactgagtcatgagttctgcatcttgcatgcagaatttcttaaatcacatgttgatggctaatcagcagaatccaaagacgcaaattagatggtacaatatttacagagaaaatatatgtgtagctcacagagtaacgatcctcacagttaccatcccacccaaaagggggaaaaaaaaaaaaaaaaaaaaaagaagaggcagcagcagcattgcaatctgaactctcagtattgtagccaagaagggagcccgtctaacagtagaaggaactgaagacagaatatttttggtagcaggggtccaaaccctctgaagagtcagaagcagcactgcaaggtgaaccatttctgttattcaaataacatagccagtatatgtgtgtgtcatataacttttaatattaataatatattcttatataatatataactctcaaataatcttagaaatatatatggatgcatatatatatatatatactttaaaaatatttgagagcttcatatgtgtatataatgaattttagtcatttcacacatgcacacacccattaccttcccatccttttccttctccctctgaaactgttcaatcccagcaatgcccccctccctccttaatgtcttttgtgtgtagttatgactctgtaagtttagttacagtttcttgtatgggcaatggtgacaggttatgtcatggagccctggtcagcattaattatcagtagttccttagggaatcatggagtctcatgagcccctcctctgaccatgaagagatattgaggcacgcactcttgtacaggactgatgtggatacctgttgttgcagtgatatgtcatctctagaatacctcttttgcgacacaccttccagtcctcttccctttgatgatgttctctgagtcttgaagagggcggtagatgtcccattgaagtctcagctctcttgtgtctgcttaaccactgcctactgcaaaacaaatctccctgatgaaggcagccctgatctgtgtgtgtaaacatgactgtttagaaggcagtttgaccacatgtccatttatccgagtgatgggagtgtgtttccctaggaccgatggtctcccagccacaagctttggacaaggtttactgtatcagaatgagctccctccttggagcaggcctaaactccagtcagaaaggggttagccataacatccatgctctggcagctttaaaaaaagcattacatgtgaggaggggacacacacatactccacagcatgtgtgtagaagccagggataacttactcgttcttttcttccatcgtatagaggcatgggttggactcaggtcatcagctggagtagcaagtatctccatccactgatccatctcaaaggctccttgccagttcttgtaactccttattttaataatttattatttacttattcatacattcatttttgtcattctgggaagcggacctgttgccccacacttgctaggcagttgctgtgccgctgaatggtcagccccagctaaaatgttgaatgcctgttttatccaggcaaactctgctgttgtccatttcctcatctcttggatccagtaaagtgcttagccatagtaggtgttcagccagtgtttgcagaatggatgactgaaggagatagggcagctcagggaactgtactactgagcatattgcagggttataatattgaattgaatttttccactcagcagacctacataacaaagtgcatcccagataccctcaggtttgtatgctgggaaaacagagtgctttctcttgatcatagaccgctacatgttttgattttaatagcaatatggcagggttaaggtcaactttgtaatataatctggtgcctgtttgttcatagatatgaaaatagatgttcttcacaagatgctcaaacagatgattgggtgaaagctctagaaaaccttgcaataactaaaaggaaagatctcccacttctgctttccatcactgtcaaatggggtacagttttgtgcagccccaaccattctttcttgtctcatcatcttcccaggtccagtctttgtctggcgaaggcagcatatgactgttagtatagcaaggagatggttcttgagaaatccagcccccacacacaatgctccagagctcctcccctgggaatggcatgattggatccgcagcaggcagagctggcccagggaaataagagcttggcatagaatcttagggccctcctgctggaggggccctcaagagagttgcttcacacccaccctccttcaactggctggacagtagaaagatgtgtaagaaaacaaattcctggctgaatgaatagaggattaagtgaacgagagatgagtcccctgttccagaagtctctgccatcccacttgaatagaaaggctaactttgaagccactctgttctccatggcatgattttgtatatactcagctttggaatatggttgccatctgctgccagtacataagactaaggaagtattggggtgggtaggaggaggctgggaggaaagaaagagacacttaaatgagctaatgatctgctttgtgttggagtctaggtttcagaacatcagttccgtactgtaagaacaaaacaccagtgtgtcttaggccacaccaggcgccggcacatcagataaggcccatgctgtgtagtgttcagccactgagcctcaagaagttttgaaagtgaaattagaggagcaaaccaaggaagccaaagtgggaaagctcttagggtaaaatatgatcagaaggactctgcagatatgtgccttcgaggttacagtagttcaaacatgactctactaattaaagacttggaaaatagtctcaatcctaggaacttaaagatctttaaactaaagtggagacttctccatctactgcaaaggcattgtgaagcttttgtacagtcacaggatgagagtgacccagctattgtgcattgttgtgcacttaactattgattaagagccatagattgctgtcctggcagcaggagtgggtggtcttttacaagcaaaaaagcctggtaagcaaagccagcaaaggcaagaccatctatctctgaaaagcagtgaatagctcagagagcttcctctttccctgatattatctgtataaattaccagttatggcacaggatcatgttgataatttatataccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactagtgaaaaaattatcccagcgaagtttacttttgagaaagattagctaattagccaagtatgacatttggaggcaagtccccttctactcttaatagtagctctgtctccactttgaggagttagcaggattgtagggcagaaatattttctggcgtgaaaaggaaagaattccttcattactataagcaaagtgaggagacagggagagttgtggaaaagcagaaaatcagatcagcacgcatagaaagtggttgcaagagcatgtcgacctcagagccctagaatgaccaagccaggaaatatttgttggctgtacaagctttggccttgattcgtatctgccatcagagcgaagtcatccacagctgtgatgcaaccacagaatgttattaatgtcctcagcccctctcatatgcagtctctcatcccaggagcccagtgtgccttaggactctgcttggcttctcccaagacaaccccatggagcataaacgtcttcatttataaatgaaataactggtccacaaaggcccgactctgttctctggcttcaaatgtgaaatgattaatagtcatgatgctgacccagcacgttgtgctattttttacattattttgggcttctcagacaaaggacatattttatctttctcattattatttttaattagttttcagaaaagtcaagataaaaaaaagaagaagaatctaacaaatatcccatagagatatttggtattttctctctctctttttgagaataaattaagatcttctctgcttctctatgctggatctctgcagatagtcacagtctcatgccagttttcagaggaataagggctcattctaatggctgcatcacagtcccttctgtgaagaaacagccttttaaattcctgtctggacactgaataacttgtttttggtttaaaaacttttaacagtttgacctgaaaacttttaaacattactaatatacaacctggttgtgagtttagcaataaatttagacccagtatgtgaaaagccaaagagaagactagtggcttttattctccctggtgacctgcactaaatgttgcatatttactttgtaaatgaggacacccagtggccagcaagtgaaaatattctaaacaatccccgacactgttaacataaatataaagagctgttgtcagcacccattgatagatagcttctagcatctactaccaagcactggtttccctgggtcaggcaagagtggagcctgataattttctacctcactttccagactaggtgtctctttccctttcatataaacgtggctcgccatctttggcatccactgaatcgtcagtggcagaagggcctagtagaatatttcttaggacagatgaagtcaggaagttgagaataacttaacagagatcagaaataataaacagatgagtgtggtttaaaagaagtgaggtaagttcataaaccataagttcatggtgaagacagagccatggttattaactaatgagagagtaaggaaattaaaaacaaaacccaagaggaagaacagatgtgggccaccagggactagaaggacctcctggaacaacgggtaggctcacctcagagcaaatgagccctgagctccacttattctcagcagtgtctgtacagtgtctgttatggagaagtaaccaaagagaacacctacccctttgggggaatgtgtgggacagtgtcagggatccagttagcaacctgtgttctttcagttacagttagagttgtacttgtatttgcagtaggtaaggtagagctgtcttatggctgtaagacaggcacaagggaaaatggggaaggcattaacttactgtcattataaactatctagtatgtgtgtaaagtacagctatattcttaaacattcaaatatgtgaaccatttccttgtttttcttaagaaaattaaacctaagactcctgggtgaccagtttatatagaaacctaatgaagtctcaagactgtcttcccctccccagatttgtacaagacatgggaaatctagggaaggggtcacatccttggtccatagtgagctttgtagttggcattgcttgactctctgatccttttggcttctaggaactactccactctctgtggttatagatgccctcaacatggagcctgagtccctcggatcactctttctctcagaacagttagtgtccctttatgtctagccccccaaaatatgcaaagacattttccacaaaggcttatgtgcaagttgacttgtttcagttctcttttgttttgtctgtgagagcctttgctgagatagggtcttaccacataccttggactgacaagtctcccacctcagcctccaggatgctgtgaccacagaaatgagccatcgcttgcttacctttaatattttaaaggaagatgatgatttttcttctcagtaatattacctcaatctgacttcaaagcatcagactccccccttcatatcctagaaagagtcctaattagttccctttagaagaccaaattgagaatgaaaacccttccttgtagggattaataaactctgaaaccacagctcttttggatgagggagcccatgtccatatacaaacactcaatgcttctgatctacaggaggaggagaaatgggactctcttataaacgccttctcattctataacaacaaacgaaaatttaataattctacttatacctccaaaccagtggaaagcaggaaaaggaagaactcagcataaaccctagtaatcatgtgaagtgtcccagagaaaggagagttgtaaataagtttcagggaaggtttgtaaggtttggtgagtggaaaagcccagtgacttgagaacttttgtaagatgagcagaaggagagaatgtggagtgagtgcagtcgggagaccatggcacagtggtacttagctggtctagcacgccctagactccaccaacagcaagcttccatcctagcccccaagtgagtaatgaataccatataggtggaaatctgcaaaatgaccaggctcttgaatcagttcaaagattctgtttgagaatacaatgagaatcaaattaaaccaacctgacagacatgagacaagactgtaagaacacaggtaaggcgtcatagagctcggtccttctactccaatccatgaatactattgtaaatattatagcactacagaacagggtatggagatagaataatattaaagcaaacttctccttatgagcacaactgtgaagtgtgctttctgctccatttggtcagcagcgcttcctggagcttttgaactctgtcaacacttctgcactagcttagcatcatcttcttagcacaagaaaggaacctacctgttcgttttaattttattttagatttttacatttgaagacacttgttccatactccatacataatctaatatactcattagattttgttactgaacaagatatggccatttaaatgcaagtctataatgtgcatgaagctgattctataatgggtcaccacaagtgggcatctgagttgtagctacttactgtcttaaggtggcctacacaaaaatcacctctgagctgccatttgaccattaatctagcaaagcattggggaaggaggcctgtactgtttagtaggggaatgcatagatagcaactgcagtccccagcttccatagggaaagagcccacctcctgctgcccacagtgctgccttggattctcatggtcatgttggagctaacattgtgttcagaagacacagcagagcaatctgagcgtgaatctgaagttctgctttagaaacattcagaacaaaatcgcaacagagtttggaagaaatcaatatcttggaagctgtgtgataatttcattgggaaagattatttacctggcaccacaagatcttatatctcactcactgaaagctagattaagggtttcctaactcacaaattaatttctgcaactcttaccagttgatattttctgaaagaatggtattctagaagactgcagtgtctcattacagtcactgaagtgaggattctatctttcctgtttaaaaaaaaaagagagagagagagagtgcatgttgatgtggagctgaaaaggagagcaaatgagtaagatgtgctagcttctatataaacacattttaaaatttgaatttctttcccagaaaaaagaaagacaacttctcaacgacactgactatctaggtccctctttaaggcctttccaaatccaagctcagactggagaactgtgaaaatttcagtacattcttcggctcagctttttatcccgcccacggatacagtatctctgtatttttgttctccagatttagtgaacaatgagaaaggttacaatagggcagcagctaaatttgtaaggaaagagctttagggggaaatgcaattcctgaaaggcgcttcaaaggtttctagtgtgagaggatttaaagacatcaaccttagcctccattgacttttctcctggtcccagcacggcttccctcctcaagaagccattttatttcaagtctgggcagagagcataggtgttcttcagcatgtctggaattttctgctcatgcttttattctgagaattaaaatataagcttccacaaatacacagcaagacagttagtatccacgttttagtccaccagaatcagaagctcaaagcagaggtccatcctgctcgttgattctactaagggttatcttgactgcgtgaaggactgcccagaaacccacgaagtattatcttaggtatggtggcaagtgtacttccagaggagctcagcatgtgagtgtgagtggacgaggtggggatagttctcccccagtgatggtgcgtccttaggcatccccacctgagagctaggtagggcttgcttctgctttggatatcagaactgtaagcttccttgagtttgtattccaggcttataccagtggcacaagcgtgcatgctagttctgaggccttcagactcacactaagccatactcggagaatcccaatgtcttcagcctagagatgatctgtcaagactactcatctgtcctaattcatgagccaattccttgaataaatcccctctcatatgtctattgcatatcctattgattctctccctctaaataactccaactaatacaaattttggtatcaagagtgactctagaggaactgaattttttttaggaactgaatcttaaggatgatttgtgtaactgattttaaggattctagaactgactatctgattaaactacaaattcctaagggttctagttagtacagagagcaccaagagactgtggcatgagttgtagggaacgcaatatttgatacccctggctcactactcattagaagcaaggagtttagtgactctgtctattgtactttcagtctggagaaccaagaaatgtgatgctgatcagttacaaatcttcaggaatgagatgtcttggctcgagctccacataacttactgaagtgtatctgaactcaaaatgtctctcctacatttccaataggcaaactgctgataataaagcatgccctcgtcattcagttggctgaactctaacagactttgaacccagccttttgtggtgatagcacactgttaaagtgaggacattagttgaaaggtatgaggtggagataaggagaaggaacgaggggatccttagcgttagattgaaatgtgtgtgaagactaatgaggctggggacacagagctcctaagctctgaggagacacgtttgccagtgggcatgccctctctccatgttctctccccatcctgtgccctacaacagagtggcctctacccactgccctatggcacggcagctggtccctcccacccctgcagatggctactcacccacacaaggattggcttttccctatctgcctgcaggcattggctggcatcattgccaatgaaaacatcagtgatctctcctgagaagccccgagcaggagaatgctgcttctcctcaggcctggccttcttggtttccaccctgagatctaaattcaagtcagatcagaattcctaaagtgcagaacaaaatgtcaccctgaggtgtactgcaacacaggaatcatgagatgcctgctttatgcaggcaggagtctggagaaatctcgtgtgggaaacatgagaggccaggctaagtaaaggggaaatgaacttatagcagcctgaatgtgtttttttaattgagatttttttacaggttgtgttaaggatccatacacagacatttcagtttgtacacaattcttaacatatgaaaaaggtctaaaagtgacatgttgtgattcttaatagcataccttccagtgacttttcaacttcaaatgtggaggcaaattttctacaaggagatatgaaataccaacacattcacatgctaatttaccatcacagaagacccgcccaggtctctggtttctaccacacacactgtacccacaaatttcccttctcagcacattaacaacgttatcaagaaaaggagacagccattccaagggtgctgcacagtacacacatgtctgacaagacaatagtatattccagacatgttcaacatacaactgtgactccaagtttccatttcatatgttttatattataggatataaaattaatttacctatatgatgttaagcttataaccaagacagtcataggcttccctaattaaatggcccactattttctggttatataaaaaataagcaacaaccagaaaatggttttgcagcttcctgcttctttccctcctcctccaccatccactctgagtaggtaaatccattttactatgccaggctccctactccttcgcactgattccttggcactctgtattgctcatattggtcctcttctgatccatgctgcagccaacaaatttaaggttagtggattttcttaatgctttaagctgtaagatgaagtgtggttccagcacactaggcttgatttcttttacctacttaagaatggacaaaatggtttccttcaatcttaaagatattcttaggatcatgaagactaactcgggattgcagttatacagaaagcataactctggtgctgagacatggtgtttatgtgtagacctaacgttctgagttctgtccaacatcccatttggtagcaggagaaccgactcccaagagttgtccctctgatctccgcacatgctctgagtcacaaatgcctgcacacagaaacacaccacagatggatggatggacgggcagacagacagatgaatggacgggcagaaaggcagacagaccgatgaaaagatcttttaaatatgtttgggttatacaagaagggagggaagaacagtgaggcattcgtagagttagcttttgtcttccacggtaggctgtactcttcctttttaacttctccattttgtgcagataaatgatggggttcttgatgagcagcttgggacatttttcatttttccctttgtttctgggttctcttttgtttgtaccctcccccctccccatctccaagatggagtatctttatatagtagccctcattgtcctagaaccagctttgtagaccagactggcctcaaactcacagagatctacctacctctccctcctgagccctgggattaaaggcatcttccatcacagcctggcttgtttccccttttttttaatttggaggtttgttctttccctttaagttttttttagctttcagctcttacagtagtaggctcagctgacagtctcctctggggcttttccttcacggaacccagctgggttgtctttctttgtggatgtttcagcagcagaaagcctgtgagctgggtaccagaaggctgtggcacgctgagagctctcaccaagccatgctgcctgactgctacagactaaaaccatcagtatgggcccattgagcagaggtggtacatttcctgtttgggtttttttggctgcagtgtgcatcaaaagggagtcaacatggctgaagtggaaatgccccaggaaggactgcaaaggcttggggatattggaatggtagagtggatttgcctaactcttcctcatgggagagccagaggtaggcccttccccaaccagttcttcaaatgagtaattaaaggggcaacccagggcctttgaggagctctgtgatgatgctttgctgtagccctaccttagagaggaaatccctgccactcaagtagaaaatgtaaatgcaatgagaactggatctgggaatacaaggaccaagcagtggccttccactgtcggatacaaggtgggtaattacagtagtagatagacatacagagcaacaagcaacattgtgtaaataatgtagatccattaccttgcctacttaatcccagagtctgtaggacaacaggaaacctacccaacccttctgtgacctatataaactggaaacttttggagaaagtgaagaaaacttgaactcacgccctacagacagaatcacagttctgagtcagtttccagagctgagttgaaagaatgcaagactgagccactactacctaaatgatgtcctgttcatcttgtccttctccaaagggactggcagccctttaccaggacacctgtgcatggggaaagaaagagtcacaccttataaggatgagtagaaatgtgctctacacactgattcaggagagtacagtatctcttcagctacccagtcagagtaaggccttacaaagatctggtgataaatggggtttgtggctctagtctgattcatggttggttctcagatctatcttacgtgtctttctccagttctggaatgcgtgattatgacagggatacttagcacctggccaaatgggcaggtcagagctgccttttcctaggaacatgatagataaaattagtatgtccccagagggtttataaagactaatcccaccatcaaggacttgcaagatgccagtatgtggattctcactcagcttttttatttggcctgtgcaaaagacagatggattttggagaatgttaatagattattaaaagtttagccaagtgatgacttcagttgattaatttacaagatgtagtttcattgtttgagcaaatcaacatgtgccctggtactttataaacagctaatgatctggcaagtccccttttctccataagacgaatggctaggccagcagtatatttatactgcagttcctacctcaagagagtatcagcttcctagcccagcaccatagttgaatttccaaggatcttgatcccatttcctttcagagctataccactgctccttcacactgatggcatttggctgactgggcatggcgaatgtaaagtgtcaaggactgtggacatgttaacacgcaaattattgtcaaagggtgggaagtgaagttcagggccttgtacctcagagaaatttctagggctctatgctgtgggacatgttaagatcccttctaaggtaaagggtgagatgacacaactggtatttcctggaaccaaagggaaaaggaaaatagtacagggtctgtttgggtttgccttggaaacacatcctaaagcccaaggaagttacacagaggagaaaccttcctgctcctcgtcgtagtctccctcagcctatatctctgattcatagagaataccctctcctgggtccctggacactcagcctcaacctcagagtcacaccatgggtttatcggattctcaggctttcagactcagactgagctgtgtcaccaagatcctggtgtccccagcctgagatgacctctcgcagaacttctcaacctccataattgcatgagacaatttccacagtaaatgccctttcatatgtctatactaatattctcctgattctgtatctctgggaagtccagatatgcacacagatgatgtcgttatactaaaactgagtttttagtttatgtttacaattggttccctaagttgttgattaattacttttagactgatgtttgatcatactttgctgcgacctaaaaggatttaggttgatgttaacaattcagtaattattaagacatgtttttatataacggcagacaaacgaggaatcagagtcaaggtaaagtaagttattgtttattattattatgtaataagtctagatgaatttgtaagtaggaaagcacatattgaagtctactcagcttctgtaatgtggcccaaatcttgactccgggctcctttttctaagcagagccaggagagcacgatctttttttttttttataccatcagatttcagcaagagcagagcacagtactgttgccacaacctgctaagggggtctaagttgattagttaatatggttcaaatagtgaaagtctctttggatgaatttgctttagatttcagctcattcacatttacactagggaattctcagtaaatatttcactaatgatctagtgaaaatccaagcaaccccccagcagctttatccataactcagttatgtttataattttagcatgaagccagcaaagcttccttccctcttgggatcacagcagtcttggtttgaagtaggcaagccagagagacctgagctaagtgaaagccaatgagagacccatccgcaaagctcccagggcctaagactccaacagtgatagaaagccaccttcagccttcagacagactagaaaggaaattagactagaaatggaaaaagaaattagaagtgaaacgtttgtctagagttaggggtggcgttagtgtcatagaacaagtgggttttccccagttttacttccctgttgcccatacataagccttagtaagaagagaatggtgaggatggaaaccgaggaggaaaaggggaagagggaggagaaggagagaaaggggagaagagactagagaagagagggagggatggaagagagtggcacagagaacagggcagtggggaaaagagcacaaggggaggaggaaggaagggagggagggaggaaggaaggaaggaaggaaggaaggaaggaaggaaggaaggaaggaaggaaggaaggaaggaaggaaggaagaaaggaggaaaaagagggaagggcagaaaagagggggattatagtgccttcaactgaacctattccacacttcattttgttgcgtgaattggaagtgtatattggatttgctttatccttgtactataatatctcatttcaacattcaaaaaatagtcaccattccctaattcttccataaatttctaataactgtcaaatgaaatgtgctctgctaaaaaccaaaatcaaatcaaaccttactcagcgattgccttcaacagttggaaacaacctccccaacttccacagcttcattctaaccagcttcagttaaccttatccacattcctctttgagtcttactgttactgttagccatccttttctaaaagataactttttattgaagattgtttatcttaccatagaaaacattaccagctccaggctgggggaagatcaagcacttgccacacaaacgtaaaggccttggagcaaattcccagaagcaaagtaaagccttgggcagctgcctggggtgtaaggtgtaagcagcgttactgagaggactaaaaggaccatggtgcttgaggctggactgtggagcctggcccctaagctgtgccagtccaagtactgagtaaccgacctcctccgagccctacttttgatttagacctgttggcttgatcaacacttggtttaatttgagcactggtatttccttctttctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatggatagtctctagatagtaaaggaatctattgatgacttactgtcggcagcccaattcccaacaatggttcagtcgtagctgtgaatgaagtccaagaatctagcagttactcaggctcacacagcaagcaggcaaaggagcaagagccagactcccttcttccaatgtccttatattgtctccagcagaaggtgtagcccagattaaaggtgtgttccaccacacctttaatcccagatgaaaggtgtagcccagattaaaggtgtgttccttgaactccgagatttaatcttctggaatccatagccactatggctcaagatctccataccaagatccagatcagaaacttctatctccaagcctccagataagggtcactggtgagccttccaattctgaattgtacttcattccaaatatagtcaagttgacaaccaggaatagccactacaccattgttgccagatatggggcaagacaaacaaaacaacccttgaggaagagtcctagactgataaagaccctgacccaaagtaactcgaggaggaaaggattttacaggttagaggccattaccaaggacagccaaggcagaaatgaagaagggaaatttggtcagaatatattatatgaaaaaaatattttcaatttaaaaagaagaagataggaaggaagaagcctttgggaggaactgcagcagaaccagcaggagctggtttgaataagaatggctcccatagaatgatgtatttgaatgcttaggtggcaaggagtggccctatttaagaatcctttggagctaaggctttgttaaagtagttgtggccttattggaggaagagtctcactggggaagggctttcagaagcccaagcccaacccagtgtctctctcctgcctgccagttcagatgtggacctctcaactacttctctagcaccaagtatgcctgtgtgcctccacaatgatcatggactacacctctggaactgtgagcaagcccagattgaatgctttattttataagagttgccttagtcatagcatctcttcacagcaatagaacactgactgagacaacttgcttccccagctcctgctcagccacatttctcttactaccccaaaccatctgcccagggctggcaaggctctcctccatcaattagcgatcaagaaaatgtcccatgaaaatgggttaatctgatggacgctattcctcaattgggattctcttccttggtgtctatggcctatttcaagttgacaaaaaccaactagcactgggaagaaagatttatcttggctcatggtttcagaaggttcaaccgatgctttttcttggtcctattgtaatgaacacatatggcaggacacagagatacgctcatcatataacaacaagcagagagaatccaagaagccatggcaagatacggtcccaaagggcacatggccaatgattacttcctccaaccaagctgtacctctgacctttaaccacctcccccaaatatagcatcttattgtgaaatatatgaagggcttaattaattcattaactcagacccttcataatcaatgataatgccctcacagacagagccagaagtgttcctcactaaccttttaggcaccctttaaatccaatcatgttttctgtcaaaataaaagttgtagttctgactgaagaatggctcatggaaaggtattcttcagagacctctgaggggtgatgtagaaaaacaggaaatccctgggactgtgccatagccatctgctttcttctcagtatggaatggtgttaacaacattgtcacctgtgtagacagtgtggaacataggggtggcagttggtcagatgagcagagcctccacagagattattgtctcccttctgggaacagtgtaaaagttctgcaaaacaccctatagctcagtttaagtttctatactacctccagtgtactcctgctctcctggcctaattatgtactctaagtgcccatcttaaatgataaatgtgatccacctagcatgatccgactcagcacatctactctggccttcaaaacattccttctttctgggagtggtgacacaagtacatatttattctggaggcagaggcaggaggatctgagttcgaggccaacctggtccacttgtgagttccaggacagactgagtggcacagggagagcctgtctcaagaaacacacaaggaaataaatcccttcctcagcagcagcagcagcatccgaatctcacagaaccatccaggagagtgcacagactgtcaagggtgctaggagagaggagatacagaagcagccagaaagtgggtatcgttgctgcctactgatagaataagaagtgtccgtaacttgagggcaggaattcaagtttcccagaagagttgggattagtccagagtgaggcaggtggagtggttcctgggctacaatgcatcttcgcatcatgctgcagttaaaggaatagcaggcaacaacccatcttggttatccttttagaaaacatcacctgaatttcttcacacttgatcttagccaaaagactaagaagcgattctcctgaatttcttgtggatccatatgaatgcacccaaagtaactaggatattaagtccggggggggggcactcaagaaattagttgcctaggctgtgtgtgcagtatccccagctttctccccgcttgtgtgtgcatctgccaggtgggtggttctagcgttactcttctaagacctgagttagaaatgccatcagctatgtatgactgtgtgccctgtcttgtatttgcctcactaaactacaggtgacatcagttgcaaggggatgaccgagcgcattcacagcatcaaccttcacaacttcagcaattccgtgctcgagaccctcaacgagcagcgcaaccgtggccacttctgtgacgtgacggttcgcatccacgggagcatgctgcgcgcacatcgctgcgtgctggcagccggcagccccttcttccaagacaagctgctgctgggctacagcgacatcgaaatcccgtcggtggtgtccgtacaatcggtgcaaaagctcattgacttcatgtacagcggtgtgctgagagtctcacagtcggaagctctgcagatcctcacagccgccagcatcctgcagatcaaaacagtcatagatgagtgcactcgcatcgtgtcacagaacgtgggcgatgtgttcccaggcatccaggattctggccaggacacaccaagaggcacaccagagtcaggcacatctggccagagcagtgacacggaatcaggctacctgcagagccacccacagcatagtgtggaccgaatctactccgcactctacgcctgctccatgcagaatggcagcggcgagcgctccttctacagtggtgcagtggtcagccaccacgaaacagctctcggcctgccccgtgaccaccacatggaagaccctagctggatcacacgcattcatgagcgctcccagcaaatggagcgctacctgtccaccacccctgagaccacgcactgccgcaagcagccccggcctgtgcgtatccagaccctggtgggtaacatccacatcaagcaggaaatggaagatgactatgactactatgggcagcaaagggtgcagatcctagaacgcaatgaatccgaggagtgcacagaagacactgaccaagcagagggcactgagagcgagcccaaaggtgaaagctttgattctggggtcagctcctccatcggcaccgaacctgactcagtggagcaacagtttggggcagcagccccaagggacggtcaggcagaacccgcccaacctgagcaggcagcagaagccccagctgagagcagtgcccagccaaaccagctagaaccaggtgcctcctctcctgagagaagcaacgagtcagagatggacaacacagtcatcactgtcagtaacagctccgataagggtgtcctacagcagccttcagtcaacacatccatcgggcagccattgccaagtacccagctctatttacgccagacagaaaccctcaccagcaacctgaggatgcctctgaccttgaccagcaacacacaggtcattggcaccgctggcaacacctatctgccagccctcttcactacccaacccgcgggcagtggccccaagccttttctcttcagcctgccgcagcccctgacaggccagcagacccagtttgtgacagtgtcccagcccggcctgtccacctttactgcacagctgccagcgccacagcccctggcctcatctgcaggccacagcacagccagtgggcaaggcgacaaaaagccttatgagtgcactctctgcaacaagactttcacagccaaacagaactacgtcaagcacatgttcgtacatacaggtgagtgccccttctctgaaggcttggcagcagggtgtggagggtcaactgtggaatcaacagagcaagatgatgcatagaagggaagggataatgtcatcttccagatcccaaagaaaccccaccatgggccccctttagaaagaagtctagctgtacctatcataagaataaagtactcccaagtcacaaaaatcctttatgggaaaagtgacctaaattcaagtacctgagttttggagatgacatagtgtgggtccaaagcttgctctttggaggaagaaattgctctttggaattcaggcccagctacttactaccaaactgtgtcaccttggtagaaattacctaatactttaaactttgacttccagagggaggaggggagagatagataaacagatggatagatagatagatagatagataggtaatagataaataaatagatggatagatagataatagatacatagatggttatagatggatggatggatggatggatggatagatagatagatagatagatagatagatagatagatagagaatagtagtgacataccttccttgtgctgcctctgagaactatattaacatatatgacttaaagatgtcgctagcatagtaaatagttatagctattattagcagtatttagatggctgaaagaagaaagtaagtttattctgttccaaagatgaattaattaattaactaattaattaatttttaaaaaattgggccactgaaagctttatgggaagtctttcaaataaataaaagaagttgaagagtccaaggtactctgaactgtttgcttctccaaaggaactgggctcctgtaactaggggtctttaaagagagaatggatagtttcatgaagatactatcccaaggacttggaaaagatagtggttccctggatcctaccactccagagataaagagctccaaacctcagaggctgccctttccttagcatcatgatgggacacaaatagaaatgcctccatataagacagtggtcctcaacctgtggatcctgaccccatttggggttgaacgatcctctcgcagaggttgaccaagaccatcagaaaacacagatatttacaattcataacagtagcaagattgaagttaagaagtagtattgaaaataatttgatggttgagggtcaccagaacatgaggaactatatgaaagggtggcagagttaggaaagttgagaaccaatggtttaaaagatcatgtctatggttatggcttctcataggttcactccaaactaaaatcactgactgcaacacgatcatcatctttgaaattcttacaagagtcactctcctggcaaagttttgagtctagactagtaatgttaaataaaataatttgtcaggaaatacttacatacatgagtcctaatacagaaaagcaaattcactcctcagagcagccttaatccccacactgggctagtgtgaatcagagacatagggcatgaagcacatacattcagagtgagggctagaagaaaagggcagcaggtgagaaggagaaacatggaaccgagcaactgaaacagcacattgcctaggcggagttttgccttcatcgaagttcagtccaagtcaagaaaatgtattaagtcagggtgtggctttatgtcaatcacctgtgcttaagtcttagtgttcatacctccaaataaacacagagactcagtgcttaatttaggaagtaaactgggtggtgatgtgtcactgtgtttacctagggtgaagtcgaacacagcaataacctgaaaccaatcaagggagctaatgaaacagcatcctcagctgtgtagtagtttattacaaatgcgctctcaagttgtacccttttattcagaaaacagctgatctaacagccatgaaattaaagataagcagaagttggggggagccatttatgaaagtctctctgtagtcaaagttgactttgctaatcttggatccatacatcccttctttgctcttttgtgggtgtcttgtatagtcagtcatgtcagatagaaaacacatgcatccgttggttcatggattcaaacagggccttaaatttgcaacataaaactcttgtcctacccaaaattctattcaatgtataaaaggatttctagagtcaccaaagaatactgtacttaatccaagtaagtgcctttgccagtgataaaaacagcaatggttttacacacctatatattacagaagcacaaagctatagataaagttattcttatagacccgagctatactctaaaagtgtgatctgcacaacacagtaaatgattaagctcctaaataaattctgaagctatttaaatgtatatagtgcaggtacttctggaaacaatattgtacatgtgccaatgaggcatctagttcttataccctttgccctttctcctagagttatttgccactggcagtttggaaagtccatccatatttcaatattgaacatgaaagcaaaaaaaaaaaaatagagaaaaagaaagatagcatgggacaaagcagggttctttctcacttctcccatcaagagacaaaacagaggtcaaaataaaggcgtgggtggggcccagaaccagagctggagggaatttgaagtataggccttgctgttgccatggataccagggcaaacaacagggtatcttagaatttatctggaaactccaggtggaactttcttttaagatccaaacttagggcattttacttaaaaaaaaaaatctataaatgaatatgggctagcatatgtagttgcttagcaaatgtttgttgagtgagtatgtaaatgaatgttcaaaaatgcggacatgctttccaggagaacttaattcaaggaacttatacataaatgcatccttttctctgcacgacttttagatttctttcttttagaaaaagagctttagaatatattgtgcagtatctatattcccacttgtggcttttcaccaacaaatgatagttctttggcttttttctgaatcatatgatcaacagcccatccgttggtgaagtttttcagcccattgatatcctttgcacggaagataattctgcttgtttctttggaaactcagctttttcagccataaattcaatgggaaagagtaatggctgtggcatgtcagtgttagcagtaggctactaagagagacacaggacaatgctattaccatccacataggagttgaactgttaaacctctcacggtggtgaatatatgttcagaggaggaaggcctcagtttcacctctttgtaactaagtgactttaagtgctaggctgaagtggaatcacagtttttggaggtcttaataataagttaaccgaggactgaggaatagaaacagaagcatttgaccataaatgctataactatcattaacacctaggaatatatattacagaaaccccatgcattttccagcatgatccaggacctgttgatggtagcaggagagttagcaggcttgggagcttatcttactcttggctgccatttgttggggtcttgaaggaatcagcacaaaggaacaggagataccatttcctggagtgttaaaatccactccactcacaatgctgtaagaagtcagataataaagcaaactgttcccctaggtatttaaaattctgcttttcactgacatatctgagtcgtccatgagccacagccgtgttaatgtatatgtccccaggtggcagtccctcctagacagtcagcagggaataggcagaaaggtcatcacagcatgccatccatggcctcctgctccatgccctcttcacagacaccaagagtaactgtgcagccattggatcaactacattcctgctgttcataccaagccttttcctgttttctggtccagtcttcattttttcccactcagaaacctctctttcccttcctctgacttccttggtttttttgtttttttgtttttttaatactcaccaagcatcctgttttggttttggttttcttgacaccccacccctacccccaaccccccccctaccatgctcacccaaagaaaagggtaggtattaccctgccttggcatgtgtaactaagagtagaccacacgcgtcacctttgtttactagtgtcagtaaaacagcctgctttagggatcggctgaaacattggttttgctgctttgctttggcttctgtttaactcaggatctgctttccgatgcagtgtagtgatttctcagatggtttactttatcctcagttcctgcaggctggatacaacagtttagttttccttaaaatgaccaatactcagtgctaggtaccgtctcattaattttcaaaacaagttcacacatgtgtactttttgaaccattaccaagttctagataaggagaccaaggcttagaaagctttgataacatgtccaaatcactcagccaagaaatggaattcatagcggactccttccccagaacggatcactttaaagtgaaggggctccttgtgcccactgccctttatgttatggttcacaaatcctctttgcattttgtgacgcttcctaacaacccaaacttgtggacatgaccttaggctccaacccagaaagccatctgagaccgtttatcatcttaacctcagatttctccacctgcagagtgacagtctacagaccactcatttcatgaacagtgccccatttcctttaaggtttcctctaagtaatatgtaggggagtcagtggataggaaatgttatatgattcctgctgattgatgttgtttcaaatctttccatatacggccggcaagtgtgggcaaatgactgatatgaaaatagacccaggtcattcaggcagtccctgaaatgctcagcgccaccattccagaactgcagtaattatagagagcaccttcctctgaccagcgcctaggtgccttgtgcacactttgctcattaacaaccactccattttgctgtggtagggcagacagctgggtactttgtcctatttaaaagtgtgggactgcccaagcattgagtgattaagcaggttgccctcaggccatttgctggcaaggccaggactagagatctcaggggttgttgaccaccctgagatgaacaccagtaaatcccagagccatagcaagtgcttgatccaatttatcacttacagaaggcaaatcaaacccagagagatagaaacatttaagaagtccagggtcacacagataattactgacataactgtactacgtgcatacaaacaaccaacgcatatatgcgaccgagaagatgacaactgtgaagaatcgatttgtggtgggattagaagggtgtgaaagcaaagagccttgattggtgaccttgcctggaggaaaagcagtcagaaggtgaacgttcaaacagcaagagcatttaacagtttcaccttcctaacaggccaaaatactgtctgcagtttaaggcacgcatgcttcccatgaaagatgacagtgggcatgttttaagagatagttggccagcctctcgtagccactgtaaattatactgaggacacaaggacagcaaagaccagctgagctgcaagcatgtttacagctgatggcagtgcctcaactaaaaataacatacatgcttgtctccaagggaatctctcatttacagaaactttacaaatgtaaacactgtgtataggccgagctctttagcaataagccttccccagattctcctttttcaatctaaaaattaaactctcttttagccctaggatcctgcacttcatacttccccataagaatgctttcattcaagatcccttatgttagaaataccaagaaaattgtctaattagagagagttccatacgatgaaacataaatatgaggcattcgatccagaatctggcatagtaaacattcagtgtgtgggtgttcgttttcttgctatgatacatgatacagcagcgtcttcagaatggaaaaatgagagccacagtcaaggcccttagttaaatggaagttgactcaagtttaaggagtagatcccttggcctgctacacattctctgatagggtctcgggcttggggctttaggcaccctgaggcagatgtctactttggcctgtcagtaatgagatggaagaggtagagcatacactttagagaggttttgtcatctgtcaaaatcagaaaagagcaagtgttgagaatcaatattaataatttaaaaaagcaagtcttttaaacaattatccaaagtgatgtcccagacccatgtacttttaggggtccccatgtcgccatccactgactagtcttaccttactatttttaactagctagatgatttggtttcagagccaatggcagacaaagcaataaacacacaagaaaaaagggccgtgccagctggctaagaaaaaaaaaaaaacagaaaaaactattttagaaattaacctaaaagttcaaaaagcatatggaaccgtttaatggggggaggatgtagccttgtaataagaatgccatgcaaatattcccacaccgcccttggtggtctacaaagtgattccatgtgtatttcatgtcaacaccatcacagggaggtaagcaggacggtgtacctcagaggttcttggtgatttgttatgatggcgcacagggtgttggtgtctatgcttgaacaaggctcaagatgcaatggttgtccaccatccattcagctgtcacagccagcaaggtcaacctgcaggacagtgcaatcaacacagaatagccagttcattctcaggaaaacttctatcagcaataatgtgtgcatttattaggccgagtagtggaaatggagactttctgaaaagaatcaacttataaagccaatattctcacttcacaatgattatagcaagcccttccctatagcaaaagctatatatttagctcttatatttgtttgataatattacctggaaatgtgtatatcttcaataatggtcctgaggatggcgcctacaaagcaccttcttgggttttcttccaaatgacctttgaagagttgggtggatccgtgttcatacttaacacgagagcagtttctggtcatggggaaatggaaagctctagactctcctggctttcttaaaacaagcttgctctgaaaaggaggccagagaggcctagatctttccaatcaaggatgatccataaagcaatcaatttttactttttttttttttaactttttgtttttctttgctgttgtcttgttttcctgtctctcattctcccactctggctgtgtcttgttctgtcctgcttgctgtctcctcccgcctcaccaggtgagaagccccaccagtgcagcatctgctggcgctccttctccttgaaggattaccttatcaagcacatggtgacgcacaccggcgtgagagcgtaccagtgtagcatctgcaacaagcgcttcacccagaagagttccctcaacgtgcacatgcgcctgcaccgcggggagaagtcctatgagtgctacatctgcaaaaagaagttctcccacaagaccctgctggagcgacacgtggccctgcacagtgccagcaacgggacccctccggcaggcacgcccccaggtgcccgcgcgggtccgccaggcgtggtggcctgcacagaggggaccacttacgtctgctccgtctgcccagcaaagtttgaccaaatcgagcagttcaacgaccacatgaggatgcatgtgtctgacggataagtagtacctttctctctttcttacgaaccaaacaaaacgacaacaaaagaaataaacaagcaaacaaacagacaaaaagctatggcactagaatttaagaaatgttttggtttcctttttactttctgtttttgtttctgttccgtttcattttgtactacatgaagaactgttttttgcctgctggtacattacatttccgggggcttgggtggataatacttttcccagtcccccttggatggtggccttaaggcctggtagtgcttcaggaggtccactggttggatctctagctactggcctctaaatacaacccttctttacaaaaacaaaaaacaaacaaacaaaaaaaaagacaaaaacaaaaacaaaacaaaaaaagcaaaaaaaccacacacatacacacacacacaaaaaaaaagaaacaaaaaaatcttttaaaaaagttttaaaaaaatgtttaaaaaaaaaagaaaaattgtttttccactcgtgaagagcactacagagtttcttaggagctgtaaggcctgctgtctttaaatacaccgctcacagtgtttcagagaacagttcactcttctggccacttggacttcacagtaagcagtttaaactgtggaatatcacttctggttgaaaacccagaggaatggccctgctgtttccacctaccatgctgtctgatgtcattaaagggctctgggatgggaggggtcggtgagcccagtggtgtcaacaaaggcggggtggcaggcttctcccccaggtctgcctggtccacacaccctggcccacctcctccacatcccgcccctttcagcagaagccaggaagactcggacaagcaacagtggctatcgtatttattcagtgtcttggctgagccacagcctcagcacaatcaagagggactttcatgaaaggcaggaatgcagagaaaaacaaagattacagatttgcacctatgtttctaggtacaagagaaggattatttccaacaatctttgcaaaaaaaaaaaaagtgtcaggatatattcttgtggaagagaaaaagaaagagaaatggagggtggggggaacagtaaaagttcttgaggcttttttaattcaaaaatttatagaggggcaaaagtgatgtttaccagatagaatgctgatttttttaatatatttacaacagtatttgtgtaaaaaaaacaaaaaagtgagattgttaaaagtgatttttttctccttttggttccgcatacactgccgtcgttccctttactttgtctcacacatatatatattttttggtaagtcaagactgttaaggttagcgatactgcttccagatagaaagaatagaaggcaactaaagttatatttgaaagagaggaaggatattttcttcatattttttttcttaatttttattattttaaagtattgcctgggttgctaagggcctccgaggcccgcccaccctgctgtaatttcaactgctgctctgttttcgatgcatagatctttgacttctagcaggcttcagtggagcgagccactgaacagttatcacctatctatctagaattctgtcctttatcatgggaggggtgtgctcttttacaagcagatttcttccttctccaaaatttcactgagctcttaggattctagagttccatgagccttgctttgtttcctctggtgaaacactagtggtccagacaccttgacacaggggtctgtttccttcatggtcctcactcctctcccctgcctgctcaccctctcagagcactgtgtgggcgtcactctgagaagcctgttacaaaccacagtgcattgatgccaaaactcctcccttcctttcacggcctctgactgcccaccatagctcacagggctgagttaggatggtcattctttagttgattgttgactcttgcttttttggaggaattaacagtttctctgtgctaacatccaactttcaaaaggccatgaatctccagcatcatcctggatgctgctctttctagttgggatttctctctttggtgttgatcaagaaatcataagattttccaattatatacagagtcctgaaggggttccagcttaaaaaaaaaacgggacttttaaaacctagataatactcactaagtaattttatgactggccatgttttagcacacttaaaaggaaaagtaactattccaataacacagaaacacaaaactacatttttttttaaaaaggagattttctttttaaattgctctacattttaaatcagttttcttcctaattttcctgttagcattttatttacaaaaaaaaaaaatgcagcaaatgagggaaaattttccaaggcaagcaactctataatgactaaattggttttattcatatattttagacaattggttaacttgaatcttttccataagttctttgtgatgtttagtagtttgtgcaactggagtatttgtggcgttgaagttggtcttatggtgcttaattcagtggattttttgctagaagttgtagtgtggctttggatgggtaacttactactgagtatcacttatcgtgatttctaagaaggggacacccaaaaaacttgtgtgacctgttttaaaaattagcttcagaaatgcaaaagttctccctattacccccccccctgctgttttgctgttgttaatattggaagtcaggcgtgacctgatgttcctgtaccaccgagagagggagcattaggtcacaaggtcatggaatcatttggaaatatgagttgttcaacccatcaaggaggaaaaaaaaaaaaaaactgatgctgtgatattcttttcttaatctggagggaaaaaagacatgaaatcactcaccatataaagcaagggaaagaaagcagaggcccagcgtcaggcatcctcactgttgacgggagcacattgaaagatgtgtttccagtcagagctcagtaaagtagccagcactcagactgatcctgggaacacttaaccttgcgtgccattcggtcccattcccatctgctcactacacctgaaagaatcccgtttgtcttcatgctaatgtgccattgtcaaaaagctaagcaactgggttaaagatccaacatttgttgtagagcatgggaaagaaaagaaaagaaaagaaaagaaaagaaaagaaaagaaaagaaaagaaaaggacaccagatgacttgaaactctgagacacattcttttcctataaagggaatatcttcttttaaaacgtgtgaggagatccctgaggaattcttggtcaggtcctacctactgtacaggctcagtcctactgtacaggctcagtcctgctgttttaccccaaacatctcccaacctaaaatactgctttctagaactgaaggacactccgttggcatcagaactctaaaggaaagtcgcttctatagtgctggtgctgtatacctggcctctcgagggctgttttccaactgcactgcattgtagaagataagccagtctgcacctacttcaaaaggttacagatgcttccaggattgcccatgcacactcgatatttaacaatcacaaataagagaagatgagaaagagtgccgctttttttttgtttgtttgttttgttttctgtcctgccgtttttatgatgggatgctatcagttcttttaaaactagaaaacaaacaaacaaaaaaggtcattttagtattcaggaacacttgcgcaagtgtgcatgcacacatgtgcacacgctcacacacgatggaagcagatgttccaggcagaagacctcttgagaagtttagggaacaagagctggcattcaaaagaatactagtatatatttttttaatcaatctacaatttaaacaagaaatttgttaaatacaaaaacaaaatagtaccagcatttgtacaaaaaaagagcccctaattgtgtaaaacatatcccccaaaagacaataattagaactggaggatatgattcagctctacagtaaaaaacaaaaacaaccaagccccacccccacactcacacctagtaatcctaaaggaaaatctttatagaagtttttcacggtgtgaacttaccctcctgcagcctctcccatcgcaggtctttcgccctcaggagggagggtggcaggtaatcctggctcatgccccagaagctcccatcccctctcccctatctaggaggccacagtcactgttggctttagaaagacttgggcttgccttctttctctgtaagtaagagacactttattatatatcataatatcatgtaaggaccaagaaaactcttttcaatccatgagcagggagaggctgtgtgtctgagacgggagagcaagagttttctctgggcgtgcctgtttcatatcactctccctgtcaggatctatgtgtgcttccatctcacacaccatctactaccatcatacggcctgcttatgccccaaagcactgttttctttcagcagtagaagttaaaccagaaatgtgtgcctcatcaaagccctcaggtccccgggaaaatacaggaaagttccctgttgcagtcctccaagatacgcccaacactgttgtcctgaggaatgatggcagggaagtctccctggcaaggatgcatagcagacaatgcccttgctgagccttcccctgaagttgcagtgggagttggtttgattagttagggctagccatgtgaggtgtgtggtgctaacatcacgtcaggccgatgctgccctgaccagtgtgcagctgcagctaagggaacaaaaaggtgtagcccaggagcagacaggagatgccctgggaggaaagagaacacagggtaggtgccctttctgctgtgacttgactcttaaaagaaaaccctctaaaaagaattctttaatttagtaatgagttgaagtccagggtaatggaagctctagggaagagaacaaaagaattgcaaaatgtattcagtacccaacaataccaaaccagaaaacatccaatcacaaagctaggaagtttggcaagaggtacttagggaaacctccagtcttttccatgggtagggtccgcagactttcttttgagtgatttctggctcagagaaacctctttactcactagaaaagaactttgtttaaatggccaattttgtcccccaggaggggagaaagaattaaaaaaaaaaaaaaaaagacagaaaagaaaaataggacactaaagacggaaccatgtgagttggtgacaaacaaaagaaaggggacactagaatttcaatagactccctattggatagatttttttttaaaaaagcaaagctacccaagggccccccagctccagactcccagtcttgagctgacccagctgctggctttctagggctggacataacttcccaactgggaccctggcaactttcattctgtgttttcataaggaaaagggactgttctcttaagtgccctggaaataggtagtggcatggggcaaactttcaaaacccacctctgctctagtgctcaggatgccccaggagctcgtgaaaatacttaaatattcccaagggctttgtgtgcggagttatcatttccagtgcaccttaaacatccacctgagctgactgcgtttctgtaaaactgcacaattactaacccgaagcatcatcgtttctagccctgagtagcaagatgatcaacccaagcaaactagcccacggggtactttaagtttctcaagatgcttctctgcttgaacactgaatccacagcaggaagagatgtgcattatccagtgctcagagtgcccttggggctgtagagctaggctccattctctctaaggtgaacaagcaaaatggaggcttgcagggcatacgatttttttcaaaactgtatgtctcctcctcatgaaaggaagactagaaaaggcccaggactggagcaagagtcttaatttatgacttactgatagctgccctttccccagagtttctttagggcccaactatgctccactgactactggcataaccccagctaagaaactttcacaaaaaaatccattgggttgtaggattattgccttaagttagaaaccctggaggaaagcagacaacacacacacacagaaaatgaaagactgtgaagatagatagggacatttcttggtttgtaatggattcataatcacaaaaataagctctattcatgactgaggactatggaatcagtgacttcctgggaggcaccaaacttgtaggggaaccagctgctttcaggaagcagctatttcctgtctgctcctttctttggtaggtcgaggctgactgtaaaataaccgtgttgctaagtagcaagtcctgttaaacataagcacaggtgcctggatggctcttaaatgtctccttaacagggagcccaaatctcaaaatacagctttctctctctacagagatcgtatcaatacagactgctctctgtcccacctcggttttgaggtgcattgggtttgtcttgtgaacttttgtttaaatacaaaatcaaaacttttacatctttaattgagacacataatctgcagatcatagacaaagtctagccctagtcatgaaatcctagcttcagcagtgcctgaaaacagtccaagtctctccttggatctctttcagactgagaagtttcttgattcagagtgcttacatgatcctggtagtcctaaggcacagagaaaaagaaccccacagaagacatctgcttctactgctgttgcgacagttgttatagcccaaagcataactgtcatttgcacacagatgctaataacaaaagtggcttaacccatccagtttgtcacagctgctgtccagaatgtctgtctgtgagtgtaccttatccgtgtgcacacatggtgtgaggtgcttgtaccacaaaacttcattcatattctccagtgacagcagcagacacttgagaatttccagctcgagtcaaaggcctgacaccatgcatagccctgctctctgcttcgtcgctgtctgtgaggaggctttacagcattcagaagtagcccaaccatcagtagtttgtgtatagccccgtgaggaaaaacttgaacaaatgctacacttctgtggatttactggtgaatgtgtgtgtgtgtgtgtgtgtgtgtgtgtgtgtgtgtgcgcgcgcgcgcgcatgacctgcatctttgtatgtttatgtatatttatgttgtctgagtgtgtgtgtatctctcaaatgaagcacacacggttcctggtgcgtagatacagttgcctcttctaccagtgtgctcagactcatggctttcttcccaggaagcagtcacctgcccactctgttgctttttgtagcatttcagagttgggagaaacaaaggcagcttgttggctccacagcaaacccacagggacaggctgtttttctccagaagagggtggagtacacacactcaaccagaagcagaccagagggagccatccaggcaacctcacaggactcccagagaggacctagccaggcaggtgacacacaaacatcccaggattaagtcggagctcaaagactattcctgtcctctctggaaccttcgaggctttagagaagggacaaggtctacagatcatagataagtctagccccaggcatggagacccagctcccagccagtgcgcacactcacacacaggaaccacgtgggagtcctactcccaaactgaagttccctgatgctgcctgcacctctggaacatcactaccattcacaagctgtgtctcctgaaaccagtgtggccttcacccaagtctttctaggaatgggtggcttaccatgtctagcaaaccaatagaatatcagggagtatcttgcgggcagtctataagaatcagtggctcttgcccatgtcagacattaaagtagaatgctactctagcgtaatatactgaatgactggacttagctttcataggtaactcttgatggcttggtgacctggaaacagtttgatttcgttttctcattcgcatgcctctcttttactaaacagtctcttccttccctccttcccacgtcccttccttcccttgtccctttcttccttccttccaatatatagattatttctgccttacagaattcagaggacttttcattcctcttgtgtttttgcgacatttttccttcccccatgcagtaaggctacttaccattgcaactattttttttgtttattatttttaaaatgtatattgtctttctgtatccaaaagaagtctgtgaccatagccacaggaatttctttttactggaaaaaagttcatttcttgtttttttgtttttcttgttttaattaacagtactagtgactttgtggaagactatggttactatttaggtatgcttacttacatacaatacactacattgcagtgtttctgaaacctagaacatacggattatatataacagctctatattgacgtatattacattatattcattttaactttgaatctgccatatgatcatcagttgattgaaatattatttcttcacatatatcacccatcaccacctgctgcagttaatctggtgcatttaatgctcctatttgccttttatattatcagcttcagtattgtctttataacattttagaactttttttttaaagctcagacatagcacacgtagtaaagtggaaactgcttaaacttttttaaaagttatttttctgtggctaataccaagaagttcatattgcacgtgatcgtgtttagctggccctattaacatctgaagaacaatggaagtgcatatgaacatatctgtgatcttcctgtataggactgccatcatctgtatttgcttcagaagagtataaccaaggagctgcatgtccaccacatgatctgaccaactgtaataagctgcatttccaaagggctgctttggtgagacacaaagacaggaacatgccttccatcctgtcccaactgtatcttcaaacattggctctcagtattgatcatacagggtctgctctctctcttcaccgtgcttgttttcattagtcttcagcatttccctggaggcatcttggcaataatacactgttgattttccctaagagatttattttaaagtaaaaccacatttctaggaactttttattgacagaactcgaaaacatatatgacattctcagccttcggaatctgtaagtaggtgacacttggttacctggccctcggcatctctacttgctttcttctttagttaggccaccatggagcactcagagctcagacagcccatcttctaacaaaaacacttgcaggcggttttcaaaggagctttcttcagctgtcccagctctcccactgcaagcctggaagtcagaatcaagctagccgaacctggtctcattgtccacattttatgttccggaccaagtgacgacagctttgataaaactcagtaggaaccctccccacaatggaccaatatttaggcttttcggtgtgaacataccactctctccttcaatcttcccttgtcaatcattatcttcaagtctcatcacgttctgctgtgcctatccagtgtgtctcttgcccccaacgcatccaaactcttctcagcatcctccacttgtaaagcttgacattcattaaggaactttccattcctagtctcctttgatgatgctaaaccagagtctactaggaaactacttatgtagcatctattctcaatgaaagacgtggcagagggaaagcgtgagtgtgagcttcgtggtagtgaggctggccctttggtgatcgcaggcacgaggtagatggtcccaactccattgttcttgctttctctttcttaccaaaaattttctcatttcttatttccttttaaagacaactacgtgctacccaatcatctcttcacttccccacccctgaaaatcttacattatgacccctaactgttcgtgaatttctcctaccactcttcttagcatctttctttaaacgagttcataaacttgagacttgtaggcagaatgaagcatgtcttcctttccgctgcagattttaaaggttgtcagcatctgagagtaggaggacctgagtcagagttttaaatgtcaactgtactagttgagatcattaattcctctcacctttacattaaaccaaagataagtatttttcttttctttccttttttaataccacagttttcaaattcttggtatgagtagacgatttctgagggaggaaaaaaaaa

SEQ ID NO: 788 - DNA, 2928 bp, Mus musculus
cagagagctgatcctggggggctggagcctttcagcaatcatacaagatgcagccactctctgtcccctgccccaatgaacatctgcactaggcccaagccttggagtgatttacctgaagagtgacaccaattatctggaaactactaaagtataattgagaggaacagggtgaaggaaatgcaaatgcgaaagggaagcagtagatgaggaaactgaagcccagagaagtgaagtgaggtgcccaaagccacacagcaagttgcaggcacagctagttccgtagctcaagtctcctgactcccagtccagtgttcttcccattactccacgggtcctgtctctaagcttcctgacaaatgctagaacggaagaaacccaagacagctgaaaaccagaaggcatctgaggagaatgagattactcagccgggcggatccagcgccaagccggcccttccctgcctgaactttgaagctgttttgtctccagccccagccctcatccactcgacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtgacggttcgcatccacgggagcatgctgcgcgcacatcgctgcgtgctggcagccggcagccccttcttccaagacaagctgctgctgggctacagcgacatcgaaatcccgtcggtggtgtccgtacaatcggtgcaaaagctcattgacttcatgtacagcggtgtgctgagagtctcacagtcggaagctctgcagatcctcacagccgccagcatcctgcagatcaaaacagtcatagatgagtgcactcgcatcgtgtcacagaacgtgggcgatgtgttcccaggcatccaggattctggccaggacacaccaagaggcacaccagagtcaggcacatctggccagagcagtgacacggaatcaggctacctgcagagccacccacagcatagtgtggaccgaatctactccgcactctacgcctgctccatgcagaatggcagcggcgagcgctccttctacagtggtgcagtggtcagccaccacgaaacagctctcggcctgccccgtgaccaccacatggaagaccctagctggatcacacgcattcatgagcgctcccagcaaatggagcgctacctgtccaccacccctgagaccacgcactgccgcaagcagccccggcctgtgcgtatccagaccctggtgggtaacatccacatcaagcaggaaatggaagatgactatgactactatgggcagcaaagggtgcagatcctagaacgcaatgaatccgaggagtgcacagaagacactgaccaagcagagggcactgagagcgagcccaaaggtgaaagctttgattctggggtcagctcctccatcggcaccgaacctgactcagtggagcaacagtttggggcagcagccccaagggacggtcaggcagaacccgcccaacctgagcaggcagcagaagccccagctgagagcagtgcccagccaaaccagctagaaccaggtgcctcctctcctgagagaagcaacgagtcagagatggacaacacagtcatcactgtcagtaacagctccgataagggtgtcctacagcagccttcagtcaacacatccatcgggcagccattgccaagtacccagctctatttacgccagacagaaaccctcaccagcaacctgaggatgcctctgaccttgaccagcaacacacaggtcattggcaccgctggcaacacctatctgccagccctcttcactacccaacccgcgggcagtggccccaagccttttctcttcagcctgccgcagcccctgacaggccagcagacccagtttgtgacagtgtcccagcccggcctgtccacctttactgcacagctgccagcgccacagcccctggcctcatctgcaggccacagcacagccagtgggcaaggcgacaaaaagccttatgagtgcactctctgcaacaagactttcacagccaaacagaactacgtcaagcacatgttcgtacatacaggtgagaagccccaccagtgcagcatctgctggcgctccttctccttgaaggattaccttatcaagcacatggtgacgcacaccggcgtgagagcgtaccagtgtagcatctgcaacaagcgcttcacccagaagagttccctcaacgtgcacatgcgcctgcaccgcggggagaagtcctatgagtgctacatctgcaaaaagaagttctcccacaagaccctgctggagcgacacgtggccctgcacagtgccagcaacgggacccctccggcaggcacgcccccaggtgcccgcgcgggtccgccaggcgtggtggcctgcacagaggggaccacttacgtctgctccgtctgcccagcaaagtttgaccaaatcgagcagttcaacgaccacatgaggatgcatgtgtctgacggataagtagtacctttctctctttcttacgaaccaaacaaaacgacaacaaaagaaataaacaagcaaacaaacagacaaaaagctatggcactagaatttaagaaatgttttggtttcctttttactttctgtttttgtttctgttccgtttcattttgtactacatgaagaactgttttttgcctgctggtacattacatttccgggggcttgggtggataatacttttcccagtcccccttggatggtggccttaaggcctggtagtgcttcaggaggtccactggttggatctctagctactggcctctaaatacaacccttctttacaaaaacaaaaaacaaa

SEQ ID NO: 789 - protein, 742 aa, Mus musculus
QMLERKKPKTAENQKASEENEITQPGGSSAKPALPCLNFEAVLSPAPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGAAAPRDGQAEPAQPEQAAEAPAESSAQPNQLEPGASSPERSNESEMDNTVITVSNSSDKGVLQQPSVNTSIGQPLPSTQLYLRQTETLTSNLRMPLTLTSNTQVIGTAGNTYLPALFTTQPAGSGPKPFLFSLPQPLTGQQTQFVTVSQPGLSTFTAQLPAPQPLASSAGHSTASGQGDKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 790 - DNA, 181684 bp, Homo sapiens
  misc_feature (1)...(181684): n = A,T,C or G
gtgagtactttgggcttcattggtcagagatgaatggacttcccttgaagtgtcggctcaggccactgtcatatactgaaaatgaatctatggtttgagaaggacctggcaaatctggtacttttaaaaatttacctctgctgacactttttaaaatcatgtctttctcaattaggatactagccttatttttgaggtctcatcttggaaacaacataatttcttccccaaagtatgggtgaatactttatattttcgtaattgtgtttcacggtatttcacagactgctgcgggttccctgcctgctgagattcgttcagctgtggtttggcctgaagggttcccactaggttgtttacaatctaatccttgaagtgggaggttaaggagcagatagaaaacatcctcgatccctggatcattaataggtgaatacaagaattcagatatttacaaggaaatctcacaggccaggatttctagggcagaaagatattgtgagaggctcctggagcatatgctgacaaggagccaggaaccaatggagattatccatgaggaaaacactgacaaatatgttaataaaatttcagtgcaaaccatttggggtttcttatgtttctgcctaaattactctgactttagtagtaacagcacttcatggagtatacagagagtcaccaaatgtttatgacttttgagaagaagaatatgtgtgtgtgcacgtatgatgtgtgcatttataggtatatatctttatttgaagtaaaactataagcacaattggcttcttgaggtggggaagcaaatgaccccttttagcagtatacttggaaaactcgaagcatctaggacggaatttgccaccaccaccaccaccaccaccaccaccacacacacacacactccccaaatactttgcttattacctgtgaaaaaaactgaatgtagatcttgtatcaacagttaagaaaatgcaaattcccctaagtagaggcattaaaacaattaaatgaatatatttttagcaaactgagagcaagttgtggttggggagatggagagctcactaagagtatccccaaagaagcagtctcagccgcatttgtttctgtttctttaactgcctggtgataggaatgtggatgtggaaataagtaggactagaaggtgggggaagcagaaagtaagttttgctaattctaacaacctatgttatcagcttattgtgccacagcttttcaaaattcaagttgctggttaacttgacacctttactgttccattcattatgaagcagcataagcaatggctacatgcaccaaccattatcctagttaggttgtcaaagttagcttaatgctgactttattttctgtagtgatactaaacaaaacgtttcttttgaaaggtcttagacctctatcctcccaactcctgatcacagtaataaccaacctcaagaagtcattagtgaagactagaacaatatcctataactagtcagctatgaagaaattggcatagctgactctttgattcatgttcttatggaaataatgggttgcaaaataaaactacatttctttctctctctctcttgaattcatttttttactggatcttctctacaagttacattggaatgcagattttgtttttgtttttgttaacaagattcgaataacactcaaaggctttaaaagccaaagtccatctttagatatagctttcttctttaatctactgccagtttcttatgtatgtgtatttttaccttcctgatgccttcgcctgttgattggtacatgttagtgctttgcttataagagttgggcaatagttcagtgatccagtccaaatctgggccatagatagaatggactcatcttctatttaagaaaagtggcaaactgctttaaatgaatttggttcagacaaggtcattggagctgttcatctaaccctgtgctgtatgtaatggacacttctgctgagctccaaagctaaaaggtaaatagacaaagaaagccagtaacttgccacccctgttagaccttatctgtgagtctgttattagatttacattcttaatcatatggggcacattttggtcatttaaaggaattgtttagtggttctcctgttgtctttgaagatggtccaggaaataataatagtgagttcatatattactttctggaccttcaaaaaactttttctttaattggaaattgagtttatatacatattcaatatgaggtttatgaaatattcagcaaatttcttagacatgaaagaattaattgttagactgttttactctagataatcgctatgttaaagccttagtagattcaagtacatttttcccaattttatttgtgttatatgcacttggcaaattgaataaaaaacgtgagcaccatatattactattttgaatgtaataacttatcaactatctgtattgcttatttctttttaaactgtagaatgtattttactcaactgtattgtgattctgtataatttttagggtgaacattttatagaattttatagaatcatacagagttaaacaagactagaaaagttattgaattcattctcctgactggaggcagagctgcatttattttatccaaaatagatgaagatttttcctattttaagagagtcaggaagaaagaaatttcagaactgctcttagcaatctatttgattatttaccacttgcatatttagaatgttcatctttaagtcttaaattctgcactggacggtttaatgtcattttgccctaggacaaaaatgctgatcattatcctctttgtaacaacttttcttatagtcaaaaaaccataaagacacacctcagctctttcttccctaagctaaattatctcagtttttcaaacatttgcttttgtttctatagctctttctatacctgagtggcaaaggggactatttttaaaagctctgtcatatgtgatgcctcttagagaggcactgcatattttaatttcactgtgctgatgtggaaatagccacaactttttcattatatgctgatggacagggcatttgtgttcatttaaccttgaggtttaaacttgttcccgaaaaagtaactgactcatagcattggctagacccaagaataaagagcatcagttttcctaatcttcaagctcatcttgcccccactcctaaaatgcactaaaattaacttttccttgacctctctctggtgctatttatttactgatttaacaactttcttctgtcatctctgtctcctaaaatagacggacagcatttattcaacaaacattggagtgtcgtgctgtgtttcacacactatgctaggcttgggagattcaagtgtgaaccgttagctgactcagagacatagatgtcccaggccatgttcagggaagagcaaataggctgtcaccgtatataaagaagcagcagtgggaaaattttttattaaaagtagagaggtgggccggggccagattgtgaaaggtcttggaggctcttaagcaaatagttggtagtgacaagtctaaatgattagaccacatgatagcagtgccaaaccttttcagcatcccttaagatcagtttactataagtcaaaggtcctggtacatcaatccctttggaatttatagagctacaatttcagtagtttaagatatagaagagaaagttctttggaatcagattgtaaaggattcctgaatgtcatcatgctaaggaattgtgtctagtttagcagcaataaaaaaccatcctaaatgtattaaacaaattcggtccttgccacccctcccagcactactgctttcatttcattctagtctgtcagaccctatccccgtaagaatcaagaaggaacagggagattcatatggggtgggatggagtgttacattgtatcttggcaatgtctcaggcgcagaagcagtcccagacctaattgctgaactttaaaatcttctctctttattgattataaccttatttcatcatcaaaattttgaaggcaggccattttttaggattgttatcatagcatcttaagaaaaaaagatctcagtatcattctcttattgttcttcttgagacggatccaaaataatatgcgttttggaaagcagaccccaagatatgtatgaccatttgtggcatttatagtcttcttcttcctgaccaaaaggaatgaaaatacatcaagaatctgtcctgcaggaaaccccaaagtacctagagagtgatggcacaggttctgtatgcacatataaatacccttgcatctggctttctcctgtaaaccttttgccaaatagaaaatagagaattaaaaactcccaaattcaagatgcatgaaatgtcattaaatctagtacaaatttttttgaatctgtcagataaaggaaatcatgtatccagagtaaagatggaatatcagttgacaggcacttaattttgagagacatataaatctaaaaatctaatagtgcctcatcctttgaaaacactggaaaccagaaaggtattaggaaaatcaataaggtaaaaatcatcatcctactatttggaatgactcccacataagaattaattaacgcaatacttctagaacgttaaagggatgttaaaacattatctctaccgatagaaaacaaacatataaacccatctaacttttagacagagtagttaaggaaaaaagattggaaatattaattaagattggaaataagaggtcatttctgtcctgttgtcacaccatttaccctcttcagctagaaggataagtgtcaaacttcagttcatccaaattcctcagctctgtcatcagtgcagtgacacattctaattttctgactcatttgtgatgaataatctctcccttttctattcacaatgctgaaagtaaccaattttggtgtgagttatgattacttattttccctttttttcaattgcactattattgttttctcttagcagaatttgtctcactctttatcacccagtgtgaatctcatgttcagaaaagcccatggacagtaatagtgcctaggcttggagttagtcaagaggaatgagagtctgacgacccagattctgtttttaacccagccagatacctcagctggcaagtggttcagcttcctcaccataaaatgggtataataatagctttcgcttaccactgtgaaatatttagaatgcaaatcaagccaaacctgtctgcttccaaagagaagcttaaactagcctgcgtaatcctgaatgagcccagattcaaggggaaacataaagtgggaaactcctaaaggtagtgtaatttagtggttaaaaatatgtagattttggaatggcacacacttattcagacgccagcagcggtatgatctgagctgtttcctaatttctcaaatttctcttttttctctagtaaattggaagtaacagtattttctcttgtagtggggattaaatgatacactgctaaccatgcttctcaaactcttccacttgggtgatcctcaagttagagtgagtgatccaatactaagggtgcctgccaggacattgcttgaagtagtctgccacaaacaagacttttcagtgaagtctcaggtttcacccaaaaaatatatacacagattttcctttcagctcctcaatatattcttgtttgtttcactcaaccggaagttccatgaggacaagaacagtatctgttttctttttggtataacattgaagaagtagttattggataaatgaacacgtgtgcaaataagactttaaattacttgcccacaaggaatactgaccctccaggaagacagccatgtatttactatttattttgtggctttttctactcccgttacactgctcacattcctgggtatactcatatccaaatttgggaaggatttatttctcaaggtacctgaaggactcagtagatagtgattcttatatcattatcatctctctgctcggtactcctctactccattgttgctaaggctttgtagatttttttaaaaaagaaattataaaggactaggaaggtaggagtctggcaggccttcaaagaagcctgtgtggctctaaccacatacccttacccacttagaactcttttttatacattttctttgctgctggctttagtttatagcatttcatgaaaactctgtagaggtgagtagctatgggattgaaagagggtttttctcccctgtctgcctaggccaggggttcctaacctgggattcatgaatggccttcatggagtctaggagttccttgaaacttggtgtttttgaggagttttctggagaaagagattctcatagggatcggtatcacttcaaaatgttgaaaaccactgctgtagaactttacataaactacactagaattgactttaaagttataattaataatatttttgattcttggagattgacactatataataatttccactcagacattataatacgaagattaaacttcacccctcgtcatccccctctctctgctcatcccccaccttccaccctgatattttaacgtcctgaattacttgggctttacagttttatactctttgctagatatatttatgctttgaacaaagtgtgcttaatgcaaatgtttttaatcctctgtgaaacttttatagataattctttgcatttcagataaaaacaacttatagacatataaggtgaatatcacttaggtggaaagagcatgtatcaatgaaataacaatttgaattgagcaaatataaatctatgtagattaatacatattctcagaattacatagcagattataattcagtcaagaagtaggtgtcttttgatgcctatgaacatttatgaattgtgtaagaactctgagattaaatttttagccatactattaagtttgggatcatattatcattttatattaacatataagtacaacaattatatccaataaaacttccatctaacttggctttaatttgttttagactgtgacatacacactgtaatttttctctccattttggattcctatcattgacagccatcctgtgtgtcatttgacatccaggaaagatagtttttcattccagacattggatgtgttagtcaatttgggtacaacttacattgatctcttttgatcacatcaaaaatttaattttaactaattttatgaataaatgcaccttgaaatttagaaaagaaagttatgtgtttagatataagaacataaacactaggtataattttagaagagcataatattgttgagagttattgggtttataacatgcaacagaaaaatgatcattgaacatatttcatagaaaattgctaataatattttcttcttctccccaaggttagagaagacagcaagttcaaaaaaggagagggaaagaaagaaagagaaatagagagagaggaatgtaagaaaggagggagggagggagggaaggaagaaaggagagagggagggaggaaaatggtaagaaaatatgcccctgtgccatagtctaatatcctggcttgcagagaagactagaatatagcaaaacttagagctttaaaatctttgaagactagtcagtgttatatatatatttcaaatttgtatgtgctttcaatgaatcatacataatctaattctcttgcctaaaattttcattaaactcatgaattttgtgaaacaatttgaaagcattggagatctccagcctctcttgtattagcattataataatccaggctggagattttcatcttaactcgtcttgtcaccatcctgcatcaagtacacctgcatgtacttgagcaaggtttcacattgaccacaaagggaaatcatttctttgaagaaatctctacaatagtgcagttgtcccagaaactttccaggaagggtgatgtctttaattgctggttttctgctttagccttttcaatgcaaagatacttaatcaggtccttctacttgatctcctttagtgaagtttgttttgcatatttctggaggccttatgtgaagttgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgggctcactgcaacctccgcctcccaggttcaagcaattctcctgcctcggcctcccaagtagctgggattacaggcgcccgccaccatgcctggctaatttttgtagttttagtagaaacagggttccaccattttggccaggctggtctcgaactcctgacctcaagtgatccacccaccttggcctcccaaagtgctgggatttacaggcgtgagccaccgcgcctagcctggcttgtaatttaaagagtgaaatatcagattttaaacatagaacaagaacactgttagggtcagcttctccaaaatctaaaattttcatcatttcatctgaaattttcatcaccaaacagagttgtgtttggtgggagagaagctttgtttaaaatcactttatcagattattttccaccatagaggggacattctaggctggtgagaaggggtagaggcagttttagaaggcaagtccggggcaaacttaggactgagttcttagctacacacgaatgtattgaatttgttcagaggaacttctggacattaaacatactaaatataccttaaaagagacaaagtttatcagggtttgactcatctttgtcaaaattagctaaaattggtcatgtactgtatagtaaagcttttacctattctagtcagtgctgcccaatagaagtttctacaataatagaaacattttctatctgtgctatccagtaaggcagtcaccagccacatgtgggtattgagcacttgaaatgaagctggcaagactgaggaactaaatgtttagctttttattaaatgttaaataatttaaatttaaatagacaaatgtggctagtggctattttgttaaatggtaacatagctctaccaaatcctatatgatacagattagaatgaaatgaacaaagaaaggtctttgcactccttgtgctgggaagtactgtcttggtcatcatagcagggggtcatacctttagaaagtttttatgaagctgggtctcctttattttgaggctagaagtgacaaaataggctcctttaggaacaaccagtcccatctatgcctagatttgctttctttcttcccactgtatcattttgcttttatatattggttttgcatcatatatcggtttgcttttaattccttattttttctttgattttcagatctttgaccatcagtctgtgacctgccccttctctttacgtaagtaaaagtgatttctttacctttaaaaaaaaaagtgtcagatttaggaaattgtggttttcactggcatatttcctagttgactttgttgtggtttctagtgcttctgtagtgtgtattagtttcttttgcgtttggagtgtatgctgttggtggtaatactaagttgctatccatgagggtgcagaaaataccagtggcccagatactgtacttctataaaggctgccctttacttggctgcagctgctgtttgcaaaagtcactgctcttttaaagtatagcttacattattcagccaaataccagcaacagttgggcttttgctcccctgtcaatcattgggcaattatgtattcttcagttatgtacccatccctaggtccaatagtttttaattttaacttctagatcagagctttcatttattgacaaaatttctaatatccctttactaagaagtacaagactgtaaaataaatagactaaacttttgtgcaaaattatgaagtctacaggggaaaaaaagaaatcccagattcacgtgtgccagaaggtttataaaggtaccactcttttttagaaaagatggaaaggtattcggggggaaaaaaaaacacgattttatatgaaaaaaaagagaacgttcattatttaaaattcaaaccaggctgcactgaatgggtttaaataaattttattttgaactgcttgaaaaagattctaggccaatgaacccaaataatcaaagtcacttataagagacaccacccaaaagatcctacaggtagtgatagtcacctaatgtgataaataattatcggtatcctctggctgcttctcactctctggtgagctctgttccttattcacaacattatatcttgcttcactgactcttcactccaaggtatttcttgtattataatcatttgcacagaatggaggttcccatggctattttgtttatgcgtgccttccactaacattcctagaagatagtggcaaatatatttagggaggcagaatcctccaaaggatgctaaggctaaagtgtaacgtgacagtttatttgacagagaaaggagattgattaaactccccaaagactggagctgtgtgtaatgcatttatacaacaggggtgggtcctacctgtccctgacaagtcttgttattctctatttcagtgttgatagagtgggtctgtaaatgctttggaggatgtcaatatgcatgcttatggttaccactttatatctgcacagccctcccctcagttacctagcactgcatatttctagtcctctgactggcaaatcatttttgttacagttcttttgtgtaaaaacagttcacataatagctctgtgttagacaaggcattaatcctcacatcaccgggatgagtcagcacagtgcactcctgcccgcacggctcagctattgtgacgtcagtgctatagggcgagcctcagacacaagcagtacaggggacctgtgtcaccaattaggaatcaagggggagacttttgagataaaaagtgtagttgaaaggctgtctctggctcataggaaaatgcaaatctgattctatgctacatcagccatcagttgcatagcttctagagatatcctattttttaaccacacataaggctgggggagtgacctataatgagcagataatccgttcatatacccatgaccttgtgccatccctgggccaggcttcatgtttgcttggcttgttccaaatcttgaagctgccctcatatcagcagggtgaccgggcttatgacagtcctactgtcctcaagtatcccatagacacagttgatggttgatggctccagagtggtgccccagaggctcgacaaaaggaaaagaaatgtccaatgtcccttgagaacagatcagaacattatctccccagtgctttgactccaagtgcctcttcaatggcctcctctaaacaggtacagaattctgcttgttcgatcttctcttagcagtgcatttagtccagtatcacaatctgtatttgacctggatttcaataggaactgaagagctctcagatgttcccccaagaatttcccattccattactgtttagcagaaacaaagaggaaccctccataatctgccatgctaccttgaagcaggtagcacagacttaccttatttgggaaacttggttcttataagttaggtctctatacaattcagattcagatttattctcaggacaatatctttcagtattgaatattaagtcttgaaaagggtgttaatttacagccttagtggcagtctctgttaaaaagaccttcctccatcacagaatttatccctcactcttactgtcaccccagccagtcaccagcccctgccatacccatcagaaagtgccttactgctgggatcttctgccttcattagattgctaatgggctcctactatgcttataaaagctaacactactacttggcttcgttttgattaattatcatgtacagctctttatttagttttcattcaacaaacatttatggaaagctagtcactgtgcttggttctggaaactccgggataaataagaaatgctttcttttgttagaaatctcagtctgataggggagatacataagtgaataaagactatagcatatgataggcactgaaatgcaggtatatacaagacgtagtaagaggaatgaaggaggagtgcccacttggatgtggtaaggtgaccaggctgggtcttaaagtcagaagagtaaattgcagtttaccaggtagatatgaaagagcagaaagaaaaggggatcataatcaagaaaaatgtaagagcatttacaaaatcaggaggcgttaagtagcagcgagattcagaggagtgaatagttcagtgtgattgaaacatggtggttgaaagagtagtatgagattgggctggaaagcaggcaggggaccttgcctgccatacggaggaccttgtatgccgtgcagaggagtttggacttgatcctgcaggctcaaggaggctttgaagaattgtaagcagatgtatgttttagaaagagcacttggtgaaagtggagaggctgactcagaatagggagaccaggtcaaaggtaaaagccaaaggcctgaactgtgcagtaggggtaggatggagggagaggctatttggtagtgttgaaatagacattaacctttgtgtaattccagcatatcttggcctattgcataatctttgccttctaggagaaaggctgaaacattgtgtggagtcaaatttcagaccaaaatacatccttatgggatcttcagcaaagacctcaatttgaatatgacctcactttgagctactgccccctggtcaccaggctcgcgtgcctcctactgcccatagtgggtgtgagggaggagcaggcagataaggagaagacattcccagtgtcctgcttgtctcttctttcacctgaaaatgaaacagtttctaaataatgcccccctaaagtcaatcaatgccccaatttcctatcattttctcattgctccctttttctaagcaaaatttccaaaccattgaactgaattgcaacttatgcacagccgggtgttgaaacaattcagtgtattcattccttctctctgaattagagttcaccataagtgtgcttttctcttgttcactttgggctgccaggacaatttaaaggaaattttcaacagcttatgtttcatgtactatgttctcttttgcaaatgggaggatatgcgtgggtgtgtttaagccttctctatattgctttctggagaaaggtttgggaagatgaacaagacgaggagtagggacctattgaaagcccaggtcccccagtgacctgagtgcagaacgtaggctggtgatcagatggtcaattatgtgtttgtcaaaacacagtgggctgcattccaggctgccagctttggaagcccagcttctgccaaccaaatgtcatctgggaacatgcaacactgggcactgtgaaggagtttgaaatagaccatgccacagccaacctactgccagtcttatagcaccaatatggcatgcacagccgggccccatgtttcagagctcaggaattcactgtactaaattcaagaggtcagatgggttcatgttttcaaagcctatgttctttgctttgaacactgtgacttgctcctcagcaatttccaagggatttttccagtcacatctctgtggaaaccactctttttgtgatggttataagatccttgtaaatgtcccagaggataggaaaaaaaaaaatcaacttgctctgacaatgactatgatttcgacagagggattccaactcttaggaaattacattaaaggtgcatagcttttaaaatatcaggaaccaccttggcaacttataaaaagcagaagggctttgcctattttataaagtgatttgcatatacctgcataaataatgtccccacctgtacttttatgcatttaggttgaataaattaaattttgtgatctttaaaatattcactgtctttcattgctcagacaccattttcaggacccttcctcctcatttcttttcctagtgataagagtggctatttttttttcaatcttttgactcattcagagaatcaaaacactctgaacaccaatcgactatagccaggaatattacctccctctggttgcatttctcttagcctttctacctatcagatggtgagttccatgtatttttaataagagaaataaagtattactaaggcgaaaacacagcacaagacagatttaagttctatttacatatatatgtaagagagagagagactgtgtgtgtgtgtgtgtgtgtgtgtatacacagacttgcactgatacacacctcagggacatgcccatagtaaccttttctttctttcaccactgcactgcgacaacctcttcaggaaccatccagctactaagccatttccgttgtaccttgggccttcaaatcaaagcctggtcagtaggccactctcccccacattcacgctttaagatattattaaaaacatgctatgtacaaagaataatttttattggatagttaaagcataaatataccataagtacatgaccctttcttgctcttaaggaatttaaaattgagttaggaaaaacagttatattgttgagcgttgtgtatgcacataagataataaatgactaagttccaaaaggaatgatacagtccaggaagtaccatagggtttcattcatgaaagagccttgcaggctagaaagtttcatgtaaaactgattcagctgagtcttgaaaactggctaaaatgtaaaaaagatgaagagaaacagaatcatattccaagcaaaatcatataccaaagtgttggaatcttcgagggggcccataaatagcatcacttttccccacttgaattctaaacctattgaaaaataagacaaaagaactgatagctagggaaccaaaatttttataaaggttggttgaagagcatagcttagtgtaaagaggaaatgggtttgctgactctcttcccttcagtcaaacctttcaaaagctctcttacaggaaaatgtggatctgcatatgagcaacactttccaggtcatcacctcccgatagtctcagtagaaaaggaaggacaaagaggttaaactcctgtgcttacaaatttggatagatcagttctacctacctgagaaatatagaccaagggctttcccaccaatgggatactttgcctccatggggaattataaggaatgagacaagaggaaagcagtgtttagaaaacatctggaaactaggagtagggaagaggcattcttacccacactgacatccatagactggaaaacaagaggaggaagtactgagtgagatgaaaatgggaaccagagccacatctggtctgagagcatatacctggggtaagaaccagtagtcctactggttatccaagatctaaactaagggccccttttcagagtctcaaaagttacaagaatcagaacctgggggaacaggcaagaaatgaagataatggacaaaagcctagttaggaaaaaaaatacaaaaactctagtttcttgttcaactaataataacaataagaaatacctattgagtgcttgccttgctttagatactggactaaatacttttcatggctatctgatttaaccttcaaaactaccctattaagtagatgctactataatcctaattgtgcagatcagaaaactgagatttaacatgtttgatttattttataagaacatctaataaatggtagagatagaacttgattccaggactatgtcttaaaagcctcagccaaattttactggacacaaagttgagtgtctactaaatactaaaggtatatataataaaggaatattaacatagtctctctccttctggagcttataatctggggaatgtaagacagatactaagcaaatggtctcacaatataacttgtaattacaaattgtgcttaccactatataataaaagtaccatgtgctctaagggcaaataaaagaagaagatttaactgagtctggaaattcaggagaagcttctctgaaatagtaacatttgagatgacacctgaaggttaaaaacaaaaagtaaggatggatggtggaagaggattccaggcagagggaacagcatgaagtccctgaagagagctgcacagagagaaaaaggtgactagcagcccaggttgaggttgaagagatacgtaaggcctgatgataacaggtccttggtaggccatgttaaggatttttgtgtttatcctaaggacagtagaggagcaaacttaagaaggactgtggcatgatcattgttgttttttaaaagggtaaactttggggcatttatcccagagagatggaaacataactgtacaacacctgtacattatgttacaccaatgtacatagcagctttatttgtaatagcccaaaactggaaacaacccacattttcttcagtgggtcagtggttaagcaaactgttatatctataccatggaatacctctcagcactaagcagaataaattattgatgcatacaataactggttttaatcacaagggtattacattgggtgaaaaagctaatctcaagatgatgtactgttacgattcttatctatatagcactcttgaaatgaaaaaaatatgtaaggattgagaacatacttgtggatgacaaagttagggagttgggatagaaatggaggtgagtgttgctataaaggataacgcaagggatcttttgtgatggaactgtcctgtagcttgactgtggtagtattcatgagtgtatggatgtaataaaattgctcagaactaaatatacactcacatactcatgtgcatataaaactgatgaaacctgagtaaggcagatggattgcaccaatgttaatttcctgattgtgatattgtactacagttatataaaatgttaccatttgggcaaaactgggtaaaaagaataacaaatctctctgtattatctcttacaactgcacgttaatctaaaattatcttgaaattaaaaatttaaaaatatatatcaaggtagcttaactttggtaaataatttggaaggatcaaaaatggatatgaggaaaccagtgagggagctattccagtagaccacataagaggcagactagagtattgacagtggaaatgggaggaaattgatggaactgagagataattcagaagtaaaatattcctggactttttcatggttggttatgtgaaataaaagagagaagtggcaacaatgactcctggtttggggcttatcaaactatatgaaggataataccattcacagttacatgaaacaccaaaggaggactggagtggagagaagtttgtaagttctgtttttgagatgttgagtgtgaggtactttggatagatacatagtgagcatattgcacaggtatttatatacataaaactggaattcagaagtaacatgaaggctggagacatgaattcagggtaatcgacatatagtggtaaatgaatctgttggcatgaataacattgcctagggacagggttagattgagaagaagacctaaactgagacttgaagagctcttaatatttaatccgctggtagaaaaaaatgaggccataaaataccctcagaaggagccaccaagaaggtggcaggaaaatcagaaaacataggcacagaagccaagagagtgcctcaaaggtagtggtcagtgatgtgacatgttactgagcaatcaagtaggttaaagactaacaaatatatattgcttatattaattttgagcttattgttgacctcagcaaaagctgttttgttgaagtggtcaaaacaataacgtgtttgtaatgggatgaggagagaatgagaagtgaagaaacagcaaatgtgggccactcagaagttttgctatgaaggaaaggaaaatgagctactgcaatatcttgaggggggaagtgaggtcaaaagaaggttggaaaagcatggaaacactagtattttttgtattttcatgggaagaataccgtagagaggagagatccaatgtgcagaagagagaagagcataggatgactggcagtataagattactgataaggccagagagatggaatcctgagtacaagtggagagatggaaggagggacacatcttctatttttgtaagaaaggaggagtaaaggaaaggagcagatgcaagcccacgtgtagatttggtactgaaaggttaagaggtttcccaagtgatgggcactgaggggcaaggtcctgctaagaataagcggggaagagatttaaggaaagtagagatttgaaatcgttcttgagacaaatgggacagcaagttgaccagagaaatacagtaggactctccttggcagtgtggaaggtgcaggtgagtctggtgggttgatgttgatacctatctgctctgtcatgggattttctccagcagtttggggaccaaggtgcaaaatcagaagaaatgagtttgaattaggatagggtttcacctagcatttgtggcattaggagttttagcttcttgttttggttctagctgaggccagtaagaaagggcagtgaaagggcttagttaaattctccaggcatctgttgagtatattgtatcaggcactgtgtttggtacagaaaatacagaggtgagtaagacaccatctatgccttcaaatagctcacagtccagggtggtttgtaggctgatatctggtccaaaacaccaggaacagggacttgaataacctttgcaaggaccaggagaccgatgtcattccttttctttcttatgcctgctccttccctctgccctgtcctcacaatacccagtttgtttttgtgttttggctttttgttttgttttgttatttactttctcaaaaaatatctactctctgccttattgccaagcctctagtatgcatcatacatatgtgagagacaactttgatttctcccattatctttttgctaaaatatgatgatttagaaacaattagatcatctacttgaagtatggtattggtatagtgtgaattgtctctaaatgttaagagctggcatctaacactacagaaaagctatttatttaagagggctggagacaggagtgtagacaggtgagagagggaacaagggaagaaagaagggagggatggaaagaagaggaaggaagcgggccgggcacgggatctcacgcctgtaatcccaacactttgggaggccgaggcaggcagatcacgaggtcaagagttcgagaccagcctggccaacacagtgaaactccatctctactaaaaatacaaaaaattagccgggcatagtggcgggtgcttgtaatcctagctactcgggaggatgaggcaggagaatctcttgaacccaggaggcagggattgcagcaagccgagatcgcaccactgcacaccagctcaggcgacagtgtgagactccatctcaaaaaatcaatcaatcaataaatatatatataagaagggtaagaaagcatattaactacacaagatcttatatagcagctcatccctgtttgttattcaagggaactcccatttaaaatgaataaataatcctccatccctaatggtgatctacaccatcagcctccaaaaacagcttccagacctagaaacgtaccagggtactataggttaattataaattccaggtgctggtaatgcaagagaagatatggagagggtctgaaggaggtggaagtttataacttccaacagaagaaagatcccttactcagatttattttaagcattataaaatgatagcttagaaagaggtggtggccgtgatggcttatctttatttgggcacattccattctgtgatattccctttaggaaatgatgttagggtcatttgactaaaagctaaattgctgatacatctggggtaaaatttggcagctgtcgagcgaaacagcttttttttaatatttactttttttatgattctataattcacacttattgtgaaatatttagaaagtatagagtaaaggggaaacatccataattccactacacagaaccaactattattaataattttttagatcaccttctagtgtcttctctagattttaacatgcctgagcatacattgcatgtatacagttgtatcccattttaattcaatattatataataaatacttcctggtataattaaaaactctttataaatagcactataacatctgaataatatcacataaagcccccagaatttacctaaccatgccctagataaaaatatttgggttatattcactacttgaaattttatattttaaaattctttaagggaagaactatgatgtacatctcaaagtgtcaaacttgggggaaacttgaggcagacattgatgtcaccctactaagagagctagttagtaattgctaatgactgaagatcatattggaatttttaagtatttattgcaggttttaggtaagttctttttcccccaaaataaaagttctaatttttaattctaaaaaagtatacatttagttttgcttgaatttgtttcattgatagtatttataaagagcaaggttaaattcctttgaaatctcacagcccagagataatcactattaataacttaggaaatattatatttccatacagtcctgtttatctttctctttttctttctctttgtctttctctttccagactgaaaggagaagttacttgctgttttgtattctattcttttcacttaacattgtaatagtcatttaccatgttaataaatatagatctacattatcttttgacaacaacgttgcacttcagtatatgcataatttattgactcaatcacttattgatggacagttgggaatttggaactttcttcttactaaacaatgccacaataactgtctttatatgcacatgcatatgtacacatgtttgtacacttacatgattatttccttaggatcaattaattatagtggaactgcaaaagtaaaatgcattactaaactgtcctctagcattggttaatatcttcaccaacaaaaaaagagactgcccatttctctgcatcctcactaattctgtaattttcagtgataatttttgccatatacatgaatattttcatactggaggtatgagatgcattttccaggcataaaaccaaagcctgaaaactttttaaaaaatacatgtattttaaattttattacatgaaaataaaaattactatggtagaaaatcattttttaaactaggaaaaatatttgtgatatatccctaatattttaagaatagctataaatcaatgatgaaaggatgaataacacaataaaaaaattggaaaagacaaatgagccgtctaacaggtttgtttgcttagtctcattctttactgcaaaggcagtgctccctgaagtcctccaaggccacctcaagctctgcttcttatgctctgatggcaacacctaccctcaccgcccttcaggggagtgttgtgggaagcaaagcaccaccagagacctatgacatttctgggttgggaggtggtaagtattcacctggttacatacatttatgtttatttggcatcaccagccctcaaagggccaggctcactcacatgaatgtaaaaattatcatcagcgctctgccttagactccagaatcagtaaattattgggaagggaaaaatacacactggcaacattgcctgatccatgtctccagggcaggattgacattattcttctcccagatgtagatagagatttctggatgttctcataaataaagtgctagaggccatgtcatcaacgtcctccatctttccccgctctctgattcccatgtgtattactacatacttaatgaaatggaatattcttcagcaacttcagggaaagtgaaagacgctagagaattggaaatgccacactaacagcatcacctccgcctctgccgtgcaaactgtgatgacagggcgtcttccctgtgttctgggacagggagcatctgggttctgggagtgagttcctcgagtcttcccgagggtcaggagttgtacaaagctgttctgggtggtaattggagcattccttgaccacagaagttcatttgcagatggtaagggatgacatgctctggggcatttttccccctctttggcagaaaattgtggacatgaaagtcatgtgtgttttaaatccttagacagtgtccagaaaggaagcaaaagagaggcaaacatgttagagtctaggaagtcccttcaggccaactacaagctaaggagaatggaaggaaccaggcctaggaaatggcttatcctctacctgaacagtcaaacacctcttgaggtgtgcacatatggttatgagccaggctttagtgctgccagcagtgcccttggagaccatgccactgactcagtgtacctagggctcagagtgtcaaatgtctcattttcttaatgatgctcctagaaagcttcacatattatccacatgcttctgtaacatagtttatactcagaagctggggttcgagggagattttaaatgttatatatacatatatatatcttccacatacacgcatcctacttgtttaaggagtcatgctactaggacacttgcagaggcatcttgtacaagaagtctttgcagtgataaaattaagagttttttttcttttatcagggttcttcttttacatggtctctttgtgtagtctctatattattcttcatttcttctaatgtgtgggtattgagaacagatcaggcatgctccagagaatcatttcaagatattcatctaaacaggtcaccttacctctcacacttcgataggctaaaatgggttctacctttaatccctggtaaatttctaggctttttgatacatgaagaataattctcacctctaatttaaaattaaccttgtactttgaatgagagaaccgtgtgtctcatgaaagaacatgagtgaaaggtacacctaaatcttttaatagtagccttcagcctagtccttataagctactcaaggacacataagaaaagtaatgaaaagtcttcagtcaaaataattttctgagttttttttctatgcttttatccatcaccaccatgcttgaataatcttcactgcattggttcttcaccagtagctttcacatactcctctaccagttttataacagtacctttcagtaaaggttaggaagaatcctaacactgttaacttcctcagtaagcatgcactatctgttgacagggtgtctgtagactatctatttacttaaaaagaaccaattttttcatcattacattatcatcagtcattaacattactcatctagaatgggtacagaggcaagccacctcctagtaacctatgtgtttaccactccatcccaaatctctgatacacttagaaaaaaagttttagacatgtaggataacattctagaaaacagtttcaaagatctgaatcttagcacaggaattcatacaccgccccccccccccacacacacacacacacactcttactgaccaccattatttggaatttttttttatttaatcgacaaagaactacagctaaaacactttgaagtattccttttgaaacattttgatgttggattctggcttattccttcttagaaaatgagggattacatttaaatgtcaaataaatgcttgtacctaatgtgttagtccatttttgctgctataacaaaatacctgagactgggtaatttataaacaacagaaacttatttttcatagttacagagactaggaaattcaagattgaggcacctgcaaatttggtatctggtgaagtcctctctgcttccaagatcgcacctcttgctgtatcttcatatggcaaagggtggaagaggaaaagggagagagacagctccttcacaccttttatataagggcacaaatccattcatgagggctctgccttcatgatttaatcacttcctaaagactccacctcttaatactatcacatgggcaattaagtttcaacatgtgaattggggggtggtgaacattcagagcatataatctaataagaaatgaatccataatttttgaccgttgtaataaaataatatttcattaagcatcactcatctctactcaagtagtgaccaaaagatggagatgttcttcagagaggagacaacagctctctgtgggtaacccccaatatggatgcagatttggaaacaggaaagcatgcaagtaaaagcaccagaaaaacaaccaagagatgtctgcaccttaactgcactagccaccctaaaatgagttaggctttataagatggaataaaaaacatgcactctagacagtaatccacttctaggattgtgtagggttttagtttcctctcatttcttcgcaaaagtatttttgtaaaaataacttggtctaagaaaaaaagatttctccataccacagttggattatttcatgggaacagtataccactttggcagactgcattgactttcaggccagcatgcggatccagggaaaatagactgagtgacccaggaggggcagagtcaggactggctgtatgcaggagtccttaccatcttccaaaagctaccaaatcaatcctttatttcctgtctcaacaatcggcattggcaaatttaaaagatcaaagttccttttaagacctgagctattatattattatatggggattacttctagatcagctactgttacctttgtctgtggtccagggcctcaaagcacttccatacacgtgcgtgcgtgcactcacgcacacacacacatgcacgcacacacacacacacacacacacacacactctattgatatgagcttttctcctgcctattagatgcattacaaatctgcctataatggggcctctctgcattccaacaaaaatatttctggagctctcctggctcccacaacatttgctgggtgcacatttaatatgttttagctttactgcctgaagatggaatcagggacatctacctgcacatgacagtgctttggctcttgcagttgcagaacttaatgtatgtatcagtaatgaaaatcttaattaagaaagctgcatcattgtccatgaacactcatttttctccccctgcaaagccctttgtgtattgcagtatatacctggtccagacagacagagccctcgaagagcttgtctggcagatcttctcttgattattaacagctagcgaatgacaaagtctcgctctccttttgtcttgaagctgaggcttggaacagcagagcacacaatgtactgtagggtttgtttgtgtttttttaaacttgcttttattacgttggtgggtttaaaaatccgacagtgttgatcaaaactaatttaggtaacttagagttgccaaaacactagcagatgcatatttacacatatactctcagaaaaatgtaattttccatatagaaacaatgcacaaacataagaagggaaaattttaatctgtctgcccatgtttctggtaactttggcctccagtacttaaaggctgcaacgtcctcacatatgtgaccttagcagttacttcttttcctgtgccattgtgcatgtgccaatttgtcatttgtgcaaagagtaagcagctttggaaaatggaatgactttatgcagacaactaactgtacccataaaaattacaagagttactaagaaggtcctttgaaccttagttcaaaggaccttcttagtactactcttgcaatttttgaaaaggtggcctataattatgtttatgaaacaatgccgaattgtgatattttaataaagctcacatcataattcccccaaataaaaagttaatcaacttaaaattctcttaaaagcctcaaagcatttcactcttcgaaagtagcaactcctaccaattaagtctatgacctcgacccatgtcctacatgatgaggagagagactcatgttctcagtcacttacatatcgttcagtcttctgcattttctaaatttctggtctacagtgttaaccatttactggtagagccatgtaaataattgaattggattcaggccgtatgcttatatgatactttctactggaataggacatattcacttaaagaaggtctgatagtaaatacttatgatctgtcttctgcttgctgtacctatactgccctcaccaagaggggagcagccatgctgtctcagatggtaatggtgtgctgcttatttactctccttataagttcgcatgctttcactcatttattttcaaaatcactgtaaataatggtcagttttctgcatatttgaagcaacaaaatatttgtacaaatattctttttgtgtatcatgaaagatatgaggaagacatcattatgggaaaattattttcaaatagtctaatttattaaaatctcatgattgcactcatagcatgtttaattaaagttaaatatgaaaagtaaaaatagacttatgttattaaactagaaccacaatgagaaagtaaaagagatgctgtcaaggctcttcactgctacataggaattattgtgaacaggttgttgcactctgaaaacttttcctttttaagaactatctgaccagtactgccataaatcctaaagcagctgtgaagtaataggcctatatttgtgctgcaggtctatagtataaagcatacagtaagctctcaataaatgtttggagaatgaataaataattatgagtgaataaggcaaagaatgaatagcactggcatttcaaagactaaatcagaaaatcaggtactgttcttaatttttaaaagtccttgattagaggttagaggtctgctgaatttctagaccttggtctataactttccaaacaataaactacttaaagaattatgaataatcttaatatttaaaatttgagcagattggttactttctacctccagaacacacacatacatccatgtatgtgtgtaaacagttactgggtcacaatataaaatgtagtttctactataagtcataaataaaaatattttaaaccctgccaaaaaaacaacaaaaaaattgtgtagattaagataatatcttctcctattcagaaaatctacagtttgcttaaaatttaagagtgactgacccattaaaaatcacaggccttctttccttatctatgaggtaactcagatttggcctccattctgctaggtggtctcctctccccttccttggagtgccatccaaatgcaatatgaaagtgagggtggagagcagttagatacagtctactcactatggtgtctggtcttctcagtgttgtcttctgagctcaaattccctgagatgtctgagagcccacctcatctttagtttcctgtccatgtagatccctgatgtgtcttccttgtcccagctccaaggcctcctcaagtcttcaggctcctttgtcatgtcttccttgctctgggcccttctgggtcatgctggggcatggtgaccctgtgaggttatcttaagtccatagtcctagacacccccctgcaaagacatcttcctgctcccacattgtggatgtgtttaccctcagacccaaccctcaccctacccttgctctacaacagtggctgacccatgtcagctagattccaagttggatttggtgcttgtgagacacttgtgagtggcaagagggtcagtagaaggcataggccagagatttcccccaccgttctttgcatcatcatcatcaccagccacatttcctttgtggtttactccctctgaacaaacctgctgtgactccagcttccctggtgacccaggcctctgggcatcaatagcaccatctcttcccattgtcctttcagcatagggacatagagacacagtccttcacctaaaagagtccactgactattagggaaggatggatgtgtaacacagatgtctgtaatgcagcaagaaacagagaggaaacagattatttaaaggatgcattgggactggagatgcgcatagagtcgttccaatacttgcctgcaaaatagagtttctcagagaaggcctaacagtcaggtggtatttgatctggatcttcaggaatgaatacggatttagcaagcaaatcggggagggattctcacctctgttatttctctgtgtctctcccaatgcaatgattttcaagagaagcttgtacactccttatgtagaaacataacggatctctcagggtttatcctcgtttggattagtaaatggggcagcactagagtagtaggatgcgtgtgacctgagtttcaactctgttgagtagcatcagcagcttacaggaaatgaggttttttttttttttttaatgtatccttttgtagattcgatggggccatttctagagttcagtcttgacctaaagacttggatctcaaggcactcaaaccgtcttacagaatgtgcaatccacaaaaaatatatacttaagccatttaaaatatattatctctatattggccaaacttctataatgaaacagatttcagactatcctgtaacactccaatctgtcagaactttcctcagaatactgtattttgctatttttttaaaacagagaaataagactattgatttacaactaacttcatctattagtatgctagaaacaatattcctaaacttgtcctttatgatctaataattttaaaaatgaaactaattgttgttctttccattgtttgaaaaatggaaaatgataatattacagaaaacagtaaagacattgaactgtttaaaaaaaaaaaaatgaccagccttccgatggcttaccatcctctttgcctctttgctgacatccctatgtgttcctcatcatttttgtgcttgaaatatgtattgtgtcagctttagtccagccaacaagttgagtaatccagcaggtttaggacaaagaagtgtgttgcaactgaggtaaaaggtctttaaaaagcatattagctgactatatggatgttcttcagttcaaacctgaccaccctttgctctcacatggaaatacatccactagcagtgttgtaagtgatcctatcagcaaacgtgtgcatcagtgctcctccagaacatcatatttacgttagggcttaataggacattcataaagcaacatgcagtttgttatttttaaatgcatgtgacctccttatttcaaaagcaagtatctttaaacatagtaatagcatttctctatatgcaaacctctgtacatgaaaaggtttacattttaaaacaaacatgtttttgagttttatccaaattcaaaaaaggcatctgaaaaatttaacagctgaaaaacactttctccttgctgggaaaacttaaaccttgctaggctttatgcaacttaaaaaaaaaaaatcacttctgtgctgagaactagcatgagaaatctcagcatgaaaggttggtggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctagaaatgctgctaaccctgagcgggttgttactgtttgaaaagcctatgggtatttgttttattgttgtctcactcaattcttacttagctgagagtatctcacaagggaagtactgctctgtgatggtgtcctggactttgttttctatttgtttcagcacttcaataaatggtctgttacctgccattatgacctgtatgcatttgctgagcagtttttcaaaacaaaacaaattatgtggctgtatttctagaacgctgagccattttcaagatagtatagaattagaaacacacatagacacgtccacacaattgtatgtttatactgaacacatatattcagacatattcaggaaaataagaaaaaagaaaataggttggacaatacaaatatggaaatacagcttgttcaatcatttagagcccatacttctaacggtgtacatatgtagacgtgactttgtaaagaagacccacatgtgtgtctacactcaagcatcttcctcttaatactctactgaggataaaggacacaaagtaatttttgaaatatcatgctggctacttttagagtatattagtgtgagtagtgacttaagaggtcaggtttaagagaagtagcaacatacttctattatttacatggtgatttttttttataagtccttccttgaaggcagacttagatatttcaagacctccttagaaaaatttttcagcaccttctgtgctccaaattgagtcagtttgcatcatgtttcagtgtaactgagtaacaggctagcaaattctctgctttcttattcaccaaaatccaaaatagaactcacaaaaactccttccttcttccccccatcctgaaaaaacaccctactgtggccccccccagtagaggaacagaccagaaaaaaaaagagtaaacagagccagctgtaactatagcactttgctcagtactgtgagcttgctagagctggcacattttttataatacagatgcataaatgtactgtctgaggcagaggaattgcagcatcccctttagtatttcttgactgccttggtctaaagtatgttgcacaggagaagcctccctaaacccagaataaaatacttaatttggtatctattttttaaaattgtgaccttctatgacttaatttttcataaggtttgtagaaaaccacctttttcagactttcacagggtttttccaaattcagacttccggggtctatgtcttactctcacacatacacatatgcatacacatttcagattacatatttaaagtaaaatatgtaaatatggactgttttaaagttattaaatgtgtatatgtgtttgtgtgtttgataatgaattgtttaataatgaactgttgtttcacagtggacataagataatcaaaccaatggaaaattattgtttaaaaccatgatagctattagtttttccagaatgagatatgcatttttaagagcagcttgttatggagtactactttttcttctctaaaattgtttgctagaataaaatttgttaaataaataattctgattaaagtgaatgggaaggagaaaggtactttacccaaaggtccagttaaacatccaaaattggaccaaaactttgtccaaaattcatatctgcctctgaggaataaagattagaaacactgaagtctaggctgggtgtggtggctcacgcctgtaatcccagcactttgggaggccgaggcaggcggatcacctgaggtcaggagttcgagaccagcctgaccaacatggagaaactctgtctctactaagaatacaaaattagccagccgtggtggcgcatgcctgtaatcccagctactcaggagaactcatgaacccaggaggcaggggttgcggtgagccaagatcgcgccattgcactgcagcctgggcaacaagaatgaaactctgcctcaaaaaaaagaaagaaagagagagagagagagagagggagggtgggagggagagagagacagagaaagaaagaaagaaggaaagaagaaagaaagaaagaaagaaaaaaggaaggaaggaagaagagagagagaaaagaaaaaagaaaagaaagaaagaaagactgaagtctatgcaaaagagtgcagggtacggaccgggcgcggtggctcatgcctgtaatgccagcactttggaaggctgaggcaggcggatcacctgaggtcaggagttcaagcccagcatgaccaacatggaaaaaccccgtctctactaaaaatacaaaattagccaggcgtggtgttgggcgcctgtaatcccagatactcgggaggctgaggcaggagaatcgcttgaaccgaggaggcagaggttgcggtgagctgagatcgtgccattgaactccagcctgggcaacaagagcgaaactccatctcaaaaaaaaaaaaaaaaaaaaaaagtgcagggaacaaaggtcattttcagtagcttagagatgaattccagaggttcaatcctgtgtttgaaaacagaccctgtgtccttttgggcacattaattcacctttaagcatcagtttctttatctataaagtaatcagaaaactcttatgatgattaaatgagatagtacacatcaaacatgtagcccagtaaggccaatatcaaccacatagaaaatgcttcgtaatggtaattatggatctaaattattttagcagtggtcgtatctttgaaataagcatttagcctggagatagaaatggtgcacacttaagcatgttatttcaggtatgtttttcagtttatatgtgatgtttctttataagcacaacgcataattatgcaaccagtattttgctttttcaaaggtgacatttattgcacactaacagtgttctaggtactgtggaagggattagaagcacatcttctcttatgatccttagaacagcccctataagttaccattatacccatttttcaaatgagaaaactgaagctgagaaagcatcagcagcttgcccaaggttagataactaggtaatgatggggtaagactttgatccaggcagtctagccctaaactgcaacctaagaaaataattacaagtaaacaaaagccattatgcacaagatatttatcatatggctgtggcttgactgtgtctccaaaagttcttgtgttggacacttaatctctgatgcaacagtgttggaaggtggggcctaataagaggtgattcagtcatgagggctctgccttcatgaatgaatgaatgccaccactgcaggagtgtgtgcattagttatcatgagagtgggttcattatagaagtgagtttggctccttcttgctctctggcttttgtgctctcttgccctctgccttccaccatgggatgatctagcaagaaggccctcaccagatgccagtaccttcatactagacatcccaacctccagaactgtgagaaatatattttttctttttaaattagccagtttataatattctgttacagcaacacaaatgaattaagacataaatatgcttttttacctttttgttctagatatttcaaacatatacaaaagtaggaagaatatcatagtgaactctcatgagttcctcactctgcttcaacagttgtcagcccatggtaaatcttgttagacatatttgtattataaaactggaaataagctagatgttcaactctagagtgctgtgttaagtatagtacgacatatctattagatagaattttgagccagtaaatgtttatgaagaacctataatagtatgaactatttatactatatattaagttaaaaggcagcatacatagtaatacatatggtataatcccaccttttttaggatttttaagattttttattactctcctatattttctaaattgtatatcatgaacatatcttaattgggaaaaattaatatttctctaatattcagaaaaatatgaatttcttcattaataaagacagcttatttacctagcctcacagagtaagactccatctcaaaaaaaagaatatacttaccataattcaaacttttctaaatgattcagggttgttatcttgaactacaattcaaatttgtttctattgatgagggtgtggaagtataaaaataatgctacatatttgaatgttattttatggtttccaaacttctcaattaaccatttggtccttattctataagattatttgcttctgtgtttctttaccctctgactgctatatctttagttctcatgccttcttttcgtagtttttatttttcttctttagctattaagttactttctgttgtgcaagtctctaagatcctcattccttctctgatgcattatttctaatcttctttagacaataaaacaaaaaaacatgttttgattgtgtgtaaagtacatacatgaactcattcacttgacaaatattgtgagtcgtgcacttgtatacttggcactggagaggatacacagataagacatgtcttgccctagaagttttaatctagcaacggagctgagacatgtgtctactttgctagaattaatagtgaaaagtgaaatgctctataaaagtagtacagataaggtattcttggagctcagaggagggctaactgagggcttcatcagaaaagatgacactggatttgggctttgaaaaacaagcaggatttgagcatacagagatagaaggaaagaacattactctatcatgagaaaagcatggaagaatcaaagggtaaagattctgcaaagaagtaattgagtttaacttgagcatggaatgtgtgaagataagtagtgggaaataaagcggtaaaagtatattgggaccagaaagtgaaaggacttgattattagggcaaggaatttggactttattcaggagacagtggggagctattgaaagtttttagtaggagagtaacataatcagagctgtgcctcaggaagattaatctggcaacagtgagtaaaatggattggagtagggagagaccagaggacacaagatcaggcaggagactattacaatagtccaggtgaaaggcaatgaaggcactaactagggcaggggcagagggaatgaacagagatggcaaactgatttatgaaatgtggcgggagaattaatccattatatttggggagcaagggagaggaagacaccaaacacatctctatgattttgaaccttagtagagtcataaacagagcagcaaagcaggagaagggttgggaggggaaagcacacgtttaattttgaacacactgagtgaaggtgccgactgggtatctgtgagtggtccactaggcttttggagacacgacactatagtgcagcagaagggccgggcttggagataaagattttgagtcacctatgcctcactagatagagaagcaagagaagaggcttttaaaaagacttggaggattatgtgtggtttatttagtaccaattttggctgcttgcaggtctttttcactttgtttgttcttaaccatatttggaatgccacataagtggtgtgcagatatgtgaagcattgctgtatgcatgcaaacacacaaaatagattctaaaataatgaactagtttgggatatagctaatggggtcaattttacagtgtccatagactatcttcacttgtaacatattcctgtgggatatggtttggctgtacccccacccaaacctcctcttgaattgtatctcccacaattcccacatgtgggagagacccagagggaggtaattgaatcagggggcttgtctttcctgtgctattctcatgatagtgaataagtctcaagagatctgatggttttgaaaaggggagtttccctgcataagctctctcttctctgccaccatgtaagatgtgacttgctcctccttgccttctgccatgattgtgaggcctctccagccacatggaactgtgagtccattaaacctctttttcttcccaatcttgggtatgtatttatcagcagtgtgcaaatggactcatacactgtgtaaccttagagaaatcactgtacctcttacttctctgggtctcagattcctcatcagatagatgaagagattgatcaagatccctggtctccataactggttgcaagcagccaaaactgacatagaattagaatcacttggggaaggcaggggaaggaaaaggcccaggaatctgtgatttgtattttctacttactttttattttttagagacaggggtctcaccatgttgccccaggctggcctcaaactctgggggtccagtgatcctcctgcctcagccttcccagtcaccaggactacagccacattccactgtgcctggctgggaatctgaaacctctctatgtgattctgagacacatcctgggttggaaattgccgggctacaaaacctcttaggttcactccagctcttatattctaaagctttatcaatatttagacaaaatatgcatttttcatgactcactcataaggaaggaaatatatcaaaaatgcaaacttactttcaaattcagttcatcagctaaatactccacctctctcctttatattaggaggacaatatatttttaaagtatttgaaagacacaataatttggaaatctcctgtgattttataaaatgtgaaagatatgtagtgtgtgccgaaggggtaggacggaagggaagaaagccaggaagtctgggacatagcacacataaagcgtgctgttcaccagccatacctggggactgtctgcatagccacagttgaagtatgtctgtgctctgcaattgatttcagtgctctggctattcttgttgaggcacgcagtccttgtactgtttctgattgtacctgtcaggttgtatatataagcatttcagaagtccttctgtgcagactcagcacaggtttagcgtgaaataaaagagccagttgagattccagtccaacaggtgagctatttccttaatgggcttatctttaacataccctctttggtttggtttccatcatacatttcatactttacctttcacatagctcttgttattacagcattgcctcagctttcctagatcatacattctgaagcttccccagggtcaacagcatgctgtattgggccacacagaagggaaggagagcagtgaggtatctttttttttttcttctgagatggagtttcgctcttgttgtccaggctggagtgcaatggcacaatctcggctcactgcaacctccacctcccaggttcaagcaattctcctgcctcagcctccgaagcagctaggattacaggcctgcaccaccacgcccggctaagttttatatttagtaaagacggggtttcaccaagttggtcaggctgatcttgaacacctgacctcaggtgatgtgcccgccttggcctcccaaagtgctgagattaaaggcatgagccactgcacgcccagctgaggtatcaattctttattcacttcctatgtcctctttcttcctttttcccagggaggacccagttagatgaacttgataggttagactggattaacctagactgtaaaaacaggttggaatttggaaaatctgaaagtttccaacttccaggcaaaattttgacgtcccattttgctcaacaagtatgttttgaggagttactctaagtagggaattctgctcagcttgtaaatcagaaattagcaaccaattttagtgattttgtctgtacactggctactacaaaaattctagacataagtgcagagtagaactagtgataatgatgatgttagtactttacatttatttagccctgaactgtcttttcataaaattatctttggtgccctcctattcgcctaaggaaatcctttttatccttgcttgtgtcactatcatccccttctcccacccttcagttccacagttatccatttcctttccccattcaaactgcagcttcttgactttagttacattcagttaggtgatctggtaaccttattaaagtaatttactccaaggtgtaaatgaggtttaaccctcttggagaaataaatattttaaaaatatcttgttagacaactgagtttctttcccctgttcagttaatgacacatgaagcgagatgtttttttgagtagagtcctcagttatatctcctttgccctctgacctccaacacacaatgttttatttacatttgtaaaggaaaaacatgaaatcagccaagcagtcctatatctgtcaccctctacatattctctcagtcgctccacctccctgatgtagctgtactttcaatgtgacatgacacccccatatatcagacatttgctgacttcaaccatgcaaccctgctggacccaccaccttgtttcctcatctgttcccactccaattcctgattcctggctgcatcttgtatttatcatcttaatattgatctttgaatttacctctttagattttgttcccatattctgggagagagtttagcaaagtacaaaaagcaaagctctggagtaaaatgccactagtcatgtgaccttgaactagttatttaccatctctaagcctctgttttctcacacgcaaaatgggagtagtgtaaaaattaaatatgatatatagataggatgaagaatattaagagttcaatgcatggagttattattgttaatattatttattatctttactcccctcaacaacttcaattgggattctcccctgattctaccttggagaacctttcttgagtgttgtatgctggtcaggactagtttcctggatgtgaccttttcagcattttatacacaaaataatgtcagacactacatattttctgaacaaagacttaggacataattttataaatacatgcatatttatggggataataaaagacaagatttgaaaccaggtctgctccaggagatcagagacttaatctcctatatctaaccttaggatgtgaattctatacactggacaaagatgaattttagagtcgtaaggtaatactgataattaagaatatgatagctctgataaccaattgtattaagaaaggatggtcaattacacaaagaaaagatgttagtatttcaggaaggagtttttttcttctaaaggagaaagcagagccgttggagtcatatctgggtttgcatgcaaattctaccacttaaaatccatggacaaaaagacactaactaaatcaccttggtaaaagcattaaatttatttgagtttcaatttccttatcagtaacagattaatgacacccaacttgtagacttattatgaagattagaaataatgcataaaattctggtatattgttaggtctaaataaatatatttcctggaaattgagagccaggtttctcttcaagatgaaaaaggagctgaaattatgcctgtcttccacatataaccaagatctatatttaaaagcaaataaaaaactaactactataaaacatggaaataaacattttccacatttacatttttaaccctaatttttccactaagtatattcagataggcaggttaaatataaattaagtactttttcaacatcagtttctaaaacagaaactttcaaaggattcctaatgtactttagtagtataaaagtgtcttttgttattatataagggaaacatagggtaatctgagactgtgtcatttttaaaaagctgttaagaaatgatcacctaacattttatggagagataccagaggtatttagtgaaatctcactaaaaagagactccctttttctatatctttaatgcttaatttccaagtggaaatattgtttttaatctaaatcttgagcattttagataagttgagaaattgtgtggtgagtggtttttgttttttatttctaatgaatcagtaattttgaccttcgttccatatgcctctttaatttatggtgaataagtaatactgatttttcaaaaattaatgcacaatctcaagcccccaagttttaaaattatgatatttccaatggcaaatgaaataacatgctgtccatgcagttagtgatttgaggcaatttgaacatcatgataagagagggagggaattacaagcagtgttataattaaaggtctgttgattcttcagtttaaatgccattgttgaaagatttttcactcagatgtcaaagtctgtggccagccaaaacttggcatgctagaactcagcccagggaaacattgtgttctacagatttaaaaaccaaaatctgttaagaacagaaatgttgggcttgggctgatttctcatgaatcagaaccagaacatagccaaataccacctcctctttatgaaaggaagtagtgcaggtggatgttaatgggaaatgtttgttcagatgggaaatgaagggaaattatcattagatatcatcatacagtgcactgggttagagttttatatcattaaagcatgtttctttgtgaaattaaaagcattttagacccctcttctattaaattcttcatgggtgttaagtggggagcagtatttacccatctttcaagatttgcacattgaggttcagtctctccacattacattccttgtgactaggaaaacttgaagtaaaactttatttgcttaactctctacctagaaatatatttccaaacaccgtcttgccctttctttaattagaaagttacaaatcagtggcctatgagctgcatctagctagcagatagaattttttaaaatgtatgtttggtccacagaatatttaaaataatttgagccaacctttaaggttaaagagatttcacaccaaaaaaaaactagattttttttttttttttttttttttggcttctcttgaaaaattggagatctgacaacattagatctgcatccacatgtggcaccaatatctggaactgagtagcagctgctcacttcagacaaaccatgttctctccagtttgacaaagtccctatcaccccatattttatgccacacctacttcactcatttgctcttccaccctggctccttgaggcatttgacttttctttcattgcttgtggtcgttgtattaagtttcctcgcttgtggtattacctgttaaagtttccaaaattttcttttcattaaataatagcattgcaaagactatgcccaatgatactggacaaagaattattgaaaagaataaaagtcagaatgcaaccaaaatgtccaaaaataggtgattgtttaaattgtattttatgctggtatatccttagaatagaataccatgtaggattaaaaatgtttatcttgaaagaatgaatgcagattactaaactatgtatacatcaagattcctatgttgtaggagaagaatattcatacatatagaaaaagagctaaagtgatgtgtcaaagcagtatcagaaaaatatgtacatatacaaaaaatataaacaaataagtgaataagtaagtcccaagggcagcttttgtgggtccccttctacagggctttgttagtcccttttgacctaatggtttgaacatatgctaaagctattttttaattctctatcaaaacctgattttccttcttacctttattctttagagaatacaatgaagaataagatttctgtagttgttttaaatacttgagaaaagtattcttacttgcccacatgctacactgccactttggcaaagcaagagaaccagtttctgtgttggctttgagttagtttgttcttctaaagcaccttttggtgacataaaaaaatattcaaaactttaaaaaaaatcttggaacagaaaaaatacacataaacattgcacttaataacatgaccacaaaaactcttagaggctaggactgaaactcatcatcacaaaggcgtcagctttttgccaaccataggaaggagtgctcccaggtaaaagccatccaagcatttatggaaatttttctgatcccagcgtttagcacaataccttggagttaggaaatgctcaaaaatacttcctgaataaaatacaaataaattcacattcccaccaaggaataattaacctgcatataaaaattcagttatcttttgaattaaaatcaaaccataaagtttggatcttgctaactactctaaaaacttccagatatagttttgcttcagagttaataatgccaacatttttcctaggaaaaaataatgtttgtttatgtgtgtgattgtatgcatgcttgagtttagggaaagggtagaaagcaataagaggtggtcctttcaaagatgagtacagtgatgaagactctagctcttaaatatacctcttcctcacagcaatcctaggtatcctgtttatgatttgattgttttgactatctatctctaattcttgaagcatttgaagcattcttcacctttacactctatagcgtctgtttttatggttctcctgttcatctgaatgatctttcatccatcctccctttatctgcccacaaaatgtaagtttgtctgtctttctctcctcactgcattcttgaaatctgtggacagtttcatgaaatccacatagcttcaactagatgtttggagcacttccctagagatctaagtatctagtcctggcctgtagactctggtactgcacatgtgggtttcctgctgctcaatggacatttccacatgtttcacccacaacatctcaaactcctactgctatcctttgagtagtctagaagctagtcaaattgaccccagacacagtttgtgctttcctatcccttgctttgactctttctgtttcccttgcctaaaacctatctctccaatttctaattgttggaattttcccacattccaaagtccatctcaaacactgcctgcttcaggtaactttgtcagtgtccaccgctgaatagcaaatgatattcctcaagtcactgaaacctacagattttttttagcaacgctttacggtattaacttatttgcatcgtgttttagttatgtggtatttcttttctcccatgttctaaatattaggattattgcttctaatctttgtagctactttctagagcttaggtcctagcagagtcccttgctcacagcaggtgcttattaaatatatactgaattaaattggatttatgtattgatggttgcgcattgcacatgtgttgtgatttgggagacccaaaacatccacctgcccaaactatctcttccattttccaggccatagtatcttgctttgggacgttctcttgtacaaatgtgaggaatttccacaaatttagtcttttgttcccaagctaagtacactattggctgggtaacatgtgagttctgctacttgttatctcctaagagggagcaaagtcttaaaaaagaataggccaaagttcagatatgttctcatggaggcaacagataggaaaaggtccatgaaaaagacaggatcacagataggaacttggactgtgccacttattagttgtgtgccttgcttgtctcatctgtaaaactagatgataataataatgatgcctaccttagatgttatgagaacaaagtaacggggtgtgaagtgcttacaataatattaggcacattgtgttagtgagggttgactattattagttacatatgtcatacatatatgggatatatatagtgtatatgtactcatatattaagtatactctttctcccctcactgcattcttgaaatctacatagctgcaactagatatttggatcacttccctagagatctaagtatctagtcctggcctgtagactctggtactccagatgtgagtttcctgcatatatatatatatgcttaaaacataatgcacacacacaaatgtacatacatgtatttgttaattattgtcgcaaaggaaatcctggatactcagagaccttaaatgtctgaagattgaggatgtataagagaagagatgagactctgtcacacagacctgaggtaaagctcagctctgccacagggaatacctgtcttttatatttgttttaaagattaaatggccgtgtcatgagcataatcatcctaacattggactttggacctccttcttttggtgattcctatccctttcttttctttctttcttttttttttttaagacagaatctcactctgtcactcaggctggagtgcaatggtgcgatctcggctcactgcaacctccggctcctgggttcaagcgattctcctgcctcagactcctgagtagctgggattacaggcgtgtgccaccatgcctggctaatttttgtatttttagtagaaacggggtttcatcatattggccaggctggtcttgaattcctgacctcaggtgatccacccgcctcggcctcccaaagtgctgggattacaggcatgagccaccgcacctggcccctatcctttttctgaactacacatttgttttcttgacaaattagatttcagacttttgttctggaccaaacttagaagaaacaggtggtactgtttcagaaaaatggtgtcagtacaagctaatgatttcaaattattaataatttaatacagtagtgaaatgttaaaatatgtacgaattaatatgcaccaagcctaacagagaacaaacactcaccaaactgtagctaaatccttaatctagaacaaacttaccagtcagaccaggttttataaaaaataaaatatctcttacctatggaaataattaattatattacagattttacaactggcttttttttttttaagtacaagaatttaggtttttacctaaaaacaaaacagtcctttccacttagttctatttgaagggagtgtgtgggggttgggggagaaggaaaaacgaaggggaaaaaaagtcttgagaacatctacaaactcctggatattcagagctgaaagaaaaagaaccttgtaatgtaccttcttgcatttagtcctgttattgtagtgctgtgatgtggcactcaatgctctaggggacctagagcaagtgttacaaatgcaaccaaaagtctcatgaaaatgagcctcttaacagtgtgtgagctggtctacaatggcctcaggaaatccccccagctattcatgtcctttttatccactacattctctgactcaaagggaaacctcccttcacctccttgaccagaattgagcagacattgatttggttacctagagctttatttattcatttattagtctttatcatttgtattccactagaacaaaagaatatatcttttctttgcattaatctaagtttaaagatgtgcaaatgtgtttgtgggagagtgcatatttatgtttacgtaattttatgggtagctggctttaatttaaaatattttctgtcaaaaccatagtacatagagcctccccatcaccatcactgtgcagaatgactgtacttgacacataagctgaattcctaaaattgtttcacgtaaagtgcgccttttaaaagagatcatgtttttctattcacttctataattagattgagtgtcacacaggaaaaataagtggcccaatgtatatgtttttttaaaaaaattaagaatcacaactttcacctcagtgataatgatgcatttatctatggacactttatgtgcataaattgccccccaagaaaagccaataaaaagtgaatataattaaacagcagatagtttgaaagcaaatgctacttgtaaaccactgtactgaaggcagcgggaaatttggagatgtgtaaatcaggaattgtcctcagggagcatatagtctagttaaggatgcatagcagaaaaggtagaattgtatgcacaattaaagattcaaatagcagttcaatatattcagagatattcttcgcacaattatattaatgacttatgttgaaattataccatgtagttaatttcccttccattttagaggacttactgagtaccacatactatgacaactatctaaataacaacaatgcattatgagctcttcacatgaattcaacttaggcgaaattcaattttggttaacaaagtttgggcaattcaagcaataataatttgttttgaggtagactacatgttcctgttcttttaaatgttaatgcacagtagctttgttacagatttccttcaggaatgcttgttgaactagtggacatttctaagcagattttttatattaagcaatcaagaaaaagcctttgaagatattttcactccctcaataccagcttcggatgctatgttttcttcagtgttatagtactgaatttgttcttacttagggaatatgttcaaagttgagttggccagaatggaaacattgtaaattctgcagcagtgtctatttcatgtataaactaatcatgatcaaaatagagatcctatagggacctaaaggaaattaacatccttagttaccaccttagctgtaacctgaaaaagggattaatgtaagttcagggggaaaccttggaggcatatacaacgtagatgtctaaaaatattcaagctaccgtacccaatatgtctgtatatatctttactctcctgctaaagagtaaataataacaacatcagtaacaccaaccgaatgagattcttagtttacaaagcattttggatacatcatccattttgatcttcagaacaatttgtaagattggtaaggcacatattattcatattttacaaatgaaaaatctatgaaatgtaaaaggacagatgacttgcttaaggacacagagctcttaaaaggtgcagctgcatctcctgatgcaccagtgtgactggctcagaggaaacagcaacccaaacagaatctttgctacacaactgtcctgcaaggcacagaggggttgccaaaaggtgacgtgcagacattagtcttcagaggaaggacgagtcctcaggccaagaggcatacgtcactattatttcatgaaagaaggaaaagacatggttagctctcttatgaggtggttttctccacatatatagagctgttgagaaatactgcaaattttcattactcagagattggataaaattctgatgattttccatgaaaatcatagttgtgtctaatctggttgcatctgagttcccttcaacctactaagagtttggacttgaacctctaaaaagatctcagtcctgatcaggaccatccttcccacctaccaggatatacatattttctattgaaaaaatatgtgaccataatcaattgttgagcgagctccctggagcttcttacttatttgagaatatggtatggaaatgcaagagatcatgggccactttactaaaactgagtgtcattggaaattgataaaaaattgtggttctgaatcccacaagccatagactttcactggcatacagaattcaaagctgtcactaaattctgctacctgataaatagaaaggtagactttcaaatcaagaaatttagcacttggttctagagactaataatgccagcagatcctccattcagcatcacaccctttaaacatctacagacttccagcctttattttggcctggagaattggacatctggagcttcttgaactttttttcagtattactacctgggagccctagttaatatgaaatatcaaggcaatatcaccaacaatgtggtcctaggatacttgcaatccaaattgatgtttcttctacaataataaccctgaggttgtaaagtgttttcatatgcatgatcttgttaacttctacattaacttttcacataaagcaatttattattattattaattattattatttccatcttacagatgagacaaatagactaagaacataatctaaagtcacatagctggcaaatgacagagtcaccatgacacctagattagcaggtgatctcactctgagtccaacgtgttttttcattagccttgatgagcctcacagatttgtcctatgacaattgttctcagctaggctttagaattacctaaagggcttgttaaaatatacacactcagacatccacctctgagcatctgattcagtaggtctagaataagacacaataagttacgtgtctaacaagtttctaggcaatgctgatgctgctggcccaaggactactcttttaggagcactatcctatagaatgtaagcggtaactgaatggcaatgatacactatggcaaaagagtcttattaaagtttggataggggctgggcgcagtggctcacacctgtaatccagcactttaggaggcccaagtgggaggaccatttgaggccaggagtttgagaccagcctgagcaacatagcaaaacctcatcactacaaaaatttaaaaattagcctggcatggtggcacacacctgtggtcacacccagctactctggatgctgaggctggaggattccttgagctcaggtggttgaggttgcagtgagctgtgatcacaccaccagtgcactccagcctcggtgacagagcaagaccctgtctcaaaaaaaaagaggggggggggaggagattgttttgtttgttttttgcctaagctgcctcatgcttcttttttctgacctctgttaagaaagctcagaaaaaaatgtggggtgggggtctagcaagagagcactcacttctgaatgagttcaggtctctggcactcaagaaatggacactgaaacccttctctttgcttctaactagaactactgttgtagattaacttggagatacaattgccaaaccaccagtgaagagttactataagacaggaggtgggcaaatgtgattagatggatctgcagccaactgatcaattaaccaataatcattagattgattgctttatgtcaacttagaaggaagctcttagtgtcaggagaaaagaccctccttgacttatcctagtcaatatttttctgaagactggtaagggttcttgtatcacaagctcagtttgaaccagtaaggtaatatatctgctaaaataattttttaaagagctaagaaatatttcaactgtgttgaaagattatgtccagatcaaggtagctgatggtccctgtgttaatttcctatggctgttataacaaattaccacaagcttggtggtttaaaacaatgcaaatgtattctcttacagttctgaaaccagaagtctcaaatcagtttcactgtactaaagtaaaggtgttgggagggctggttccttttagcggctataaaggaggatccatttatttgccttttctatcttttggaggaccctgcactccttggtgcatgaccccttcttcaaataaccccaacctcttgtttctgtcatcacatctgctaactctgatcctcctgcctctctcttataagaacctttgtgattacagttagagtccacctagaaaatccaggataatctcctcattttaatagccttaatttaatcatatttgcaagacccctttgccacgtaaggtaacattcaaaggttctggggattaggacatggatatcttttggggggggccattcctcagcctactatagttcctttgtagtgtgtttatcagactacattaggaatattgtacccctttatcagcaccagaatttaagagttccgtcagtaaaatatgtccaaaaaagaggggatctggagtcaagagtataaaagccatctttcaaagtatgagtgagaagagtgtggaaccagggacagacagactgggttccagcactagttcacttctaccaagtttttttaccttaagcttgtcagataaaatatctctgccactcagctcttctctgtaaactgagagaaccagagaatttcctaaataccttctgcttgtataaaatctgtcaggctgttcctaaatggcatttaaaaaccaagtgcttactatctctaatattcaggataaatcttgtccacttttcttttgaattcaaaattcacctaaattttgaatttaaaacatgttttctaagtacttcttgctataaaaatagtggcgatactatgaaaataaccaaaacaagtgcttttcactagctaattcttaaatactataccctccaatattattttctgaacatcaaatcactaatcttaggataaagtatgccccttttacatgttgaaaacttgacacacagagagaaaaatttgtatttactcataaagaacaaagggaattaaaatttgttgcttccagcttttctgggagatcatctaccaccatggcaggtgtgatgctggacaatacattaaatatacaaggtagaatggaaagaccttgtcctggaagagctcagtcttaaggaatgagtaactaaccagagggcagtcactgagagactgctatcattattacaggggtcaaacaggtgggaaagggctgttttatatatttattgtggcttgttctcagataagagcatgggacttgaccactggttctcaaaaggaaatatggactagtttgatacaaatctctctatagcatgagggttatcttatgaacaccaactttaaatgatattttacagagcgctacaaaaaataacttggaggaagtttataagaaggaaggcttcaagagctgaaccagaaaaaaaggtgcttgaaagtaaatcaaattatgagatacgttgaattatggcatttattattatgtgcagaatatgcatggaattttgaactaaaagctgaaggagcaaagatctagaaaccttcctgcataataaataaattaaccctttattctcttattttccacactccctatatttgatgacttattcatacaaatgtacactaaaaaggcctaataaactatggtctaccatgggtgcatttacctatttgtgtacatgttttaagcatatttttctgggagtgtttctttagtataatgcaggcacagtatttcaaaggccaagaattctttggaaaaaggaaaaggagttgtgtctgtttatgactgtcaaactttcctaagcttattaaattaggatatgttgtccttttctttcataatttgaagattattctagtgatatgtttggagataaaaaaaaaaaacctgtcaagtaagtcagagctaataaatgggttaataattcactgaaaacccgtacgttcagtatgctctaccactcaggacttagtctcattttctactctaaaatatcgaagttttcattggtatttttttatactggaaactacatagtgtaagaaaatcagcttatcatgagcaggtcatcagctctggaaatatctgcccatgagaaaaaaatgtgattggaattctgtcaccaaggaaatgttttaaaaatctgtttcattgccaaacaaaaagcttcaactagttatctttattttacaatgactttaattcttttgcccattcatttattacatagctactatacactgatcatttagaaaaaaaagcaccctaaatgattatgcaaaccttaaatataactatatgtttgtgtgtattcgtatgcttttttaaagagcacatttgtgacaggaagtgaagaatggcatagtcgggggaaaattaaagagacacgatgtaattatccgaactggaattaagccaattaataacccttgtgctaacactgtcctcaaagtgctgaaaatgccgtcagatatttaaatgccctgggtggtcatggtcagcactcttcccttcatccattttcagcaccatgcagggacatggctcaccctggtttctgacaaaggactacacctgaagtgagctacagaagaaggacagattctataattcgaaaacaagattctctcaagtggttttggacagattattactgatctccaatgaaataaaaattctagtgttttttttatttgcttattcattcaacacacattgactgaatacctactgtgtgccagtttagtaccatggctgagaatgcgggctttaaaatcagattggctggatttaattcccagctcctcacttgctaggcgtgtgatcttgagcaagttacacaatctttctatacctcagttttcttttctatgaaatgcggatattggtagtacctcattcataggattcttgtgatgctaaagtatgattttaaaatgtaaagtccttagcagactgcttagggaaagccaattagtaatatgttggccatcattattattatgagccaggaaatatagtaaaatctgggaacaaagaaataatacaaccccagatgacctaacatccttgaagtttagattttaggaatttagttctaaactttataatctctactgccaatcctttctagtagagatctgtatattagatccttgctttgctatatgctttcatgtcttgaacctacatgctttgaatataacacactcagcacatccataatatacacttttgtttacacaccttcctccataataactaccgtgtaatgactagctgtgtactttatatgtttcctcatgtcatccttaagacaactctatgggaccaatatcatcaccttttacagaaaggaaaactgaggctttcagagtagctgtgacttttgcagtgttatatataaatatgtgtttgctccaaagctcttgttcttttttctcagttcaccaacagacatttactaagcactccactgctttcttctgggctctggcctatcaggtattttggggcttgccaaaggatctgccattatcaaaatcactgattccttccccctttccaaatcagtcaactgtaggccgtgtgttttaggcatggcatagcagccattgttaaagaggttggtgtgcaaataaactaaattactctggctatgacttctctcagattacttgtctttgagtgggctcccacgtgcctgacatttctttcggttttcttctttctccctaagtagcaatgttgttgctgaagcatgactgagagatagttttcggtttcatacacatcctgagtcttgttttagggcaagaaacttaatctctccagtaacatctgatggcactgttctcttcataagcacctctttcaccatttaaaaactggaccttcaattacccattgtcaaaagggaatccttagtgaacatgatcatatgtgtcccgaaaaagataccatcactttcatgggcggaaaatatagtttcccctttttagtagctcattttcaattgaaatatattggaaaggttgtacatacctaattctccaggtggaaaatctcatcagtgctttaaaactacatagtatgctgaaagactcaatctctttcacccacaatgtgcctatattttagaaacgaggtgtatgagaaaaaccacatcttctcacttggtgatatatagcagatgatgttcatagagcgaattgtaaattcagggtgaggtctttgtagatcaaaccactagccttcattagcttgaaaatgtgacacaagttatatcttgctgagacgaggcctctacaatattatatttttctgcttttctcctagaatgaattaaagacttaaatcccttgttcctagcattcaaaatggtctctctctctctctctccatatatatatatatacataaacacacatatatataaagtggaaatgtatttatatatgtaattatatttccatttggctatttaaacattttgagaaattggaggtttgtgcactaactatataggtggagtaatattcttatttgggaggtaagggtgattttcatacctgttgggccagatcttcaaagaatactctaggttagctggtgtggtggaaagagcactggcctggtgggctcctggagtcctagtgtctagtgtcgactctgggcctcagtttcctctctactaaattgggagggggagagattgatctctggggctttttctagctctgtattctctgggtctgcaaatcgccttcagtgtctgccttgccagctctgtttgtcacaaagattaatccattttaactgtaccttggagtgcacccgggagaggaggatggatggattgttttgtacctaatattgcatcagaacttttgcctttttagatgagatcatgccgtgcctaaaatctgtctgcctatctgcccactgactttgtctgtgctgatctcttgccacggtgcctcttcttccagcatccttctccctccaagatctagattcggcatctgactgtacctgtcttgttctctgcagcatctgtctgctacactcctagaccatcgttaataaactttcacacattacacgaaaacccctaatatgttggcacctgcacataaatatctatggttcataaaactagaggagaaaactccattttttaaagacctctatctagtgccatttgtatttgcactttttgtttagttgtaagttttaatagttccccctttgaggatttgtcagtacgagcagtattgcttatcagaacacaccaacagtctttttgtaatattcgcttttcccctttggttcagccgagcctgctgacagatcattcaaattcaattgttttatgtctaagccgaacagctaattaaagtagggatgattaacctgactggcagtgccgctctccctctcgcgctctctctccttctccttttctctctctctccctcctgttccaatcagtctttttctcacacactctctctctccgtctctcctctctctccctctctctctctctctcccccccctctctctcttccccctctctcttcctctctctcagtctctctctccctccctcggttggtgtctctctctctctctctctctctctgtctcttgctctactgtttttttttcctctctctctctcctaaacgtggtctgcttgctgatggcagaatggcactcggagatttgtgcattgtgtctggtttcctacgggcaggctgacccagtgcctccagggacttatcaatagaccactcagaagagacacagacaggagagaggaggaggggtggggggagagagagagaatcaatatcaagaatagaaggagctccgaagccattttttttttaaagaagtatcgggacttgggagagggtgacaaagaaggtttttcaaagaggcagtggaggaggttctaataaatttggaaggaaacagttccctgtcttgggaaaaggagaactcctgactgattagcattcacaccaggtatgagatgttcgctaccccttatcactgtgtcgcaaccgagatggaaaagcctttttttttttttaggagaccgagggagcatgtattttgctgtgtttgttgttggggggtaagaggggcggcgtgagaagctgtgggcatttgtgtatgagagcagaaagaatggaagcagtacaacggggggtgggaaagagtatggagtatgttactgtcttccctgtctttgtgcacccctggggggttacccaagttcatttctagcaggtggatttagacgggagttacttaacgcttgaccgccagttttgaaaaaaaagaaagaaaaaaacgctgcttcctatgtctattaaaggaagctccaatttctctctctctctctctctctctctctctcccttctcttttcctctctcttcctctctctcttcctctctctctgccccccatccctcttcccctctctccctctccctctctcttctttttttcctcttctaaccagacagcgggagggtttctggctcccagccagcccaaaagcctctaagtgttttgcacttgtttcagggagtagctgcccggggatttttcagcattttcactagagaacaaagagttctttacaaagggaagggtggggggggggggagtgagcttaatgtctgatatatgtttttctatttttattagtttttcgcctaaaaagaaagagacaggaacagaacattcactctataaagacacaaagacattcaaaagaaatccagttatcttttctccccatcatcccaatatatacatatatgtacatgaaaaaattaaaaagaaaaagactagttaagttgcatatgttgctcttttctcctcttttaatctttccaaatccaactgttcttatgctcactttatgctattttttttctactcacaataaaagttgttcaggatgcatcttctcttatcatgtctttaccctttctgggtcgccaaaatcttgtggaagaaagaacaaaagtccatcaaataatcaatttggtgactagaacatcttctacttttgccacttgggtaaaaagttaattatggaatttgggttcccaaaataccaatggggtacatcagttcattcgatctcacaagtttttgcatccatctgtttaaaaggtaccacttgtgtcacttgtcagttattaagaaaaggtagtaagggagcagatatttgtattttatttttgtttctaattatgtaaatgacaaaacccccagagagatttcttgccccttctatgatacactagttcatgcaaaatatagtctagatggagattttgtcaacgattctgattgccacgtagctttgtgttctccatttcaatttttgcctatgcatgtatatttttaccatgaatttgtgttgtagcaaacatttcagaatgcttatcattttcaaattaatgctccaacaaaagcaaaaagaaatcagatgtgagctgtatgtgtaaaatgtagtaaacaattttatcttttatatatgctgtacatttatatctttatgctaatatcctggatttgtaaacccaagataatgttttctttcttaaagttctcttaatgcatttatatgttgattgtcacttagaaatctttttaaggtacattatagacacgaaactaaacaaggggaacaattctcaagctctacaaaaatccttaaatatatattatgtaccattcctaactacagataactgttttgctaagtagaaaacagctacaacagttgtttcaagaatcagaaactcttttcttttttttctattaactgaaaataaaatctattcatatccctggggagggaaaatgtaggggaaaatatagatatatacattttccataattatagaatgcatttatgtaactgcttcttaagggtgtaatacatatcagggcagagtgtgatgctcatcaaaaaaccctcctggctgggaggtgtgagtgccttatgtttgaagtaacttgataacaaggagtcttttcgggaaaccttactatgtatgtgttgcctcagtaatgatcctcagataaaaaacaagtactaggtggccagtgttagcacttgaactcactgaaagatattagaagtaggggaacttttggcaaatccagaattttccagggtaactcacttcttacacttacatgttttctttaggaatattcttgaattgctttcagacttttctgtatttttgtagaattttttaatgcttttaatagtgcttaaggagaaaaatacttttaaaaagaatgtcatccaaataagagaaactcagtctttaaaaagttttatattgaagacaagagttgttttggttttgcttttttcctttttgcttgtgttctattttttctccctgaattcttttgttgctgtgggctgttgtccctgcatttttaatttttcatttggtacccccccttttttttcttttttctttttctttttggtctgtttttgatgtgaccaaggggatctttgaaaggggcagagggactgggataacaggctgttactgaaagctgcactagctcttcttgatcccaactcaggcagctcctatcagctagttgtgccgccaagagtacagtgacaggtgatagctgtcattctgggattcttcgtggatctgacctgagagtgacacattcacagtcgaggagaaaagggaaaaaaaatagaggaggaggaaagaaaagctctttgagctggaatacactggccctttcttcctgtaggcaatccgctccagttcttggcgacgtgtcctgcactatcagatatcatatgactttttatttagattccttttcggagaatggcctgttaggactctgtttgttttcttttatttaatttccttctcccctcacccactagttttgcgtatctgtgtgtgtcatagcgtgtgtgcgcacatgcatatgtgtgtgcaatttttatctttgtttttgttctgttgatctgatgctttatttaaagacaaagctttaattatttcagtatactggtttaattatttgccaaaaagaaacctcattctaggctttttggggggtccatttttaaacacatccattaacacatgaggctggagatcctatatgcttgttggtctgcccttggcccactccctcaccttaatttaaccctccccttcatcagcatgcacagcagtataagttaggaaacacctgtgctgagttgagagagaaataaaagtagaagcaacttcttcaaatttgcactcctagtttcactttaataaactttttttaatcgttgattttttttttttttttttggcatcctctgttaagcttgaaagcatcagagatagtgaacgatgtgtctgtggagcttttgtgaggccagctgagcacccttggaaagtagagcaggagctgaaattcattcagagacttaagaattaagtaagagatttaaataagatctgtgagatctgtgagctgttcagggtttggtgatagatggtaaaatggaatgcttagggatattcaaggaagagaaagaaattttcaaccaggaacgaaacaggcatttctactgcaattcatactttaaaaaccttcttttatcaaatttttattttatatatctcaaaatttaatcaattggtatgattgccttcttttccacgcttgctatgaaaaacagatgaattgtgccgatgttattactgggtttctcctaaatttttgttgtatttctttttcggctttagagagttctgattttagttagcaaaagaaaaataaaacttctctaggtatgcatatggttgtatacacattattcttatctacatataatatatcctgtttgtatcaggatataatttttgtatagttacatgcaagactgccttgaaagttcagatgaccattacattctttaaacccatagtttttagtttcttgttagtttctctaaaattattttttacagaccttaaatttgtaatgccttatcatagccagaggtgaattttgttgaaacttggagaaaaatttattccacccctttaagcgtacccaaaagggaagagagaactatttttcgttcaacaaaaaattttaaaagccttttttccttcagcggaaaactccaaaacagctttgtctcagaacgttaaacttggcatggataaaaaaatttgagttttgctttgtttgaggaaatttgtttttgaaacaacaatgttataaatatttttaaattgcctgctgagcatgcgctgtatctgactttattcatagttttaaacacacaccaaagtgcagtcttctgaatggccacaggtaaggctgttgatttgtatgatctttcgcagaggcaccttctgtgagtctactcagttttccagaagggaaaaaggcgagagctgagtttagacctggacacctttctaaatatcatagagcaaaagtaaattgccccattaaggcttgcacattacacttagggtaagtactgttcaactttccttttttataggagttgcctgccttaacttttcagcttaatacgagcagcgtaaattaagaaaaaaaattaactcaatcagttatttcactgaaatagaaaatttgcagattttaaagggtatctattgtgcataaatttggggatacgagaatttgccagtgaaatgatagcagctctgtgcttacagagcaaagatgtgctagtctgaacatgcctgatctcatctggaatcgaaagctaaatctaggtgggcctgtaataataccagaaaaggaacacatgtatcttttgtgcaaccttttttttttttttttttttaaagctaggcttccaaagggaatgacaaagaagcaggttctcctcttgcttaataagtagtcatagtttgcctctggagatatgtatttccagttgttttagttgttttgttttgttttgttttgttgttgtcatcgctatcgaagaatattctttcctgtcagtgattattaacactttccgtttttcagaatgctttaactctgtttgatgtttcctcacttggttacctttctcaagtctgcgatgaccctctcaggctttgccattcttatcgattcttaccagaatgtacttactcattagctgttttgttatagttatggtggagataatcttgtttttcaggcttttataactaaccaaacaaattaccttttgaggtgaaatttctcatagttatccttgacacagaactgaacttgtcttgaaaaggcttgaagaaaatccaattagccgttttttgagaactgaatattctaataaatgcaaatggattattttacaaaatacttattgatgtgcaatgcttttctaatctgtttttcttttcgtgctttaaaacagaccctgaaaattaaatgtattaaaaagaaagaaagaaaaagaaagaaacctgccaggttaatactgatattttaaatacccaatttaaaataatgctcaaagtttgaatttctttgcaacatatcacctttcagtgtcagtcagtaatacctgggcaggtatatatatacattcacacccacagggaaacatgaatccactttacagttacattaattctattttaacctacaagagaaaaggttagcattactgtaaaacttttgttaattcattatattttatttttctgtaataaaaaattcactgaactattgctttcatccaattatatatatacttaacacccatttatattcaaatattttatcttaatttatgaagtatttttataagtcttatatgctgctgaattttatgcagctatatgaacgtttaagttttttctgatacaatttgctttgttccgaatctgttactgtgttagaagtttttttctttcccaatctagaaagagtatggccatcttttcctatatgtgatatctatacatcttcagtattctgaagaagagattttttaacctgcaatctcttggaaagctttcaaacaagtgggagaagtaatctttactttgcttctccttgatccatctgtttgccctcactgtaccacccgtcaccaccagcaaccctgaaaaaaacaacagtaataaatatgatacgataatttttctgatcacagaaccaggaaataccagagaaaattgtggcatatgtaggaaaatgccaagagcttctccagtaagatcagctgtttttatactttttttttttcctcttgaattttgtttgtgacttttttggcttgctgaagcacatccccataatcttacgaagccacagcaaattcccaatgccacaacaatactgtgcagccggggagaggccagaagagctgatcctgggtggctgcaggcttccccagcaatggtgcaaggcaggaggagtaagtaggctactcttcttttcccttcttacctaggctgcccaacctgccagctagagattttctttctgtagctttctcttcaactgtctgagacatttccttcaacaaccaatgactttctacttccaagggatggttcatatagcaaaacatccatttttattttatattgcaacatggaaagctttgaaattggaggggcaaaggaaaggggctcagggtatccgagaaatatcccaaatggcattaggctcaaagctgtttttcatggttgctcaggtctataactttcctgttccctccagagcctctaagtggttgaaagtagtgaatgggataactatagggtacacactatgatctaactgattcagtagatggagctcttctccttaagtctgtatttaaattaacgtcccactctagtttgtggggctctctcttttaaggtgtgtcatactacacacataaaattgaggcctgcatagctagagaagagatttcctggcgcttttcaagagacatgaagcatttgttctgaaatgcaaacagtgcaggggagcactagggtggggtgggaagggaaatggagtttacctatctaaatttctctctgtgtttgttgatattcttaagtgtgaaattaaatcctagcagttattgtggaatacacttattcattagctaatttgtaaatgtagaaaaatatattgcacatgcaggattttggtgatattcattgcaaatcttccaagctatctgaactgtgcagatctcctttcatttaattctacaaaagcatcttaatactgtaatgcagttgtttcatctaattagtctagagtacctgaataaaatgttacaagttctgaattgtgacagcacagtggagggcaaagtagtgtgttagtaaggtgcctttgtggaagccaaaatattttcagcaataactgaaaatagatttccagtatctgttttaatgggggaagagctacttgtttatttctttttaaattaattgaaatgaataattgccacagaatttttgtcattgttacattgttttcagtaccaatagaataagtttgatcatgtctcttcctggtaccaagtggagaaatatatgtacactgtatgtaataaattatcttccttagtggaatgtcttctcacagattggagatattactgaatatctcttgttaaatcttgataagatcatttggccaaagtagaactggtcttggctttagtaccaaaagaaatagcatttttaaaagacttggatttcctttgcataccacgtgtctgagtttgatacagtccaggaaaatagagaggatgagatgaaattattcctaagcagccgccgtaggccaaacactgaaacagtgccaacctggaccaatcaggccggcttctcagaagatacatgcttttgtcaaacacttacatgaagaaagagagagaggaagttcgtgaaactgtatttgtatgaatattcttcactgatttcaataaagtccagggtaataaattcgatgatttttattcttttgtaaagcagaaaatctgagtttttctgggcagctaaggttctctaaatgttgtactgtgacatcttttaaacaaaactatcctttcgaatttaagcagtgcaaaacttctcacaaagagcaaagagtaaaattgatggaaactcagaatcaattccaaacccatttctggcatgatgagaataacatttgtgctgtgtttaaagtagtttaaaacaagaaaatgataaaatgatcaatatacttaaagccaaaaataaccaggagagaacaatctgtaatccattctcagtctgaaaccccacactacttatttattgaacatgaaaataaacaactatatattttataaggtggccctgcaaaccttataacatataaacagtaatgatgagatgccaggctttcaaccctttatttaagctatgtgtttagaatttagtcaggcaaaaactcctggacttaaactattatacatttatttgtttctacataccatgaccataaaaagaacaaacgttaaggaatatatagattgtcgcagtgaactacattgccaccttacagtttatgtactctgtttgttttaaaaagaaaaaaaggttttaactacagcaaaagaatattttaagttagaaagtcagttaattgatcaatatagaacagatttaatatttctttaaaaataccttgactcctgactaatttattaaattcaacacatacataaatgtaaaccatatatattttatacttattgctttaatggattgctttaaaagactaacttgacactaataaattttgaacctgtggattcaaggtcagtgaatgctgctgtccaagtttacaaaaatctctctagacttaagattttgctctaataaataattttcttaccaatttttcagaggcacttaactggatatatatttatcgatcagataaaataaaattgtccatctagatttttaaaattccagctgaagaacttaaaataacaacaaattgcataggcacacaatttcattgcactgaggtgctgtaggaatgatgataattctaatgagcactgtgacgaatgcaactacaatgaaacatgtttgattacatcagtaagagtgaactcagtgggcaaggtcagaagggtgagacatagaagtcatgactgagtgggggctaatgattaaagttatgggagctatttaaagccctatagctgggtgcaaaattaacagatatggaaaataagagtcaatcaattctaaatatggacagtactttttcctataggttataattaactgtagaatttactattgcaaggatttataacaacatcataagctttggttgtccagtgtgatagtagatgtaaagagctgttatgcacatctgcttaaagatttatgtaagtgtaattgttatagcaacttgttatgctattgtttgaagtttaaaagctctgctttaagcgttgacaaagcaaatgtcagcatcagagcatcataatcactgtatcttggagcttgaaggggctttagatatctcaatatgggtgagtgggttaaccaactcttcagaatggaatattggaatatctggtcgaggaccatgtagaatttgaaaatacatatatattacaatgttttatatttggaaaacaaaatttacgagaaaaacttaacaaaatagagaaagtaaagctctacaaaattatctggactaatggtactatatattgcattctgtgaaccaggaattttaaatagagaagaatagaaggatctacattaaaacaaggttttatttttatcaaaaaaaatttgatgagggggttgtccaacagattaagaaatgatattcaggcttaaactactcattttgccaataagaaaacttaaacacagagaagagataaaatgctttcaagatgagcaaggcaaaactgggaccagaactcaagttttctaactcacgttttcttgatgtactcctatgccaaaaggctgaccactaaaactaatttataaaaataaaaagtaagtgatatcccactttgaagaagtggaagaaaccagaccctcagggtttctatttctatgccagtaacctcacctcggatgtggcagggacaaatatgtgtgatgaggataaggcattctgaggaatgaaggaaaatgcacccaaatgcattgtactccctagagactctggagttaacactgctgcccagacctccatagccttgtatctcacattttttctccctctatcgccaccaaaaaataaataacaagaaaagttttgagaaattgtagtcagaagatcttttggaaagaagtatttctttgtagaaatattcctgtacagattggtatattttactatcttatcaaagtatgagttctaatgagacattgatgattcaacaggtttataacattacaaactggaacaatccttgtttcctaagcacacaccacattttcccatccatgttccttttctcctagtattcccaaatagaaacacattctgcctcctttatttctacaacactttgtatcttttaatgagccttgccatatttcattttatatgcaagctatttatgtatttatttgtaatgtaaagaacaggtctacataattttaggcaatgtacttaattttactgggcctcacgttccacgtctgtaaagagaaaaacgatatctgccttcctaggatactataagaattccatgaaatgtagtatataaagtgcttagcagaatgactagctcaaggttatcactcatcattgttgttattgttattgctactattacttattaatattcccctgcctctgattctttcccatttatatacttctcgaggtcatagattgacctaattcattgtcttctcatgcaatgaacacaatgatttttgtgtaacaggaacctaataaaaatatattgaatctttttataaaagtccatattggacctattatttccctacaaagatccttaaatcctgtcctggaagtttaaaatagtggtggttatggccagtgcctgacccacatacattgtaaaatgcagtggtgttgcttgctgtggactgtcagagccacatgatttttcaggttccccacagacccccaacagcttaagactgctctttgcagcatccccagaagtgtcagcttatatttctggttcatgtgattaatgagcttgttacacctctgtctgtagcctaaactagaaactttcactttggagagcaggtcaagatatcgaatttaattttggttgcatctgttataagccaattgtgtattcattacatttatagattccctcttcagccatatattttcatggctgttgagagcacctgaatctgtgttgaatgtccttagattttactttggagacctgaaaatgagacagtgagatctttttgatagctagctgtcatctttggcattttcttccctttagtgtgtaatctggtctaaatttgaagaagagggcaagtatagcatttttatctagcttgaatatggcatggtaattctgtattaatgaggtcaatggtaaatgcagttcagctacacatttctgtttttccagacatacaaacacattctgtggaaatagaaaatgtctaaaaaatggaaatgatgaaataacttgagacatgtaagggtagagatataacattaaatgtatgggtttagcaagcagagcaacatacaaagtggactctgagtatgtatggatcttgccagtccttcaaggtttcagtggatagcaagaaaacgaaaaagaggtagatcacatgaacatggcagaagagagactgacagcagggtgtgctcaagtcagaaggaatgttacattttaatcagccagaagttccatttatttgagaataagctggtatttgtgaggggaacaaggtcacatttagtagaactgataattcaataaaggattttgactttgccagagtaatggtgttggcatcaagagaagaaagttttgcagatttctgtgtgtgcacttgctgttactggtgttcctggtgggtggctgaatcatcctgatggcattcaacaggaaccagctgctgagaatattaaaatgcaagcatttattcctctagagagacagtagcatctgcaaagttttcctatcttgatagtacagataatcccagggagcattctctagtagttttcactctctattcatttatacattttctttttatcattagcattaatatctcaagttctaaatgaagagaagagtgcctgagtcctgagtccacaacaggctgtagagatggatagttaacacttggccaagaacttggtattgcctcttgggctttaccttgaattgttatctaaaagggggaaactgacatttccctcccttggcctgtcttcaaagcaaagagtcatccatactcctagtcttcagcgagctccatcagtgtaaatcctgcccccaacaacccccaccaaacacgagctttggagcttttcactttacttataaaatttgtaaatttgttgctttccttgtgtgtttgtattttatttgtttgtttggtttattttgttttgttggtggttttttttgttttggttttggtttggattttttgagctaccatcaacagttaggggaaagggagttacaaaaaggaggtttggactctgtaatcttccaggtctttccatctctaatatttatgaataatgtattgaactgatggaaaaaatgttgaatatgttcattatgaattatattcaccggtgtgttgcctagaatataaaagagcaaagcagttgccgcgtaagtggttgcttacaataaatgtagtggtacaacagagctctgtatcccttctcattccaccgcgcgtcgtccccaaacacacgctttacatgtctgagtggcaactgcagatgaggtgcttgatgggatgacagccagccaaggttctgacgggtacagggacattcgtagtgcagtgggtcttaaacagaagcagccttgatgaaggttttgatagtgcagtttccttcaggagaaatcaccgaagccagtttcacatagcaaacattactcaagtgctttcatgctgcaggggttataactcctattaggagaattgaaacttataattttgcccctgatttttaaaaaacagcatgaataactaatttgtcagcaatgttacattctaaatgagccggagtggcagaaaattcagaactatttattatatttagcttcaaaattcattatatacttgtctctgttggtttttcttcataattatgttttgtttagaatttatcaaaataaaattgtattttctaagcatttaccagatgacattgagaaacagtaaccagaagcatgataagagacaagaaatctttttagtcacacaaataatcgacaaaagagataataaagagttaaaataatagcaaaatagtttttcactggccaaaaaacagtgaggcccattatttatcaaatatgtcaccgtaactgatatgcaaatatgtgccaaaatagagaaagaccatctaaggtcagggactcagagaggacagccctaatgtagagaatagttccaagttaaagcagttcaacaggaaggtgcacagaaagctctggcttttgtctgatatcccaggagaatagcagagtgttgatgagcaggttctgcctccaaaaagctcttccttcccatggtatcacttcagagcctttggactagctcttgcgagagaagggtccaagacagtactcgtaccagtatccactttatagtgacattaattcaaataaactgtcccagcgttatctatccttttaaaaccttttagaaataagcttttttctcccctatgctctctttagaagctgaaacccatcaaagcccatgaagagcaagtgtaaatttagagcaaccacatttatcaatagtttataataatctcagaggagaagcagagagaagaagaaagtaagagggaatgagagaaatagtgaaatttttttcaggaaaattacattacccattatttagatcaagtcactcaaaaacaataaaggatacccaattccatagtggtatcatgtaagagcagatgtgggaggatttttttttcccccagctccacccttccttacaggacaaatcgcttaacctatctgtgtaatagtgtatttgtcaaataaatagaaaaccatctatcctcatctacttcacagcagtattgctaaggctgattgtgcacacatatattaatgtatatatcgtagctatctatttacagcaggggagaatggttttaaaataaatgaatcagagttttatgtgtgcatccattgtgaaggtcagtcactttttaaaaaaaaaaaagtaagaccttctctgctgattaccatttgttaaaacacttgaaaatgatggctgagcctacatcacctctgtgaaatggaagacttttgaaatctaagcatgattatagagattcaaacacatttccatctacttatggaccctaatggccttacgcagagcagcagtacaaacctattaagccaaataaaagattagctttgccaatagatatcttttaaaaaatcctaaatcaaggatatagcaattggtctagtgtcaaagtataattctggctgtaggagtgaactggttctctatattagatatttttctttaatgggacaaagatgtatagaaaggacggaattaagtttcaacctgtacagacatcctaggcatctgccaagctactggtctatccactcaagaagtaggctaagtatatataaagtccctaaggtcattggaaaagaggccacattcatttcactttggactgctgttattcttttgatgttggtctgagctctttaaatctctactttcttcatacatacatacattttttagacatgatgttaccctccaatagcttttcaccaggcccattccaagcatccaggaaagagaaacttagcttccatggagagtgaagtcatcgcttcaacttagcataataagaaagggagaaagcatactgttggtgaaatgagggagtttctgctaggctatgaccagattcttctgtttctgctattttttctctaactgaaaagagttattgtggtaattcacctgcacttctgaacctgtgtgcatacacccaagacctactcaaggtaaagccagaaagagattaagagcagactttcatccaggggactcagcttctttttagtgacttctgcttgttttgttgttgtttttaaataaatttgtgtttttagaaaatatgtttgaattcccagacattgatatcctgggcatccttaggttgtgacagaaacacggattagtgactgtgacaaatgtcgcagaagccagtgcagttgcaatctatcaaatatgttggcagaccccaggattttctgatccttgttgcagaattcagttgtgtccttaccgtaggaagacagggttaactgagagttttgagagttgtggtatgtgcttttccatttgggtctgggtagctctgggactggaataccttggtaaaaacaataactaaaactagggccagcttcatgggtatacaacctgtgcagttgcacaaggtcccatgtttggacgggccctatgcctggcttgatgtgcttctgttgctgtcctgaaattcttaataattttttaataaggagccctactttttttatttttccttgagccccacaaattatagagctggtcttgcctagaatttatctttccctagcataccaattgaaagtatcagtcattttttctcttactgaaaatgatacctttttcaattcctcaaaagttaattcctccattaaactctttgaagatttctgtccacataatgtggttcagaagaactcatctctccttctttcctccaagcaccttgagatgattatgatcaaggtgatcttgttttgtaatcagaaactctatagctgtctcagccaagttttgttttgtttttttttgtttttttttgtttttttttggcaaggagtgaatactagggagaaatagttgtatcatagtagtgagggctttggcctttattggatcattaaaataggcttcagtcattaaattgatgttttaaaatgagcacctaacattaagattatcttagcctaggtacctcccaaccatcatgtgatcaaacacatccgtgtatgctaaaaacaagctgatctctcagctctggccctgggcttctgcctctctcagacccccaccaatgccactgctagctatgtgttctgtggccttcccctcatcttcccttctgctttcagctcagatcaatccttttattcttcttactcaaaacacaactggcattagcaggaggcagttcctcgcttcagtctacatgtagcatctaaggagactacttcttgctgagttttgtacaaacacactaatgcctgccaccacattgatgagtgtgaattacagaattgtaaggcctggagcagaccccagagatggatgggcctgtccacactgacagtttgttaggaccaagccttaatccagaaaatgtaggcctcctgactcctagtcaggtatgctttggataactcaaggggtgttcgacattcctgaaagataaattccacatgactggctcctaaacctgttttcaagcacccatgagtgaaaggaggaggagaagaaaaagaaatatatacatataaataaatattttgtaggagctgagaaaagagtgctgtgtaacaaggagcctgactggccaccttgagctctagttagctgcttcaaccctataaaatacttcctattactaataatatcttcagggctgttggaaggatctagagagatgcttacctaacacaaagcctaactcacttggaagctgaggaaaggttaatttcttctacctcttcctcctccttctttgcccttactttcacacattttttcctccctgctctaggaaaggaaggaaaacagaagggatctgatggagagatagtctttgtgagtttaaattatatgagattaagctactctcacctcaaccaagtaggctgtagtttgctgaccccctgttgagcaacagcacaaccatggagcaacagaagagccaaaggcatttttgataaaccatgacatctctcaagggatttttttagtggttcaccagctccagacaaggccctgggcaaaaactgcaatagagactgggttcttttcagtccttgtcacccacttcatcttctcctctgccagcagagcctagggtccttgtgttagttaatctgattgcttccttcaccttcccctgttccagaattatccctatccctccctccagctccagttcaaaactgctttacactgagataactctcttggagttgaagtggttatagcatgaaggcatgaatggcttgacccctccgtggtatgtttgcatctcagaagaagtgctggaaaaccttttttagcaaggggacttttcttcttgcaggctcacaatcagctatgttcccaatgtgactatacccaccccacccctttcttttttgttttttaagggttgaagtctggctcaatcacccaggctggagtatagtgccacaatcatggctcactgcagcctcaaacttctgtctttgctgtaatcacacatgtgatgtgaactcagaaaagcaaactttgttcctggaggaaagagagggagggaatataggtttacatagtgaataaaacccagtatgatagcaaagggtctctcttacgaaaatataacacaatattactttttttgtatgaaaataagtttctatcttggatagccaaggccttaacaggtaacattataagagtactataaacaaatttaaaacccaaatgttttgtgataagtcagggcttctacctcctgtgaactctgggcattttgcaaatttgaataatcagtcatctcgagtctcctctttttacagatgagagtattgaggctcagatgggacacaggttttcttctgggtcaccaaactcaacagcagagctgagtttggggcccttgggcctctagggagatctagcttttctgtctgatacgggaactcctaagagcacctccatccaccccagccagctttcctttcttctggtcatttctctttaacagttgttgctcctgcactcatcaaaaaaaaatgtcagcacaagaatcaaagggaggctatggagcattagagaaatattagcaactattgaaaagacattttgacctatttctgtagttatcaatttaatagtatttgttgccaggaaatgcaccgttggcgggtgggaaggtggattgcaccagcagcctgttctcagaggccctccagttacaggaggtggtaattccagttaataaaagggtgaacttcaaacacattttaaccaaatcaaattgtagcgggaaatatcatattactgatgttcaagctgactcacagctggtaacattagtcagtatataggccccaaattctgacttttcagcattttcagatgagtttctggcagtgagagagttccccaggcacattgttatgtaggaataggagatttttagctaacataggagctagcataaatgaagaatttttttattctcgttagactttttataagattgtcagatattcaaataatatgtaaccaagccaaacttcaggttgataggaaatctagagccaggagttttaatttttttgttgttttgtttttttctgtgacatgttggcaaatgataaaagcaattcactctgctaaccagagatgctgggcagaattcccccaacactgatttcatgccatgaaaagcacatgaagtctggcctggcaaggcatggtgaggagcacaggctttgtgtcctactgctccaatttgaattccagcttagtccctactagctgtgtgaccaaaggatatttacgtaacttctctgaaccttaggattcttatacaaaaaaaatgggcaaaatatcaatcattcgtagttggtatgaagatcaaatgagataacatatgtaaagaaatccatgcataaagaaaaacagtgccaaacgtgtaccaggtgttcagaagtgatcactgttatcttcctcccttttgctgctatggtgtgcaagtttttttttttaaagagttaattattttccaataaaatgcacagcttttcatatgataataaaaggaaatgctgctggatactccacagattaatctggtgagtcttgtttgagtgaatggctgtttgccacctcattttagtcccagttaagcttagacttccctttattaacctctctccggatcatacatacaataggatacatggactacatgataaatcaaatggccccctgataacacagtcccaagttgtgtgagcattggtgagacaatggatcatatgaatagctagaaccgctcatctctcttccacatgtgtcctactacacctcactttgaatcaggaaagatgccagacacctttctatgggattgcctcccacctggattttttcctaaactttttccatgcgcctgaatctcggttttcacagagattaattctgatttggttcgcctacacttttgatgctctaaacctttttattgttggcagatagtctcaaatactgtgtttgagaatggaaaaagaaaacgctgctcaaatgtaagcaccattgaatcaaagaaaccgtattttttcaattgcattatttgaggatccagacaaccttgaatcctttacaaaagcacatcagtaaggctatcctctctcttagaaagatacacacacacacacacacacacacacacacaaacacacacacacacaccccaattgcagaaggctactcttcatgaggtaaaggactagagtgtccaagaggaatacaaaatgaaaaagatgtttctgtaggaagaacccagacctagaagccaggacattcaaattctatttcccactaccatgggaaatacgatcttatatggatcctagcatacctgcctctcccgaactccatcgtcacatctagagaacatggattccaactcatactccttaggggctatcaggaaatgtattttttgctgttttgaaagacattttgatacccctaccgagagcattttgcacaggccaagtatttccctcatttggaagactgaagccctgaattttacttcccatcactctggaatgggtaaaaaactgaactttttacactagtgtgggaagaaaatgatgttcttataatgccaacttctagcagggtgttaataatcatctaaaatatctagaactaacacagacccattgacctggtctgtcattcaattgacttccacttttatccatgcatgtttttgataaacattaattatggggtgacccagtgtgagaggagctgtggacacagtgagcacatccctcccctcacagcctagctaaccctccaatcccctaatgcacatcaattgtaagttgacttaaagttgtacagatccttcctttctgtgcattgagtcatttcagtatgtctatggaggggtggttctatagccaggaggacttgcttcttccgaactgctaaagcacttatttgtatgtctcctgtggcactgattacatactgtcttatactagagcatgtttatatgtctcattcctcctgccactgcacagtaagcttaataaatacagagactgtacttacacacagttgtatccccctcaacacctagaatgtgccatcagaaataaaaggtatagtagtaaatgttgtgatttgaatgagtgaaattaacaatggcatgtgagtgtttggaaagaaattaccttttctgaatccataaatttctactcagaagcagagaacatcactcagttacatcagaaaagcttaaggatgttttttctttccagtttattacttataggtttcattcttccccactcttgacatttgcacatagtaggtttttaataaattattattgatgtatttattaaaagtatagaataaagtagaggtgtcccactcctgtcttctaaaatagtaattttgattttcatctacttctttatcttcagaccttgtctattcctacagcacagatatcctgggatttcattccaagtggttcctgacttgagcttagacgtggtcatgacttttaacttggcctctttatcaggcttcttacagggcagaaggaaaatcttttttttctgtttcctcgtctccctcataggactgttgtatagttgaaaaggacctatatctacgtaaaactattttaattcctagagtaacataataacagattcataatgtcagattgaagaagctttggcatcccagcacaccaaatggttttgtacaccctgtttcaagcttatccatggacctgaggggtgaggagtttattactctaagcttttaggttaggttcgtatgatctgtaccagctacattaaccttgacctcagtccaaatgaggtagctgatttaatgtgtcctctccagtcacacaaaagcttcaccattactctccgacctgattagatgctaaatttcatccacacaaaatgatctggaaccagtcgtcttggtgttaggtcacaggaagtgataccaaagaattccaaaataaatacattattccagttttcctttggttcttcctcaaaaagtctgtctcacagcagactcagagagccagtccctcctcagctagacattctgttgagtcatgtttactgtccccctcagaaaggttccaaaagcaaatgcaagaggttgccgaatgcagggacatgtggcgtgcatgctactgaagtgagaggcatagcacacacctgctttttggctgtggcaggccatcttgactgtgccatgccacaagttagcattttggatgagcaattgccattctgttgttttcttctcaacacatggtgttcaaaaacagttaaaagaaaactgtacccatttgctcatcccagaaatctaaaatttcaaagaagcatgccaaattaattttcacataatattttccaagctttttctttgcactgagaaatggtatttcactttttgaactcttggtgtcctggcctgaggtaaatgggtacagtttctctttaaatggcattaaacatatcaaagcaggattatatctgtcactgtcttttttttttttttctaatggaatcaaaatccttcagggagtgtcccaaatccacattaatgtctttgagtgctaatgtttccactgggacttttacattagcaaaatataagtgtgtggttttcccccctctctctgctgtctgtataagaaagagacaactgcacatccgttattctccatggccttcagctaacccatgttaaggtggtaaaagatgactagagatttttggtgctaatgtttccttttctaccttttcactcctttgtgccacttgaccgaaaagctactgtgaatgctgtttccaacatggacaaatctttggaatcccagccatgaatctttgaaatcccagcatttggtctgttaaacagaccaaactgcagtagctgtcaatgctgtttttacctttggttctgattgtggaaaaattagacaaatacccagaactttaggatctcactatagatatttttgtcattaatattggggtatgagtcatgtgtcctttttattgttggtggacgcacttcctgtctaccttaatccctcttttcttgttctttagcaaagcagttcaaatggtattttgtcaactcttgattatcaagtgtcaatgaaagactacaatgtcataaatagaaaataattgtaaataataaataactttaacataatgaatcattagctgtcatagtacatttaatcttagaatgcacctttttcttgcatttgaacatgctctggaaaattacattatttcttgaataatcgtttttatacgtaatgtagaaggggctagaaagctctgcaatatccgtctctgacccccttccagagtttttcttcttttagcaccatcctgcctactgagggttttagttctggagctgatagagactcttcatccatggagagctgggaggtgccttgctcttgaggctcacccttttcatcgtttcactttctggagcactctggaagactacactacttccttagaccctcttcctatccttcctccttcttcttctgtactttttcctgctttttctgtttttcgttttcttttcctatcccgcgtgaaactagaacgtgaactggggtgtatgtttgtgtggatggaggggcacagggaggaggggactctccaaatgccccagcttagcacgaggagaaactccatgttttcatttaaacaacctttccccacatctaggccttcatatatgagagaaaaattcacttgttttcctttccacactttacagaaaacaaggtaagtagaggcagtgagaatgccaaccctggagtaaaaatgaagcagactatgtgctcacctttaaatatttttaaggataaaaccctatctactggcagttaacagggaattcactgtgccaggtttttgtaggagcagtgcatgatgttccctggcactgaaagagtttatagggtattttttatgtttttagcattaatttttgcatgataactttgcaacatcaggtaaattgtcttctaaaattaaaaaaatacatgagtgatttgaattttctacatcaatattctatggtggatccaaatgttagtttgctcatgctcatatatttaaacatcaaggtggcagaaaatgtgtgtttatattcgaattaattgggcacataacttagcatcatatagtagatatccaataaaaagactgccagtggcattcattgttgtttcatttttgggtttctcccttagcaggcttataggctttgtagatggacaaacttggatccaaatatgagtgccataaattactttctagctttgtatgtctgctcaaaacacaatcttgctgtgcctcagtttctttaccagaagaaatggaaacaatctctgctctgggagatgtttatgagaattaaatgagctaatttgtgtaaagaacctagcatagtactgaaatgtagtaggcactcacatgttatctttctcctttcctctttttaagagaaatgcttgggtaatatgatcacttctttactactagtgatttttctccataaccagattacttaaactaattgtattcattaggttttagctactcaatttttgttcatctcaaaggaaatcattgtgctttgccatatactaaaatataactaactgtaagggaaatgacttggagattaagtacagtcatcccttgatatccaatcagcagggcactggttccaggacaccccatcccaccccagcccaccacacagataccgaaatcaacaaatgctcaagtccctaatataaaatgggatagtatttgcatataacccatgcacatccttccgtgtactttaaatcatctctaaattacttataatacctaatgcaatgtaaggtctatgtaaatagctgttatactgcactgtttctttgtttgtgttatttttcattgtggtatcattattttttattggagggtttttttttccaaatattttccatttgcggatatagaacccatggatacggagggccagaggtctgactacaaatgtgttagatctgaaagaagcatgacttagcaacgttctctgccttattcttagtttcatccccatcctcaacctcaataccctctcagagactgggcagaaggagagcagcaatgcctagagagctctgtttctgagctaccgagttagggcattgaatttaggatggattctaaagggaaaaaaacatccaaatgcaccgaatagctgaaatccaatctttagatgtggggtaccagaaacattccagattatttccagtgtctaactaaaatataatgcagagtttatgccttctctcaagattcaaaattaatgattatgatttgtattaatccaataggaattagtttgactacttgattatttaagaggttgtattgtagatataaaacaactatactgttaactctttttgaaacagcacaaactatgtctaatcgtacttttttacttttataatacttgcacacagagttcagtaactgtttgttcactgaacaaatgaatctagtccgtggcttcttgaccatggtagtgaaaatgctacaacactggtcctctttttactacccagcaatatattttatacagacttatctatatctatagatctctccccctgtatctttttttgtatatatatgtataattgtttaaataaaaggccttgaaggacccaattccactggattcctcatagccccaaatctatctgtaaattcattactgctagaattgccaactacagaattaacttctgtgaccattggcaagtcctcagtttcctcatttacaaaatgactaaaagatcactaaggtaaaaaacacttcccactccagaatttgattctttctctctagtgagaagtcatatctttttgagaggtatcctattgtttgaacttagcacaagttttttccttgatgcaagaatcacaaatgaaattatttgtattctactaggggctggggacttgtacttgcttttaaaactgtttcaggacaaccattgagataggtgtcttttcatttctttacttacttagatactgggactcaacatggtgggggcagccagacctccacaggagcctgccaggtttctgtcattccccccacctaccaaaaaaagaaaaagactaaaatctacccagttccccacttctgggccccttcagggcacttcctctttggtgcaaatgaggcctgtccctcccagtctagctccatagatgcttttctggtgtgcttggtattaatgacatagtctgctttcgtcagccttaccatttccggagtgaggtatttcttggtagtttgcatttttttcttttaatacctgcgtatttaatgttgtgtctgatagagtctgattgtccccattgtgaacgtggtttttaagtcattaatatgttgatttggttcgtaaaagtgagagtaaactgccactatggtacagtactttgttggggggtatgggggattctctctattttctcttctttttacaagaagaaaaaggccccaaattgtgccctttggattatcttgttctctttttacatttgaatttcaaaatcccctttaaatgaacaaatctcaaggtttctattacgacagatgcctttgggcatgccccccagtccccgtgactttatggctgtgggcacttcttcctttcagctctttgtgaatattctgtgtccctggccctctctcagagtcacattgacattcaaacaataacctctcccttagttggtgctccttgattgccaaaacgagtgctctgcctctactgctttacctctgttaacaatcattctccacgtttctgaagaaaaagaaagtcttaacatttaatttcttattacacgatacattttgattaacacccaagtattagatgttggtgagtgctgaggggaagacccagacagcagacaccaaatcttatttttggagactatttacagtataaatgtgtagtacttgggggtgggcaagtcttgcacatttgaataaaagaggaacagagttgttgtctcatctgtgtcaggaccttctcctcttcggtctgcattgcagtcctgctttggcttaattaatccattaagctctatcttaaccctagtcagtaatgatcgaggggctcactggagccatctagaatgggagaaattagatggataatgatttttgtgctgatgatgtgttctgtctttttatatagttgatcccgtgagggacatatttctttggtgtattcctgctgatgttctcaagacagatatattacagagaaataaatcagactatgagactttgctagtgtctacttcttggtgtgtaaatttaacgttttaaaatcaaagctgtttttaaaaatatagttttatgaatataatattaaacaatcaagagggtgagagaaatttgggaaactctcattttggtattatttcttgttacactcagatgctgctatggaatatttatgttcatagtcttctgattccttcctcctctgtgagtaaactgtttaagatggttcctcctcaattcaattcaacaagtgtgtgtttagtgatacctatcatgtgcatagcggttgacagatctcaaaaagcatgagacttaaatggctttatatatattaaagtaacaaaatgggacttttttcatttttgttttttataccaatttgaaatcaagacttaaaagttgcaaggcaataaataaactgtattaaataccatattttgctgccatcaaaataatttataaacaactacaatacacaattaaaaatataatttttttctgaaatgtgtggaaaggtgggtggagtggttcttaccttgttttagagggttaacagttggctggtaatcatcttggaaatctctctggcataagtgaggtttaagttatcatctgaatgaaggaaagatgttcttcagtgcatgagggattattccgtagatgcaggcttatgtggaaaaagttcagagatggagagggtgtattctcagcggaaggaagccagaagacaaaagcgacttgctgtgtggattaaggtgggccttagtggcaccggatgctgacaggttagacaagcagacctacagggagggggctttcagtgctgggagtctataattcacaattgatctgaagtagggtagaaagccactggaggactaaagagggaactgtgacagtcaaaccattgagaatatgtttggagtgaggaggcaatttttttttttttttttttgagatggagtcttgctctgtcacccaggcaggagtgcagtggcgcgatctcggctcactacaagctccgcctccaggttcacgccattctcctgcctcagcctcccaagtagctgggactacaggcgcccgccaccacgcccagctaattttgtttttgtatttttaatagagatggggtttcaccgtgttagccaggatggtctcaatctcctgacctcatgatccacccacctcggcctcccaaagtgctgggattacaggcgtgagccaccgcacccggctgaggaggcaattttcatatcctaggtacaatgtgattaggagctggccaagaatattagtttaaaaaggtatatttgagttaacatcatcataagaaaatttctaaatttgataagtggctctatatgagaagcaatatattaaaatgtgaacgtttagcagaagattgaggcattggatatattagactgtggttatacagaatttgtatagcagaatgatttaaaaggaaagagagaatgctttttattatttgggttttgaggggctagcagccatctaagtagagatattctgaagagaaagtgttatctaagttaactaacttagttaaccctaactaaaagaggtagattatgagaaaagatggatgagtgcatcagcccttcagatgcatgagtataagaagaaaaaactatggccttaagatagttctttgagggacagcatatttaagagttacaaaaggtaatattgaggaaataaatgaagggagaagattgagccaagattataaattatagaagccaaagacatagaaagaaatcattttgagcgttttagggtaaaaaagcaaaaaagggctagaaggaaccctgcaggatcgtctcagtcagtattcaaattttgtgtattgggaaaaggagacctagaagacagatgtggtcgaagtaagcagagacaacgtgtagaagaaataggacttcaagtgccccttcacctctgctatgctgcctcagtgggggacttgtccagtcatctcttgcaaatgtcatgatttaagcaaagaacagctaaatttgtagagggccaggctgacacaaactggcttttgtaaatccattgccaagagtaagggagaaggcgatattaaaatctctatcactgcttcagctgtaaacagggtggtcagctgaagaattaatggtttttcaaatttcagagcgacaccttgttgcctactaagtatcagaatcacgtgcataagagggcattcagatacacagctacacaattatgtaatggttttcaacttggtccttaatatggagggaaaattctagggatgtctgccaaattaaaataattaaaattgaacctagacttaattgatttaaaaaaagaaagaaagaaagaaactgaagaatccttcactctgtcctaaactgagaggccagtttgctttacaccttgaccagctttcttcagaatgacagtaaaaggacttggtcaatgccatggtacaaaagatgtgccatgccttgcttactagatatttttaaattgcttcttttctttaggaagacctcctaagtttcacctaagtaaagaccgtaaacttgagcccatgcaaactacaactgtaagatcgtgcaggggatggaggttctgtgcaattgtgacatgttaaacggggctcccctgcataatgtgatccctgtctttaggaatagcgctttgctcccatgttaatacattctggaaattgctcaagaggcagctttggcattagaatagcaactttcaaagcagtgaacgtcagcacttctatttctccttctttttggcgtgcattacatgaagctggaaggactaattggctaaatgaagggactcagtgtcgcagagttgaaatcctggcatgtaaatggagaggtggggagagactttgcatgcatatctatatggcctccctttgtgaattatcataatagaaatggttctgccccttctctagtttccctgcgagatgagttggggtgtgaagtgcatggcacagaaattcaccatgctttgtatctatgattacttgtgtctgtgtgcatcttttccactcctaaattgcatgtttacccaaagttgctgaataatacattgtttcaaaagatgtgtccctgaattaaggttgttatgtgacaattataatatgaccgtgtacagctgctaacaactgtaaagaaaaataaaatcagtaagtggcattttcaaaagcaaacaaggaaatcgcttatttgttttataggtgttagatttacttccttgacctctgccaagcattgataaagactggtcaataatgggatcaaacagttcacatgaggttggttccctatgaccgtagtcaacttagcatgtgggatggctcagtcattgaatcatacacatacattttatgaaagagtatttcaagataagctctacagatcatttttaacttttatgagaagccaaagcctagaactcttctggttcacctgtcctgccctctagtagcatgttaactaaattgtcacagataaatagggatcaaatgtatttcataaaacttacactgggacatcagagtatttcatatgaggatttaacatctcctgaagtatgtaataattttataactcaactcaatccctcatacttcataaaccccctttttaaatgtttaatctgagttataggtaaggaacatctattaacacatcatcttactaatgaccattatcaaattatctctttaatattttgggcaaacaaggaaggaaggttctttggcctttgctctgaacccttgctaagctttccccatttccattaagtatggaactttgaattccaaggtataaaacacagggtgaatgtaagtcatccacttctttgttaacttttgttaacttctttgttaacttttataagcattttatttgtaaagcacattttatgcttagttaagtctatgagagctgagcctgacacaccagagtgatgttctgtagtataaactccttacagactaataattgttgatcagtgagaaagtcatttgagctcactaggtaccattgtacaaaattttgtggttaaagagtgttccatggaagcttgacagtgaaagagggagttagtggctcaactgaaagctcagtgaagtttagacattggttaaatcaaatttgagaatgccatatttgatttaaagattaaatattaaaatgttgccctttgattatgggagaaaagggcttgcctggggaagaacatgggtagagctaggcccttactgccaaatgatggaaaataccctttccatgttgccttctacccaggaggggtgaagtagactttgactactttgccaatcattggtcatgctgctgtaaaggtaaaggtgactgacccaaaatatatataacaccatttttttcagtagcttatgatataatttcatctcatccatcaataaataagaacacacaggtgtcattctccccaaatgagaaatggaaaaattgaggctctgtaaggttcagtaccttgcttagtgttacctaaataatcagcggttacatcaaaaccagaactaagtttgatgtctagaagctacagaatataattttcaggaccaagtggaacaagttatgttcagtttgattttaatgcatttcagaatctggacaacatcttacaaaatgtctgattatatcctattttttctgtagatttctagaaagggaattacaattgggggtgcagggtaaatctattttctgacagtggtatgcctttgctcttacaatcttatcagctgaattgagggaaaattcatattccatgtcaaattcatgtaaggcgggtaatgtccggttgcagtatattcacaaaatatactttcttgctgtgtgttcataaagtcctacttcacagccacaaggtttgtagatctttgacacaagagaagtggcagcaacaactccaaaggggactgtgtcctttgttgtctaagagtggcttctaggtgagctttgaatcccattgtgagaattccaggagtgtggaacaaaataggaaagctatagactgagcagacgatgtagtggtctaagtaaaatgtagttagtctttcatttctcttcattttaccctctatcatgccgtagtgagacagaagagctgatttaaatagtgaaagaattcttctaaacttcatctacttgtgtgttcaacagggctggagggaggctataaaagaaagtcatggaacagagctatacttgtgcttggttcatgccttgtagcagattagtctttggggccattccatgggagattgcactaagatacagcccgaaacaaagtgatgttgagtgagagggagagacagggtggtgtcaaccagatgagggacactggaggagagggaatattttccctgaaaggctcaccacccacgcagagttaaaaaaaaaaaaaaaatctgtagtcttaaaatgactttaatgtcttattttttccttcaccaggaaattaacattcagaaagttatgtttttgaatgtgtcctgatgtatgtctaaatcaggagtacatttttatggctaggttataaacccatcataatagtgaggggttaaaatggaatgccttcaaaagataacctatacctactgcaggcttgaaactcgattagcccagctattaaaaccaggaggacaaactgtttcttccctggattcaaaagctgttaggctacggcatgacccagtacaaaagttttctgaatctctctccactttacaaaacgtcggctcattgctgccgtctgcagtgaagctgtttacagctctgtgctaagtggaaagttcaaatcaattattgtccattagagtttaggtataactgatgaaatatccccagaggagtattgtaaatgtatcaagacgtccttccccattatagaaatggggacgcatagtgaattacttaccttctctcttacccttaatgcctctgaaaggctgctgggcagacagagctcatcttgtcttgctgggctttaaagtgagaactttaccatttggtgaacatgcatagtgagctggcaaaaagtaaatttcaactctctagactatcctgtggacataaaggtctaagaaacaaaagataggaaaagccctaagaattgattaaagccaaaacccacaagttccctggtaatcaagatattttagaaatataagcttcttattaacaatcaaatgagaaaagctttgactccaagtctttagcaaatgatggtatggtttaatgccaaataatttgtgctagggtgctttctttcataaaactggttctctagatttgtctgtatctggcttcagcaggacagaaaaggagacccactgacttctcaagtgcaagagagatagttctaattttccagaatctgttattcagttatagagtctaatagtgacttccacctcataaaggccagaactgagaggaagaagagggtcttatttgtaatcttctataacatgagatggaatagaaggcattttacttccttttagagttgtctttacttattccctttccctagttgtgccccagagcaatccctgtgccctagagaccctaaggctgaaatgcacagggacttgtcttgacatgggaaagactggatagtattcttcagagtgctatgatttttcaaaaaccagagaagtgtcagacaaaagtcaaggagacatcattctcctgtatcaacctttccttcctgtatgtgcacaggcgggcaagacacctttttattcgttcagctccaatgggtgccctacagggaagcactggaacataattccaacccagactgccagtcgcaatggggataagaagcatctttaaaatgcaacactgatttctttgtgtttctttaacaccaaggataactccaaggatgtttctttctgctgacagctctgtccgtggtgctaagtaggaaattggctgtatttcctccttttggcccatactgcttacccccagctctcctgggcttccccatatctatctatagagatgctaattgctatacagtaaatctagttgagatgaaaacaatgcttccaggatatttatcaagttagattttcttctagatcactcaggtaatgagagttttcatgttgctttgtagctctatctagataagtctgttgctctttttaagtttacaaggagaagtccattgggacctacctttcattactaaaccaatacttttttaccaaattatgtactgtaaaaactgtcactaactcagagagcgatctgggccatgcccacccagttcccctcccctcaagtgtacatctactcacatatcaccagcttcgaacaatttatgatatttaaagatttagccaatttatttcccacattcataataagggccattgccctggtgcactcagcatgcacacggtatgtttctcttctttcggatttcatttattctctttggtatgtcagttgttttggcaacgtagattgtataattgtttcctcttggtgttttaggagaattattttatatgctaagtgtgagactaaaacttagtgattaaagtctaaatcctgtaaaataattaaaattatacaaagaggatggccttcagatttgtcctgtgtcttaatgacaaaatgccaaagaactgtacaggtccctatctttcttcattgggagtacagcatctgggtgctacacttgaaaagcagcctcaatgtgacagcattaaatatatacccacagtaccaaatgtgtgtttagagttattttcctgccctattactatgtgtttagtcagtcctttctcaaatcagcttccctgttctgaaacccattttgcttgccctcttctgactaccagccagcacacccatagactgctaatacgcttgctcagagttaaggagcagtcctggttttcaagtttcttgtagccattatttgtgttccaaattatgttactgtgtctgtattaattttatgtttctgaaagtgaactccgtgtatttcaaggcagcacggtttcttttttgtattttccagggaactggtgtttttaatgtcatgtgaggacaacattacacaatggatctttggcagggatacacagaaatgaataccgtgtgcgaacaaacattaaatggcagtcttaattacagagtttgattctgttgtttttaatgcccttcaattttataatttgatggaaaatgcatcaacacagctattttctttctaccctaaatgattaaagattgatatacccccaaaccagtagcttgttagatctggttaatcaggtaggtcttacatttcatccactagagggcagtagggatacacatccacagcaaccaatatgtgcaacatatggtcgatgtggaaacatagtagccatagctttcctgtgtatgaaaaattcccattacagtgttgcttcacttataattatattgaaagtaaacactaattcacagacggactacgcatattttatttcaacataccccactagtgttttgtctattctactttaaaatgccctgagtaatgaaacttctactacttcccttgggaaactgtatcaaaacccaactgttctcactgcttgatttttttttttttaatatactcaagatctattagtctttcttctagttcatttataactctattgaaatctattccattttttcttatgataaggctagtttcattctggaaagcaaatgtttattgagagcctattgtgtgtaagatatcactaagtgaatgtatggccacaactgacaagggttgcaatacagaatttgaataaatttgcatgactcagaaagctaaagaagaaactctcccaggtcaaatgtcagaagaaaagttggtctcagttctaaaatgagtaatagccataaggctgtcacagcttggggaaatgtttagttgtacttagatttctgtattgaaattcaaagggcatcaggaatgcttggtaacatcagataacacctaaagaattgtgaggtatgcagctaacacatcagtgggttcatgccaagcaaatgacctggaagtttactaatcaaggttgatccttcttcctttcacagctgatggccagattagcctagaagtttcagaatctatactgagaatcattatatgcatttatgaaggataggaaatgggttagtgaatttacccaaggtgggcgtaccttgattatgttgcattgtctattttctatcatcgactttttgggtccaatcttggtcactacacacactacacaatgggaaagcgatccaagttcatgtgcaatactctggtttgcatcattagtttcttggcatatactttgattattaagtatctgaaggggagggtagaagaaatccaagccaagaaagttcctttaaggctagaactcacaattacacacttgtttaaaagtccttttttcctttacattaaagacagagcaagattttttgctctattgagtatattcatctggaaggatttccataaggctgtcctgatcactaagagcaattcccagatagacgtgtatgcaaacaagaactgttcagactccaagagcaaaaattgaacactgcagaaattccagaaatgatactaccttttatattaacgtcctttgagcctctgtaggaagtaaactattctccagagtttttgaaataaagcactttcttttgccaattaagagcgcaagaatgtggtttcatagactgtggtttcattttcttaaggaaaatagtagggacggttacagaatcttcgtggaagtctacacaataccataacccaggtttctatcacaaacaaagcttagatttgaaatttatgtcacctgtaataaagtccacatgagtgttttctgtggaagtaattaagtgcaaatgtgcaacagccatttttgtgtttttgtttgtttcaaaataccagaggtgattaggccatattatgaactaattacttacttaatttatttaagttgaaacgagtttttgagttatacgagggccagaaacaagaactcgttaatccattctgcacatcactgaaaagaacaaaacaaagaagttaacgcctttattttattatgttacaacacactaatattttgaacactgatgaggacccaagtggtcaaaacatctgtatttggtaagaaaataaaacaaactctttttttccaccaccatttggttctttcagtggtgtgctgaaattcagaatgaatcaccaaaggtattaaaatggtgtgtcctttttagtacattttcctatggcatttaaaagattcttcaaacatatttgaaaatagtaaataaatgacctacaaaactcaatattttcttaaatttggaagtaaaccacattcattcctgggcttgggactctatacaccaagtttcaaaccggagcatattttggtattttgatagttgagttataaccccctgaaaagagggactgattatgtgcagtaaggacagctgcccatggagctgcaactgagctgctaaaataaagctagtgtttacctgtcgctgctgaccaagagatgtgagactcagtagatctgttctgtagaccctaagagaagctctgtcagcactctgcgattgagtttcaccgtctgcgtctatacttagccagcttctagaaggggagaaagtgggggatacaatacactcatggaagcaaaaccaaaacaaaacaaaaccctgtatgttgcaagcaaattgaaaatgtcagagaatatttatgatccaaggttacttgttctaatgtttgattctttatcttccaggttctaatccctctatttagttagttgttttttttttttttaagtattgctaaggaattgaaattatcatatgtctgaccacaatgatcaggtggttgatattattaagtgtctcaatttttattttcacaagttcttttatgacttgattctcattatctaaagcaaaattctggcatgtgattgccacctaaatccctgggtgtaccatacgtgggcaaattctatgctcaactatagtatttacaaagaggtagtggctcaatctgtaatactggctaagtcatttcccacccctgtaggagatggggtgactgcaatggaagcagacttctgtttttccatgtgaaaagtgaagaggaaaaaaatatctgtaattttcatatcccaactgaatgttgtagggatttgatgagctatttatgcaatcttaaaatcagggaattctctcaggattggttatctcttttgggaagaggctactggcaagaacactttcaggtgattcaaagagtctgaatagtaagattgttcttgtagcacaactactatatggtgataccactgactcaatgtcagtgagacccacgttttaagttatttcgcccaggagttcagatgcattagtatcaagccccgtgctctctcttggccccactccatttaaccctaaattagaatccttgactatgaaatagagtttttctctattccaagacatttattcattgagcaaatatttattaagtactatgtgcaaagtattatatcaggccatctgatttatatgaaaactgaatctctaatgttaaccttattaaacctatgttctaaccgagtaagccagccaaacaagacacaaaatcagaactttagatttgaaaggagtcccacactttacaggtgaaggcatttaggcctagacagtgtagtgattttgtaccacccaacacatcaaatttgtatcaagagccagaagcagagttcaaagctgctggtcatcagtcgaagatgtcttccatccctatatgccccttcatcaagtttttctctgaatctagacagtcatttctgacatttttctcttactctctttcttctttggcactgatagttcctttagttcagttaacaatgacctagctttaccaggttcagcagtgccacatccctatgccttgtttgcagcgagattgtcacattggtgttgagggaatgtaaggaaattctgcttagaggattattttgaccttgtcctaatgatatcaaaccacattgatttttcattagtcagtgagagtcactatttggtcactatttgggtggtccctagccaagggaacatttgtgaaagctatgagttgccagtgttacagaaacccattacatctgtggttaaaatcctgggtgggtgcgggggggcggcagagaaaggggagcaaaaatatacaaaaggaaagggaagagaaccccagagaaaggagtatagatgactttacttttacctagacttttaataaaactcacaaatagctcctattcacatgtaaacatatataataattttatataaaatatatagtattttatatactatcatatagcattttatattttatatattttataattatattttatatattttatataaatatatagtattttatgtattcgttgtttcatataaaaataacttttcccatttcacaaggatagaaattaagatacaggtattttgtattatatttcaaggccacaaataattttggaaggtttgttacttttgttatgagggacacagagctcctaagatatgttatcacagcctttaggctagcaacactcttgcattacacaatctcctattactaaacttaaattttcttcaaaatgtggagaaacaaagctcattcagattaaattagagtctgggaaagtaaactccggattcttctctaatgtttcttctcctcatcgtgcttctcccccaacccagctatttcttgtgtttctcatcttccattttgatatcccattcaacattagagtcaccaaagcaaggaggttgttggaattcatcatattcattcacttcttggatattacttctattgtagtacctgagtttagattaggaaaactaagaatgagtctttagattagttgatagagaagagtttctgttaatatacattatagtctgaggtactctataataatccatagcagcatgccttttacctcctcgtgatctgtttgcttcttttgttccctcttaatgagagctggagacatctttaatgtaaagccatagatgagcacatgatttgatgacaagaagctactgcacacacagtttagatatcaaggcaaatgaagagcaagacttcatatcgctttaacaggttaaattagtcatcttaagctgttaatacatcaggctactgggcagaaaacagcagcagtgtggtagcagagcttcagaagtagataatcctaaattcaaatcccaaatctgccatttaccagctgtgtgacctttgttaatttacttttcgtctctgaacttccctgatccttacttctctcatctgtaatatggagatgataatagttgctgcagagaaggagtggcataatacagcttaggtaatgtgacatatgtgactgcaggttcaagaatttgtgcaccttctggccccagcaggcttaatatcagcactatagttagtccctactttcttacaagcatgtgattataagaaaagcccctctggttcaggcttatggtcctttcagttcagcattcattttctgatcacagggacaggaaactgttatataagacacaattgtccttgttgctaacttaaagaattagagttattttcctccagatagcctagtttctctgaataacccactatggacttatccatgaatttagctaaacctttgtgatactatttatgtcatcgacctttaatgaattttataagttgattgcctactgtgtaaagtagttctttagtttgtcataaattgtttcttttgaaaagtagtaagatgacttccagttcacgtatactagaatttgaaaaagaaatccatagtcagtttcccagaccttttgtttctttatagacatttaccatatccttgcctggattttatcattataaatagaaatcttcatcttatgtcatgattattttaattaatactgaacgttctcctattctttttatttatttattttttgaagtacttcatccagaaagtatcccacccatgagttgccgttaccttttactagagctgatcgtaatttaactctccccttcctctatcaaaattacactctatgctctgggctcaaaacagaatgatcttagtgtgactgcaattgtatttaagccaaagttcagcttagaaacagctggcaaaatgttcaacaaactggaccatagaggaagaatcataacaaaaagatgtgattccgtttgtagcaaagggagaaacttgtcttaaggaaaagctagagactgaagtttttgctcattttggatatcctaaagaagaagtagaaggcgatgttttctgagccaatttgttccactaaaagtgaccagaatcaagtctaggttgggctggctgccctaggttgcagttagaggttggggctactgttttgacaatggcagcagaaatctgtgaccaaaaaaagcctaaaactgcttgcctctgtgctagcatcgctagcatgaagtaagatttgaactttaaatgactcattatgagtgggtggcaacctactgtggagttagtctatgaacccaaggtcagcatcccggtgagaaatcccttcaggtttgagtgagcgatacacccagtcacactgagatgggagatccttgtcctcttcagctttgtcagagcattccctgctttgtttccaatcctatttctgaggatatttggcacactgcttggctcacacttggcaccactgtcttcagaaaataaatgtcttacatttgtacagtgctttatagaacactttcacatagattgtctcagttgatcctcacaactctatggtaactgttcatgttcccattttatggatgaggaaaactgattgaattacttgtgcaaatggtgttagtaagttgtagagcagggactggccttatgatactaagtctatgtcctttccatgtcaccgccacaaagatagccaggtcatttctggacatcttcctgaaaatataccttgtttcattttcccctgaatgtactgcattatacttgcttgtactgaagttgccctgacctcttgtggatgacagcaagcctcatgagatcatcctgcagacttcgccttttaataccccgaatactaataacacaatgttctacaacttccatatcatgtggagatgttccgtaagcctagcaccaaccttgcatctggacattcagtctcagaagaggtcatttatcccaaacttttcttctttttgtaaactttccatattaaaatcgtccttccactccttaatttaaatgtgcttcaatattattttaacaaactcagtagcatctgtaccttacatctttctgtacccttccctcccttgtgagggaagaatccctgaatgatcctagtaagttctgaaaagccttagcagggtagataatgggtaaagatcattgtatttcagctccctgatccattacacccctgcctttcaccagcatgcagagcgttgtgtttttttctaacagaataaattaaatatgaaagagaaggactaatgtaattcaaataaacatgttaatgaccctatttttccatttggtaactagaccggatgtggtggaatgccagttttttactgagcctgtaatttaaaactttcaacaaggacactttttttcccttttatttccatcctccattcccacccgcttttattcttacagacactccttactgtccaattagttttggaacatgaaaactgtcctcactgatgcctggagccatgggggacctgggatggtttctctctgtggaatggcttgtaagaatccagttttactggtgatgaccctgccagagctctgtgctgttgaagggtgtggggaaggaggtgactggtgcatcctgcacctcctctgcacccccactttgtgtatttttgatattttgcatgtacatgtttgctgttctaggcagcacttcagcattcagatttgggaatagaagagctctcagtttgcttttaaccctgtaagtagccatccatcccagctacattttttatgagtcaaagccatgttttaagagcttgttatcatccaaactaaaaccctcactaactcgatgtgtccctggatgactccctagtttatttcttcccttccctccactaagtcagttgtctccctatgcaccccaggagtagccattttccacagcggccaccacctctcctccagaaaatgggcggctcaaaatggagcccttcctctcctccggacctcaaatctgccacctgtctgctccattcatcattagttagctatagagcctgatttttctccaaactgtatgtatttaatccctgatttcttcctcacccccacgatgtgacatcctttcagcattttacctgctggaaccagcgctctcttgtttcttttactgtggtcacttgctagagtttgaaggaaaactttttgatgtgaacacatttcagtttttttccaatttacactggagagaggaatgaaggggagagggggctctggccctgttacttcctgtttgtttttgttctggagaatgcagaccatctgtgtctctcagaagctattcttctacagccaccgtgctgaggctgatatttaatttcttagtttttccctcgtttctctctaatgtccttttcctcttccaaaaactcctaagcccctcattaaatctttcttcctgaattttcttatcttaatagtacctctggatacggttctgtccccattaaggccagaatttcaaattaagtaaatgataattggagagagaaaacaggagagaagggaacaaggaatcagtaagcaaacagaaaaaaaaaaagtgggttgactttttaaacatggagttcgctgattctcagagccacttcccatgtcctggcatccattgttcagctgatgtctcacctgttagatggaccttgtctttctcagaagaaacatctgctggatgttgggtctctctctgagttgcctgagaaggtccctccctaatttatttttcctgccacccagacttcgataaaggctatactttctcatgataatcaagatggttattttctagaactagtagagatattctccctcttctgagagctgcctgatgaatcccaacatatagtcaccctatataaaagtcctattttctttctgtttcttttacatgcaatttcactaaacaaagtctctaaacaactaggtcctctttcagtagataattctataacttatgaaatttcaagtgtttcataagaagcatctttctgaggcacatcttcatttcagatgtcattgcagtttaggacacaatatttccctcatttgtgttttttaaaaaacatagctttgatttttttttattcttaaggtcagaattaaaaagctaaatgaattccaggcttcaaactcccagaattatagctggttcaagcctaaaatgtgctatatcaactgtctacgggggaagtgccgagtagttgtggccttcgtggagtgttttttggagctctcgcctgtcccccacccccttccttcagctgcttctgtttgttcctgctgtagtgccttcagccatgaacataccgtttaatcagtggtgtattaaaatggacctgtacagtcagcaatagctaggccaaaatcgattggctatttttaaaaggaaaaaaggaagatagaaaattgctcttttaatctaggtaaatcaaatcgtgcctgcttgctttccacctgtagctaagtgtaggcaagagcattctgattgatgacagtgtttctttgtgcttctttattcatgcttatccacttggggtaaaagcaccagggtatcttcagaacggagttttcacattcacgtcagaaagcttgtgctctttttctctcagaaaaaaaaaaaaaaaaaaaaaaaaaaaagtcttccctttttccccctcttagaagatttgaataaaagcagagtacgttcaaccttttctgcctttttggttttttcctgccatgaaatcatatctgactgtgacatcacagtgtgttgctttgggcagctttgtgatgtatgaaggcgaggaccttaattgggttaacagagcacaccaggagcggacggcggacgagcgctgctctcccactaggcagttctttgctccaggcagtgtgagagaatcagagaccagctagagaggagctccttctcccggggatttttaactctgaggctttgtcttcttttagtgtattactaaccaatgaaagtaatttttaaaagaaaaagtatataaatgtgctttgtttttaaactgcaaaaaattgggggtgggggtggaatgtgctggcaggtttgttctgtagcattgatttgtgaccaacaaaggaaatgtctacttgtgagacacaaatcaatgcaaccagactgcgaaagtgcaaacagagatgtgagaaaattattcaatcgttagtcttctatggaatttaaaaacattgaatctttcgattgttccaatacaaaaaaaaaaatcactagaagaaaggaagggagggtatgaggacttgttctaatttcgtcaaaggttttctctcgtgattatggaaaggtccggcaaagctataagattcctaaacattagcaatgttgtgaatgattttcagaactcatcaaccatgtcctcagatgctgtcaacagcaaagttgtggaaaactggtagaagacaagtttatgcctgaacttctgctttagtctgcagtaaccttggctgctgtaaactgaagtttcttgcaaattctctgtatccagaaataatccataacaagcaaactcagtacttacatagtattttttatcatataagcatgctacaaaaattaacaaatagattacatgggtaaaaacgtaactctagaaagctaaagaagtttattttgtaaaatttcatcagttcaaataaactgggagacagacgactagaatgagctgaaaacgtgatcatggaatatttccatgtactttgaactgagatttctaagttttaacagatagagtttcttcagcactaacttcaaaataaataagaattttcagtaacttatcagatgtgtgtatgttaaagtagttaaagatgtttcccccccctcatataggttacatttggtttcccccatccttcctcccaacagttttaaggttattagtttgcttagaaatcctattttcagaggtaataaaaaggcaaatttcgatacaatccctatcctatcacagattgtgaattattctgacttctccttttggagaagaggaaaaaagatgatcagatgttacttctctgaacactgaaaattaatgtaaataacttcacagtttttaatgttttcccagtgtctagtcaggccagagttcccattagcagtccagggaagttttctaacttgactgtatatttttgcctccatcactatgatgaagtcagttaccaagactctctcaccttatcctaaaaatgtgctatttctttacttcccaattgtcattatgttagttacattgctggaggaaatcaagggagtgaaatataatggatcagagacctatcaagtaaagtaatcaagaatggatttctggacaaccctgtttaaaataagaagccttgcaataaaagtgcataaatgtttcactctgtgttacacaataatacctcaaaatccactttctggtagttcagatctctgagttacaaccctgagcaaagaagtaactgaagaccttcaagtgtccaaatgagtttcccccaaatcttctaccaaaccctgcattcaagcagtattgtctctacagttcttatttatttgattttctaatccaaagcacattagaaaatacatttagcagagaggatttagaggcgatgggtctgaaaaactgggacagtgacgccagttggctatggcagtggctagtgggctatagctcagtctgtggccgttaggctgagccaagggatgaggccagttctcaccacaagtaagaaaagtgtattcctgtaaaacaggaacaatgaatagtcacaaggatgaccctgtatcatagaaaaaaattaaattacatcaacatactgtgtttaagaaaacaaagatatgtaaaagttttctatgaaaaacatgtttagaatatattttactgcttaaaaaggcaagtttatgtcattaaaaaacattttaaaatatatggaacattttattcctcaatatagcttgcttttttatatcctttttcagtttgaaaaaatatagggattgttttgtagtagtgactctacaaacctgtctagccaaaactactcagtacaaacaccttagaaggagtacaaacaccttagaaggaaggatgtttattcttgaatattttaagtccaggtctcttaaaataaagatgttctttttcattgatcttagttatataatgtatgttgtcatctcgagtaaggcgcagttgctcatatttagctggtttactttgtaatgcgtcattataagtgaccaaaaacatggtacaggaagttgtttgtgtgttttttcattgcttatgcaacttccaagcagaaaatgttcttgagaccagatggtaaagaacagtcaattgcaagttctattctccagatgtattgatgtttcatgtcttcctgaagccagttcaaacacacttgtaaattcaagtcttaattttagtaactctttcacttctgctagatcctatttcaaatgataaagaattaggctagaatatttaataacaggatctctgaagcctgctgtactatagagtggcaatgccatggtcatataattcagtcggataaaagttcattacatgtgcttttggacgtatttggtcactgtgctacaatgacagctaagtgtttacagtaccaaacgtcttttcaactttatcctttccaaaagtgcactttgttaagacaattttaaaaaataacatttacccagtgtttctacttggcatgtagggtttttttttttaatctgctcagcaatttggaagtttgcttggaacacagatgagttaagataaaaagctgttttttaaaaaaaaatgcctctagtaagtaaaaatgaagatactatatctgaatgaatgtgaaaagttgtccctttgtatatttttaaagcttcctaaactatccccagttctcagccaaatgcagcctacccagattgtctttaggaaagtagcaattcacagagatttgcagttagccatgtatcaaactacactctctttagtccctgcttacagctccaccattttagaatatggtgagatatgccagagccctaccatctgtttaatgggctaattatgtttaccacatgcctacttcacaggaataccatgagtgaggttgccaaacatcatacaaatatatatgtttgtatatattgatatataaatatacacataaataaaattgtatacatatataaaagcattcagcatttctgagtttcattccatcttttactctcaagatatatcatggcccatcccttaaacccagccaggtgttgtcagagtttgtgaagctgttgatgataagaccgtcagactgagagggatcctctaactgagagatttggaggaagtgaaactcaaattgtatacacattcctatgtcttcgccatttagctatgccccatgttctctctactaaaatgtagacattttagcttcataattaatgcaattaaactttatgacactgtatgttgctatatccaatgactaaacttcttttaagaaacagaggatctcttctcctttattggaaaaaaaaagtcagactgttttaacacaattcctcccgtacatggctacaacttttctcttacataccacagcttctatattgggcttgttcttaaagctaggattttttttttcctcctatgaggacactgcaacccttgaaagtttttctctggtattctctgagtgcttcctagatacctggtttcagtgactccagttatcacaaggactaattttcacttgctatccatgaaaattttcgctgggtcaaactaagttgggtcaaactaagctgcttcttggaaatggggcttatgctagtcgtgagttgtgtccagagggaattctgagcagtaaaaggaggcaaactgagggcattctaggtgaagggaattaaaccagcagagaatcagggcacagatggaaaagagcgagtcatgggtaaccagagtgcctagtcaggatatgatataagctccgggtattgggttttctgtgtagctcctttgtttatgtaaagctagctcggcaggctctgggccttcttggctttgaggatgcactgacctgagagctatggggaaaaatagccacgtctgtacaccagactataaagccaatatgtaccattctctttgaaaatgaaagacaataacatatgaaactattattgatataagcttttatttagtcttttctaagataccagggtatttttatgacctgttttcttcccctcggcgttaggatgttttcttatactgcttcaactgaagtaaattattcaaacagagctgttttgttttatttgtttgtttttgtttttgcagctttatgcttaccagggacttcataaacaagttgaaagagaaaaaatagccaagacataaatatagaaataacccaatcacataagctttcatgagcatgggtgagggccttgtgggaaggatgaggaaaaatctttattagtaccagaatgatcgtgattaccttaggcataagtctgatttgagaagagacactgatatacaaagaaaggaaggattattcccctatgatttgtccatgtgtacaaggaaaaatagcttcagtatttactatttgacttcttgagtccagaaacctaatactcactgcaaactgcataggcacggagcaggagaaagcaagtatttaccaaaacaagaggaaagaggaattactctttcatctcttcttactttagaatcatcaaatgttattactggaaagaatcttaaaaaccatctaatctaacactcccacattatatatgagaaaaatgagactcgagagaagtttcatgacttgcccaaggtcacacaacagattacaaacgtggctggggacccacatatgataaataggtgcccttcatttcttcagtttctccataatcattttagagaattatttgacttatcccaccaatgttgttttgtatatctggattatcatctggcttctcagttaatttttttgaagtgaagtttgctttataataactgccagattctatagctgattctaaaaattaaaatgtgttctcagacatatcctgagtgttgtacaaatatggagacgctcactagatcaacatgtatgcctccttattttatatgaatcctataatacctataaacgtggcctgatcatattagactcttgaagtttctagagttccagatatttgttggagcatataaataggtgagagcagatttacgcatttacccactctgagtccctgagacgttcctgaactgctgtgcctttgtaagtcagttattcccactgctatcgatatcaccagttccaattattaccaatatggcccattactacagactgatttcttactaggttcaaaaccagctgtacttggtgttttactgatattttgttcagtgttagaggagaaagaacatggtgagagtctggcatagcccagctcccttctgtgaagaaagagtccatcactgacaatagacattcaataagtggttatttaaagaggtcgaaaaaagcatccaccatttctctatttcaaaataatcaatcatttaaaaatattaactacaagcttctgatgcaatgttgtgtggtttgttgtgccacatatggttatgatgatctacacgtcagctacaatccagaaatactctcattgttacaatgcaaaataatataatcatccacttttacattttaaatgtgtctggcccaccaagtccttgcttaggtgccagacacaccactgtgaaggaactgtctgacatagtaccctgaaatttcgggtaagtataatcatctcccagatgcatagaataagcctggtttttgaggcaaagagaagaggcaaacctcctgcccttccagaagtcagaaccattcagcaatatattcacagtagctaggggggaaagcctttgtgaagaaaactgttgtgtctcatggctgtttttattaaaacatttagtccaccagctttccaactctacgaacaatttaattcacaaagcacatgaaataagcagaagaatctagtcccaacagccatgttccacctctgtgatcctcgtcgtgagttaggatgatttagtcgtcaagatccctgctgttctgtgcttggatatttgtgaggaaaacctagaattcatcccctttagaagccatgtccatatggcatgcagcaaagaccattagagaacagtagtaggagttttgttatcaaatccagccagatttgcagataggaatactgagaaattagtatttttccttcctcttcttctctcttttcctttttagcctttttctttctcctgtttgcttcttcaattcaatactcctttgtttatggatttggagagtactccaaaagcaaataagccaatcaaatcctgtttggagggagaacagccattttgacatataaccatctcatcactcctttttatatgcctaaacaattgaagagcatgtagcatagccaggtgctggtcctcaaagtgggtgtgccctaaaacattctttggtttgaactagtctagtccactgtttcatgttactgaacaatcaaaagagaaaagaaagtttttcttctctggttctagaccaaatgactggcaggatgtgattgccatctgtaattttctgcgaagtccttccccagtccaatttacatgatatgtacagctacttcactctgagaatgcacactcaaaaaatacagcctttaagtgatttttcctagcatgggcaaggtgaagcagtgaggaaatggacgtatatatgttatacatttatattattattccccataaacttttaaacttcctatccagcatttgtatttgttctcaaacaaattggtagtttaaagaaaaacctacctttgtgatttttcaaaaatcatttttcagcctctcctattatttttttttatttcagtagccaccttaatgggtagctgagtggggatcaagtataaaaagacctcatcatgtattacaagccagagagtgtactcatgggaaaaatgtaagtcctcagatggaaagtcatctccgtcaaagaaagtggctcgggcaaaagtgcctgacattacatagtctgcatggtggaacactgcagccatgttttcagttgcctttcactctctggaattttatgaaatgatctcggccaagaacctttggaatatcactctctggtcaaacaaaaaagaggacaaaaaaaatcctttgaaagttgaagctagttggtacaagctagcagacaatccagtgaaattttcaccccactctgttttgggggtttggggtttttatgcagtataagagtgttagagaaggtgtctgtctggtatggattgggatactttcaaatactttaaagaagaattcttgttttctacagtttattaaactagctcagctaagtatattggttatcagatcccatgatgcatgattattcaatatattttaaaacacaaaaaaattcaattgtgctgtcccctttctccttctgtctcctccctgtctgtctcactgtgctgtgaagcattgggagtagtgtgtgtgtgtgtgtgtgtgtgtgtgtgtgtgtgtctgggaggtagacagattccctacctggaaatggcttgctattattagacgttcagttaccaggggttatgtaagacaattgaagctctgttttttaacagagacatgattcatgctgcttgtagtaacagtaaccacctccaaacgagacagaaaccagacacagacaaaggctggagaaatcaatgccgactcggtacagccattctcctgataccctctgcctttcaatcagagcacttaggttatcaggagaggaggctcctgctaattctggatcctttttgtctcttggggctgccaggtgaaatcatgtgggctggagctgtgtacaggagaaaacgggtcctcaggagcagtgacgtctgacctccttccctagggtcccccagtgtttcagacacacctggaggaacagtgattgtcacctgtgttgtggctcaggattcactgtggcttctactcagaaaggttggaacttgagcatttggctcacccactcaagtaactttcctcaagtgattctctgcagcgtgctgggagaggagaggatggagtgggatttgagctgctgccagtgctttattatagcttctcctaaaacctgaatggaagtggactggctgtcagttcccacacacattcgggaccctttcctaaatcttccagacaacattgattcagtactccacactatacaaagcacttccacatggatcagcttattttagcctcacaactttataagataggcaaagcatacattattgtcaataccattttacaagagagagattttacagcttacaagtattatgccattcattgattccttgctcatgactttataagtgagaacaataagactcacaaaagttagtgacttggccatggtcacacggctggttcttaccagatccaggaagacaaggcagatcttctgattctccatctagtgctctgccccagatttgctacaaagcttgttgacaaccatggcattttttggggaaaaaaagcattttctgctgaaaatcttggttttagattaagttctactactcattagctagcccgcttaaactgccctttccttcctcttcaccccatccacctcaatctcctcatctatgcaactcatgatagggagaactcatttttagagtgttcatgaaagtaccacataatctttaacatgtctaggtcaatatatataaagcattgccaatagtatctccctgcccccaccaagagtgaaatccagcaaagagatccagagatctcaggcttcacccagaacataaaagtaaactatttatttttactacaaaaagaagaaactcagatactttattgcagaaactgcccatggctctcagaaaatagcagtcttgccccggtggcctgttacacacccaataggcaggccacccttcattttcactctcacatgtgtaaattgcccagaaagacaattcttaagtattgacatgacaggaaaacatctaggccatttagcttcacccacccaataatctcctgcaataaaaattccaatttaaaaaatacttattattgattactactaataaccaacactctgatacactgttacgaattttaactgaagacggacacagaattttatatttatgaaattttaccattatccttctatttcacatgttaaataatacaagctatacctattttaaggtaaacacaagtaaacattcttatttataaaatagctttttattaaattttttgtttgtataccgctttatatccaggaaggtagcaaaatactccacaggttatactctaataaaatgcactttctcttctgctaaaatatgaaattgctgcagttttaagaaagaaagctatacttttctctctcacataataaaactccctgactaagcatcaagagaccaaacttctagtcgtaggcccactaaaaattcactgttagggaacctgctgagtcccaacttcagataacatctaatctgaaaaactcagggccccttaacatctagttattacacactagcccgagacaacctgccctgcgctgttgtatgttgtgtcaataaaagagctttatgggaaagatggaattcattatttggggttttatgttgtgccagtcgttgccaagctgccttgaattcaccaatgtattgtgtctccagactgattcaaagagatagaatttggaatgtgactagaaggcagtagcagattctgtaaatagttgctacacattctgtataccaggcacaatagcacacagtggaacctcagacaatacttaccctgacttccttaagtaggaaaatatcctttttcttttcatcaagttaccatgatttaatgattatgaatggtaattttaccattggtatattccagtgattcctttcatggatcacttgatgttcctagattattttaatcttatcgccatttggtgttaactaatgcaaattcttactttcacctaagaacggagctgcctttgctcttctgtatctagcctttatccacatccttagacacacatggtatcattttcagggcaatggcagtgatggcgggtagtgtttcttcccaatattgtgatggaacatttcacctgggctgttagcatcttaaactattccaatagctacagaaattgggttttaaaccatcatgtcttaatgccatccatttctgtttatattaaccgatgacatggttataacatcctactgtgctcaaaaagctggggtctctgtagtgtataaaacaaggttcctacccaagaggatgtacaccctcgctaataatatagcaaacaggcagtaaaccataaccatttattgaagtacttaaaaagtggcagaaaacattatgggctaaagcagtcttcacaagggaaaatttcataaaggatacatttttatatatggaccctgaaggagaaaaaagtcctatataattttttgaaaggtgataaaggtattccaagcagccaaactggtatatacagtagctcagagatagaaatgtgcttagtctttctgacaccctataagttaaccagtttagaccatgtggagtattaatggaaaggaaatctgagaggactcatttgatagggagtcagtgaatttccgagcccaggcttaagagtttggaaccaggggaatcccttaaagcatcttttcccgaagcatattctgaggttaaataagtgttccattaaaaagggggatgggggagtctgtaatccggtaagcctggacaaagattaggcttccagcaccttaatatcctgtgtacacttgcgagtttgaaaatagaatatatagttttcagtgtttcctaaacttacttgactgaggaactttttttgagatgcatcttgaagttccagtatgaaacacactttaagatacaccatctgaaaagatttttgaagggcaggagttgaatgcgggacaaaaaaaaaaaggtatgtggtgatgattaatctagtactattagaaattgatatgctatcagctacagagaaagtatccctgatgaaaccaaaggaagataaagagaagtagagagaataaccttcaagatacgaagggaacatgggaaaagatatatcctgaggaaataaaataatgaaaattcagagatattagaggagatgagagctaataagcttaccacactgcatggtgtagatccttttattaaactaggatgctagctcatcaactgaaaaagagaatgggacttcataaaggagaacaaactaagaaaaactgccataggttgtacctggaaacagtgggcaggagcataggtccaggtagcatgcatgtgtagccttttgttctgagagtgggagcaaatggagaatggtgatacagattcacagttgatgaatgtaaaaggaggcactgcacatagaaagttagaaaaggaaggaaatctgcatggttactgaggacagtgttgaaatggttgatcatggggcaagatcaaactggacaaatacatctggtaaggccaactggggcctactaatgaaccagctgaaaacaataggttccttgggcttctgggaaagtgagttcaatagctgggtgtggaacatctgatgtcaaatgtgaggcctcaaaagagtaatttagaaggagtatgagagctaagaaaaggggtgataaagtctgttgaaaagaagtgttaatgagtttttggattaaattattaatacagggagggaaaacataaatcaagtgtagaaggttttgagaaatttcaagaaatattcaagaagacatgagagagccatgaagaagaatctagcctaagccaatggtggggatcacaaatgaagaggagtggaatgaaggcagatcagtggtttggtgattgtgagcctggtataggttaagctctagaacatgtggttagaacctggcccttaactctgctttgctaccctctgccttcatgactgatgaccaataactgtacctttcctgagtatcagtttcacctccttcgtctataaaatgggaatataattcccaacttcaaagagtaattgtaagaaaataaagttatctgtgaaaaggctcaatgcctgccacacggtaagcatttagtcaataatagccaaagttactattgaagtgatgggagcaggaagagggaaatgatgttcactttgggaacagtgacagagtgtgttatctggagtaatgccactgtgatgtttctctgtacctttttttccatttaccacaaactataatggttaattcagaacacatactcactgtaagaggtaaggtataggaaactctgataataccaaataaaatgctgtgtcataaatcatgctcatgttagaattctcattacaaagtttaaaacgatcttattaacatgacctgtggcaggctttctggataagaaggttccagtatccggtgacataatagaggggttcccatcaccaggccagattcattaataccagaaattcatgattgtgtgtgtgggtgtgtgggtgtgtgtgtttacatgtactctgatccaaaagatctcttattttaaacaagaatcaactgtatctgataatgctaacgctcatggcatgggatgtgcaacttatattaacagagtttatgaactgtcaaagaggaatcaagaggtctctatggagaaaattaacatagatttaatgtgacaaacagtgggattgtgattccaccttgtgttggcagggccatcccaggggtcttcaagccatcagaggtgtttcttatggacatgggtattaactagtggttaattaaggaactaaaacctaaaaagtaaaatagttatcacagcatcagtaagctgacgatggtgttcctgattagtttatctggccgtgatgtctttggtgccttattcattaaatggttttctcaccactttccagagaggtggggctggtgacgtagacttgggaatttgtttcgggtaattagctaaaaagttaaaagtcaaatagacttccttaacatgtttaatggtttaacaggttgatgagctacttaattcccacatcttccttctcaggggactattagagttttaagggaccttaaaaatcataaaaccaacctcctctttttgcagatagaaaagctgagccacctagaggttaaatgtctcatcggaggtcatcagctagtcctgattttgctttctcttttcttatcttacactttctaactcttttttttctaacattgtattccccacaatgacctctctgctaaatatttcttagatgtatcctttttatgaaatttgctgtgcctcaaattatgatagtgggcctttgccaattagtaacccgtccccactaactcaccactacatttggggcaaagaaacgagggaagtggaacaattttaaatttactatgatctttgagacagctttatcttcacctgggaattgctgttagacaattaaggttagtaaagctcattgaatttctcagagggaaggtgttatttgaattattaccagataattattgttaaaaataacaataatgtaaaaaaataggaactttacatgttagagacattatcattttgaatttccagagagaggggaaaacccttggggatctaaaaacaattttttgacagtgtgctctatgctaagaactccttgaattctgtgtaatgcctgatgacctgacaaactggcctagaatcagaagccagtcggctggctgtgtgaactgttagccaagttatttggcttgaactgctccttcaaaaacaaccctagtagaaaggagagtgtcagaaataagacctgtggtcccagaccagtagcatcagcatcacctgggagcttctcagaaatgcaggatcacaagctccaccccagacatgctgaatcagaagccctgggtgattcgtttgttcattagagtttgagaagactgttagaggacattctcatctgcaattagaaaggaggagggaagggactatacttattggcagtttctgaaatagttccttctcctggagtctgtgctcccagatctttccagtggctctgaaccatcgtggaaataagcatcttccttgtactgtgatcacagcgggaactagaaatgtgtcccgtgtccatgctgcattggaacagttgttatatagtgaaaagagtacagatttagactcagagagatctgggtttggattctggcctcactatccagtagctttctaaacttcgacctgttacgtaagcccattaagtctcacttttccttatctgtaaaatgggtatactaaaacatacaccatagcattgctatgagggttaaacaagaacatactcatttataaaaatgcctggtgcagtccctgataaaatttagacatccaataaatgctagctgttattgttactattacctttcttgtaaactttaatcatgaaccccccatctataattttagaacgatgtggtgtgatttcctaggactgggacaggccatactcaaagtagacatctgcagaaagttccttacattgatatgtggcagtgtatttcataacagctctgctctctaagggcttccaagacagatctgcagaaacgccaacaatgaaacgggctgtagagaagtgacctactgtctgttcgcctctgacaccatcaagaaacttgccagccgggttccaagagcagattctttattacagtgatgatgtaagaagcagagacaacagctggattttcaggttctagggagaatttgtggcatcagcagcccctcaaaattatcttttgacttaaaaaccgagtacactggatatgaaagtcattaaaagagaataaatgtgaaaccccatgaagtcattctcaccgaatcttttttagagtgtaaccaccctttaagcaataaaacatgacacaccatgcagtggttctgattaatagacgctcaggtgtgtactaaggcaaaaggggaaagaagatggagctaggtgacactttgccaaaaatgaaagtaagattatagcagcaggatgtgggactgagaaagaaggatttaattaaaggacagacatactatggttgtattaattataaaatgcacaatgtaaatcagattttagatatatttaaaatgtacatttatataattacacaaaggatttgtaaatttgccagataatttttcactgcaatgtactattgatgagtgatttcctttatgattttaatgtagttgccagggggcaaaaggagaagtaagttctatctggtgaagtgtcaataatctgtccagccttatgatgggttagaaagaacaatgaagagctcttgagcccattttgctgtttgtgtggctgctggggtgatgctatttaatggatgtctcaatgcgtagcatggctccaccatactggccaaaaagagtttgattaatgctacctaccaaggttttcctctggtgagtaacagtgagtcaagcgctcacctgggagatgcagatgaggtcttgtagtattggagctaacatttaagagctgagcttttctggccaagtaataattactgagattccctggaaaagtctgttttcctcacctaggtaaacactattatccccacagcatgttttgttgggcttttcatctttgggtgagagaaaatgattctgtttgaggataaggatagagaagagaaacaactaatgtttcctctactacaagagaagaacaaggcaagaaaatttgaacagactcagaggcaattgtctatgcatttctacaagtaaattagtaatataaggaaagaaaaacaagtaaacatttaaacaaacctagagaatgagtactaggctaagctaggtggaaaaagaagtgttaatgtggcataatagcagattgccaatagtttgtttctacaaagtaatgaatttaaccatggaattactgcatgttttcaccaagaactccagctgaacacacagcttttccaaagcatgagaaatttctttattcttattttcagcctgagtttatcaccccagtggtatttttaacattttatttgtttttaatttttgtgggtacatagtaggtgtatatatttctggggtacatgagatgttttgatataggcatgccgtgtgaaataatcccatcatggagaacggggcatatatcctcttaagcatttatcttttgtgttacaaacaatccaattaccctcttttagttattttaaaatgtacgattaagttattattgactatagtcactctgttgtgctatcaaatagtaggtcgtattcattctttctattttttgtacccattaaccatccgcacctcctccccagtggtgttgacagtattgtcataattatttctgctggtaatgttagaaaactttgcttccttgttttttaaatccaccctcattttttagacaacatttaactataaaacatatttattagttcggtttgttgaagcaaataaatgaagcaaatttgttatattttggaacacaatatatttttgcaggttacacaccccaacctccctctctctggtcttgtcattactgatgatctgttgggcctattggtgccaagtaagcactgataaatattagtctgtggccttttatgtctgttatccttgcccagccactaacaaggatgcgaccttgagcaagtcagttcccttcatctcttcgtctgaaaaatgagggggttgaagcagatgagcttttaggtcttttcaatttagtccccgtttctatgactcaaggcaagagggtttattctttttaaattcagttcagcagattatcagcctagtgcaaacttaacgtgcaagaagtcatggcccactatagggtactcagagtaaaaattgtctcagctttcaaagggcttatgaagaaggaagacaaattacacaaataaccattctaattggtagaatatgcaaagggagtagtacagaatgtgctaataatatttaagaagggcactctcctttgtgaaatgcttcataaatgaggtggcatttggatggcccttgaagaagctacatgtagacattgaaagaaaggaagaaataccatgaacatggtaggaaagagtaggactttgctggagcgtagaatggagtgtagagataagagtgagaaactagattgggctacattgtagcagctttgaataccaaactgagaagtttgaatttaatccaataagcaaggaggactgtaagcaaagaagtgatatgtttagaagggcactttagaaaaattaatgtaatgtttgtgtgaaggatggacaagaggtaaagaaaaactggaaaagtgaaaccagtcaggagcttttcatagatgtcctcacagtaggtagcaaagggagaaataggggctggtatagaaaacaggtattgattcaggaatcacaatcagagtagaatctacaggattgggtagctaattggatataggaagaaaaaaaaaacggaagaattgaagatgactccccagctgtaggcccacgtaactggatgaagagaataccaatggcaggaaatgggacgtctagagaaggaacagattttaaaggaaagacaatgaattaagttctaaactttctgaattagaaaagcctgtgtagtatttgatggcgatgtgaacttctcaaagttagagaccctgttgtattcatccaggtgcctcatagatgctatataaacactgaatgaatggacaaaggaacgaatgaaccaataaccagctgttatttagaatgtgggtgtgcagctctgtagaaaagctagaactaaagatagcaatgtggatgctctccatggagaagtgattgttgaggtcagggaggactggggtagacaaagcctgaggagaggatctagaggaatgtctacatttagagaacagaagaaagaaaataagccagtgaagaaggcagaatagcagactgaggtataggggaaaaaatagggtaattcggtgtcctcagggttagagcctatggaagaaaatggagcctttgcagtgaaggacagagggaatgctcagaacatgcccagatcaatgggtgtcactagaatacattaagaactaagcaataaagagagagactgaaatgaaatcaagaatatcagaaatgtggtaaaagtacacaatggaacactattcagccttcaaaaagaaggaaatcttgtcatttgcaagaacatggatgaatctagaggtcatccatgatatatggggaaaaaataggcttttttttgtactagaaaagccaggcacagaaaaacaaataccacgtgacctcacttatatggggaatctataaaagcttaatttatagaagcaaaaattagaatggtggctgccagacgctgaggagacatcagtcaaaggacacaaaatttcggttagacaggaggaataactccagagatgtactgtacatcctcatgactatcgttaataagaatgtagtatatattgaaaattactgagagtaggttttacgtgttctcaccgtgaaaaagtgataaatacatgaggtaattcttttttttttttttttttttttgagatggactcttgctctgttgccaggctggagtgcagtggtgcaatctcggctcactgcaacctccgcctcccgggttcaagcgattcccctgcctcagcctcctgagtagctgggactacaggcgtgcgccatcacgcctggctaattttttgcattttagtagagacggggtttcactgtgttggctgggatggtctcgatctcctgacctcgtgatcctcacacctcggcctcccaaagtgctgggattacaggtgtgagccagcacacccagccggtaatgcatattttaattagtttgatttagccattccacaatgtatacatgtatcaaaacatgttttataccataaatatatacaatttttatgtgtgaataaaaaataaataaatataataaatgaaaaaaaaaagaaaaggatactagaagaatcaactgtgggaaggttgaaggacactgtttctacttccttcccccactgtcacccacaactcagcttctaagtcagaaccacaaaatcagctccgcccgcactgacagggtactgttgatgtcccaggctgcacaggcagttaggtgaaagcactgaaaatggagcctggacaacatcctctccattctcccttccgtacctcgccattctctggtgcaaagatgtagaaccaaacaaccaacctctcactcaagtcccaaagttctttcctatcaaaataaataattgccatcaccatcacctgttcatttaacaaccttatttttgttttttgtctgatctagatgcagccgctctctgctccctgccccaatgaacatctgcactaggcccaagccttggagtaatttacctgaagagtgacaccattgattttgaaactactgtgagtacattatgtctccaataaaaggcttcttagttcactttgtttaatacacacacacacacacagaaaattgtgaaagcaggcaaaattttagatggcttcatttcttggatcagcagggtaaccagactcagtcctgaggtgcccacagcggttctcaacttcccggctgcagtgcacaccatgtgcattatcattccctcctggccagatggctgtgctgagctgtatctgagcacaccttgcagggactggtgctgttctgcttggtcatctgtgcctctatgtacggtggtggcagcttctcctaatctgtttgcttctcatcatccttccgtgccactgttgaatctcatggtagcttgtcatttcttgccaccctggtcaaatctgtgaccagcagctttgcttggttttatttacctgttgtctgagctgcaacccatgctgttgtctccttgctgcccttcccttggagctctggcctccttccaccacatctctaagccacttgtatccagctcacctctgctctctggatgtatgggtctgtgtagttgatttagttcccgccatgcaaggcatttatgtaggagaagtagagaccttgcaaggaaaagtacagaaataatttggggtaggggatatgatacctatgggaaaatactgatgaaagtttgatatcaagtattcattaatcattgctgaaataacagatgaatatatgctattttccaatagaaaagccagtcatttgaattatttagaagttctgcatgcaaagtaacttaattacacattttaaaacaataactagttgttatattcacaagttttcctatatgttatgaggcaggtaatgggatggtgttttacagacttctatgttactggaaaacgctaaacctgggagactaacatccctcttaggcttcaggtaggatatttacattcatatttctatgtctttagctattctggtataaatcaaacctaaagggatgaagccagagttttgctttattttgtgttgcttttttacctttaatgcttccagtcaactgaatcatagttgatgggggctgctgtgtaggtgatagacaggcctgcctttcccggaggggaatgtgttctatagtactaataggactgagttactggggactaaagacatgacagaagatcaaacatagtttcttcagtccacacccacacaaggaacttacttgtatataccttcattcatccttaagttcaagtgcaaggaatacccgagaaattcccacatctggatagttttctgagtttttcttcatcacagagtaactatgctgatacagataacacagccttactatgatgcagatgggtttaaaagtttctatatcctttaagagggaaaagagttcttatcactcttaccttcctgtgctacagagaacccagatccagacctagaaatcaggagctgatgttgcctacagattacagagaagtccacaagtgagcatgtattcctgtcgtaggaagtatttcatctgtgcagaatgccagtgcctgcttttacttctcatgggccctagagaatggacagactgggttataatctttgcagtctttgctattcagaaacttggctttccaatgcataaaagagaaataataataataaaacagaaacttgctaggtgcaaaaatcaataaagaggataaaaaattaaaatgtgaatcatttacagaagtatatctcttctggtgggttgacaatgcttcgggcctagtcacaaggcttggaagtgggttggggaggcacatattaaattttaatacctacccacccccccataccacctgcacaataatgctcagtggccctgcctacttaaccagattattgtgataagtcaatgagatgatatatatataaagtctgtcacggcagaggtgagtatatttactcagtcatttaaaatttgctgaccatttactatgtgccagacactgttctaggaactaggaatatggcagcaagcaaaacaaacaaaaatccctgctcggctgagcagcattctcttttcttgctctgtgaatggcaattcgacataataggtacatggaagctaagacagaacctattttattttgttctgtctttccttccagaaagtataattgaaagtataagagagaagaacacatatgttgattagtcttgccaccccattctacccccaaaaaaaccccagaaccattcttttgccctgatgtgtgacccagaagactggccttctggactacattacccaggctctcttgtccttgggcttccctttgaatttggccaaaaggagacatcagcaggagatgtgaaagtgggggaagagagaggtcaggaaatgtgttagttcagccctccttcccaactccaattctgactggactcagaattcatcaccattttacttgccccttcagtttaaatggtttaaagctttccactactgctagtacctggcagtctctactattgctagtacctggtgctatctctcttgaggtcccttaacctcatctgcagctccaaatacagttttttcattaaatcctctttagctaaaaactttgcatgtgccatctatttttgccaggatcctgactgatacagttaagaggaaattatactgaaaaaaaaattataaatcagccctgccaaggttaaaaaaaataagattgagaaaataaaatgtgtttaatcactaaaatatcttaaattgatgtgaggacatcagaccaggtagagaaatgataaattgcaagaaaacacgataagccagagtcccataggttggtctcaatgaatagaccatagtgtccaggcttgatgggcttctataggctaagtgcagcttgctcaaccctcagcttcaaggagctcatggtgtagtgtagccacagcaatgacaaacatgtgagcagaaaggagatgtcaggaagtatacagcaagatcaaatgttgaggaagagattgctggtcctaacattgtttctgcctttgctacaataacaatccatttgcccctacccaaaatctagatatctaaacagattactgaaatgaagggaaatgtcttctttttcttttgtttttttcttgctccaggctgcagtgcagtggcgccatctcggctcactgcaacctctgcactcccgggttcaagcaattctcctgcctcagcctcctgagtagctgggactacaggcatgcaccaccatgcccagctaatttttgaatttttggtagagacaggatttcaccatgttggccaggattgtctcgatcacttgacctcgtgatccgcccgcctcgacttcccaaagtactgggattacaggcatgagctaccaccccttgcccggaaatgtcttcttaaagctaacatgatgaatatcacagaactaacaatccctatgagaggaactaccattattgagctcttaccatgtgccagcacaaggcaaatcactttacatggcttatctcatttgttcctcacaataaccctaagcggtaggtattattattcccattttacagatgaggaaaatgaggctcagagatgcggagtaatctacccaggacatacagctaataggtagtggagcgcagttccgctaccacccttattggggtggtttgttaccacctaccctttctctcctgcccagatactaagcctatttaatgtattgttggggaaaagagtagggaaattgttacgactccagtaagattgggggaggcatcactggtctaaattatcatgagccaataggaggttccaactaattttttcctatctgataagtaacaggcacattacttaccagataggaaaagaccaagctgataagtaaaaggcacattaacgtgcaagagagggtgggagcccagtgaagagagaaaattgggatagggtgaaagaagagagcactctcaacaccctggagactgctaagagctcacacagataaaatatttatttttccatatgttgcagaaagcattgccatcactgtatgtgtgcaatatgtgcaaaagaatgtgaaatatatacatcaaatgccgccgatctggttaatttccatgcatttaacatgcttaatacctaccatatcatcaatatgttttaatgcatatttctttccacatacaatatggtctagttaggaaagagccaacatcctccacagccttactcactgctatgtttcagcctaaaacttcttgctggggccagcacaatgagagttaaaaaccagaaggctctgctggctaactcggccgccagtctccttaaaacacactcccaattcttgaagcagccttttctcataacagaaatgtttgcagtgaggagatgaaaatgtttttgttctccttggacaattgagagatgttcagtcagaatgtcagaactgaccgttgaaaggcgggtgcctgcggccacgcttttttgccttttttttttttctttttttgaatgcagagctccaccagtgtggcgggaggaagtgcacaatgattggtctgtttttttgtggaagtgttcagggtacacccagttttgctttgcatatatttgcgaaacatctgcccttttcttattcttaagtccttccctgtcaccagccccctttctttttcctggttctttctaagcgggggaaggcgggtctaactttttcattggagctttcattttccggttgaggggcgacttcatcagagtgtataattttaacagagagagaggaggaaggggctggagagagagagagagagaaaatgagagagagagagagagaatgagagagagagagagagagagagagagaatgagaactgaaaagaaagagactgagaggccagagcctggcaaatcaacctttggcatggtgaccaggaggaaggttctggtcgggagttcgcctctctgaaatccgctggagtcagccagtgtgctgctgccctctaaaggctccagggaatagtgcatcgccacagaggcttgaaaagacttgccctcagatgtgccatgtttataattctttttatacagcctcaaaatgtattttcaactaattatgacagggcttattctttcctccttaataaactatgaactgcaaaaatggggtcaattcacagcacctgtgcatgtctagacgtaaacgggtgctatgttttagggtttctcagctccggaaaaaggagtccgaagaaccattagagagggtgagacaggacatgaattgcttctgaggatggtgagcagttctctattatctggacagttgggaaacagcccagtggtataagggtaagtaaagtgatataagacaaataagggggtgagccaaaaaggttgagttgctaacatttcctgtttatagaggtagctccaatgcctctgtgctatcaatattctcccaaagtgatcactgaggcaacaggagggtgtgatacaagatgtcaggtaggaaacaagagcgaatctagggaaggaaacaagggcattgatatgaagaacaatataatttttgcagtgttaaaaataaaagagtaatatattggtggttttgctatgtccttatgtttgaaagaaagctttcttaattttctgaagcacacatctgaaagtatcctaggccctgtctatgaatatcaaaaataaacacttttttctgctaggtgacatatgtcattactgttttgaccctatatttaaatgaatcatgagggccagcctagccttactgagcaaaatagtcctgctcttattaaatacccctcacagacttaaagcaaaagcagccagtcaggtagttttgctaccttgctgcataaaaagtaggaaacttaattgggattcagactatgaccgttcttaaaatacactttaatttcagcttcatttcattctgtccacaatcaattattgaatgacagctttgtctaagctacattgcttaatagtatagacaaggcagtaaactctgggagggaaggaaccagtcctgttttattctttagcccatgttggcacatcatgggtacatcataaatatttgtaaaatgaatatgtaaatgaatgaatgacaggagagaaggaagaagaaaagaataggtgaacactaggaatactaaaataactaagacatttccttaccttcagagagcttacagtctcacaagagggatatgcacataaatagccattattgaaataaaattgagtgagtgaaataagattaagaaaaaaaagagcttaggcatttcggagaaagacctagggaggaattcactgtggggagtgaagtcctacctggcagagaggaatcaagacagttataagatgaagacaccatttaataagtatgaaggataataagtatgatttcaacagggcagagatgaaatatgggatattcaaagtaagagaaaacttgagcaaagatgtagagcccagaatgtagattcccaggatgttctggaggatattcaagaaatctgagggtacagtatggccaatatacaggacacatgagaaaagttagaagagatacggaactgaccttgagtgtcaggctaatgtagtcatcttagatttagtgaatgcaaagaaacaggactagaggagtgaaagaggttggagagccagttagtaaacaatcagctagataaaaagcagtaggtgattgcagtgaaattggaatggaaacacagatgtgagaaaaaatatgaaggaagcagaactgtaagaacttactgatgaattggctttaaggcagaggaaggtgtatagtgaccctgaggtttccaacctggtggtagacaacagtgatagagatatggaccttagagaaagcattggttttaataaaggagttgggctttagcaactttgatcttggctacatctttaaactgaaaatcagaataccagctccttcagggtccatgtagacactcaagatttgggggttactcccatagtcaccattcaaaaatcaattgataaggtcttataatttgttgcttctcttgtattggcttcctccatactgaaaaagatgtctgaaagcctcacctctattctaatctttgccatgccatctctgcctcctgccctctgaagaaacagattttatttcacaacctgttggactgaaaacacagcatactaatcataacaccatattctgcgagggcagatttaactacccagcacaacaaatttaaatacaaaatattctgcataacaagtacattaccatgctcacagaaacaagggaaacatggaaacaaatctacttacaacaaattctgtaccacacatagtcttctacaaataaaataaatgctttttctggtcatgtccacataatgatagaaaaagacacaaatccaagggaattggagaaatgttcaggaactattactaataaaccagtttggctgtggtctagggtctgtgtagtataagctaagtatttgttaatttcatatcagttgcattgtcctggggagaggagacctgagctgactgatagctgtgctgttttacttcctattcctgaccccatataacaattagtaacaattactttctaattcccttcacccttctcttcctcatgtcccaaacacacaatcacaccctaaactccaggacgatgcaccaaatcaaaaatcttaggcgtaggatgagtaaagagttggagtagaaaaatctctgcatgacaccttccctctttagctactagaatctaagctcttcttttcacttttcacttgctactctaacagaaacctcccatcactaccccctcatccgtacaggctgcaaatttaaattgtgatttgaaattttatttaaaataaaatcttaataagagcaggaaagttgaatgttccttaatgtagtccatgagtagaaatttaaagttggaaggaacctttaaggccttctaatccaagccctttattttacagatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggtaaaacttccactagtatttttccagaccatgttaaaactcctaaggggggaagagggatgctttcttggataatgtcagccatacgtagctcaagctgtctaaagttctgggacagggtctttttatgcagccaacagagtccaaatgtggtgctgtttgcttggcccatatgctttcatgtgttcccagttaggccattactggagggaaaaaaaacaagaatcagcttgttttaaaacaagggacatactggactccctcccatcccccttcagaaaaaaaaaatcaagttatctttaacagattctaaaaatgccttttcccaaatatgcagtcagttccttcaaagggccctttgtttattttcaggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgagtacaccactaaggtgatggtgtctttgcagtgcttggagtagtgcttctaccctgggttctggcttttctactttcagagcgagctctttgcatttggtcttctaaagcagccaaaagtaatgtgccaccattttcattcagccaatatctataagtttgcaaagctagagtgtatttaaaagccaggtgacatgccatttggccttaaagggctgattaattacataaaacacgttcttttcataacactaacccagaaaatgaagttttgttgctggtatccatttattcttgatctggataatggcacttccacaattactaaattgaacaaccaaatgtggacctcagaaggccagttagacacaaggaaacatccattttgaaattacataacacaagtcagatttgcattagttattggagtctcatgtagcttggctgaatttctgtctttccagtttttaatttattttgaagtggttaaaggatagcataaatttacagaagaaaagagaatggcttccaagaattcagaagccacccagacttcacacagccaatgagaatccaggttaaaaatattttttaattaaaaaaactgcctaagggctaaatttggaaatgggcagcttaatgagatcgtcgctattgaaatcacttctttgctgtttatttttgccatcttcccactaatctgggagtcacttcttctaattctattttaagcaagttgataaatcacgtttaggagatttttttctttttctgaaatgtaacccaatacttcagagaaaaagaaacatgtgtgttgacaatggaaaggaatgaaataactttggagtcgaatccaaaagaatattccttttagtcttaacatacccaacaactcttctgaactgatctccataaaggatgtctggtaacatgcaaataactggcatattcttctttaaaatgagtaacataagacctgcaaagttttatttcaaaaataaaattttgtccacaaagacaaaaattattaggaaatgagattctaaatcttttattgttatttttctgacagaacaaatgtaaaattctgcaaagaaggcaagagacaatggtccaggagattccattctctacttgcttcatcatgatagtctctaaagagagggaaatgagctggcggcaggattggggtgaagagagcttgttctatttaaggttgggctaagaccatattctagccgtcactagaaaatgaaaagggaagtaacgtgagacaaatctctgtggcctatgtgatttgaacagtcgaagttgaggcttctatagagaaaccagggggcagaagcagggactgtgttctgaggaccgtcctaatagtcacatccttggaccttcttgcctggcaatcttcagtgtaatagtaatgacagaaagaattggaaagtagagtggcacagtgcccataggcatgtgcacactgtcccttcccaccaggaaaatagcccgttcctgtggtgaagggcctggagtttctacatgcaggtcttcattacccagctttctgccacaccttatgggtatggattacatagaattgccttaggctagaaatcttctgttacagcaaaaatgaatgttttgtgaatagaaaaagcattgggcttcacttattgtgctttatcataagcatcctctggccaggccttagcattggcatgaagtaagtttcaggaacagcgtgagtatggtgtcaccatacatctccttggtggccctggggaagccagtggatgtgagctcagttggaaaaacaaaccaggaggagaaacctgatctccagctgtttttagacagtcactttgattttgccattaagatgtgtaagtcttctctgttccaacctgttgtttaaattgattatacttttctccaaatatatttggattgtagtttgtcctgatttgagcctacacttagaagaaaattgtttttaggaaagattcacagaaatctgtccatttggagattgcttgagagaagacaggaaaaaggtttattttaagctgttaaaatttttggatgctcttcttgcattcaagaggatttttttttttttactttcaaatgtcattcttaccatagattaatttaaaagcctaatttctttaaggtaaaatattcagttcctatttagaactaacagatttggggcatttaaaaatagtgcccttgacttgttagtctctttaacttcagaaacattccaccagtgtgtgttgttccaagctttcacaagtgcttgaatttttatagcacctttttatttgtcatgtgtttagcaaaattattcttagtcatgatttaatgcccatatcctgtcagtatgatccttcccaatttacagatgagaaaactgagaaaattgacacccaggtagatggaagactcgcttgtggttaactcatttgggtaccgaggggtgtttatggatttgctctcattgtgagagcatttcttattggaattctctgttctgagcccaaagacggcattcctggctctgaacaggcatcttgaaaatgtgcaactactcatattggtgactgggttgtaaaacatgatggataaagcatcgccacaaaagaaaagtcagctctgcatatgaactgacatgggtgggtaagccaccatcttttttgcatatgaaggacacaggctgtgttttacagcaaagatgacaagtctgaccccctaaattctcagttggctgtttaacctcctgagcctcttcaaattcggcaaaagatcccagtggtattcaaaacaagaagaaatatagttgagatatgctttcttttgtgagatgatgaggttaatattgctgctaaaatgtatgttgctttgcagtgcgcctactaacacaatttccttttagcaatattcccccattaccccctagcttaccacctcttcaccattgctaaaaatctaatggtaagcaaattcacatggtgataatggaaggcattaagatgagttatggaatctgaagggtaaaaaacaccctaggtgtttgatagagcagttactcactaagcaagctgagtatgagctgagccaagtgctccctttaaatgcttaagcaggactaaaccaagtcagtaaagcagacgaagctctccatatgaaaaacctttcttgacagctatcaagctgtagcacatcacagtcatatacatgtgatagacgcgaccagaacttttacttgcatatttcttccattttgttttcccccaaataaggctcccattgaaagaagtgattttcctccctgtggccgtcctccctacttctgctgtagatccacctattctgatgtctttcttttgttggaagctgatatccatggtgacttaccttcccatgttttataccggcctcatcagactgtctcattttttgtgtctttgccaagatgcacttacgcatgaacagtttttatttatttttcattgaacctttacacatttccaaactgttgtgtgggtgggtttaactttagctccgtaggtagcatcattctgctggggctggacactcacagaggccaatgggctcttccttttccaactcttgccatccaccttccttggcctccccctcccaaccatttgcttcacccgcccaagtctgtgtgattaaaatttttagtacacttggctcattttgaacttttaagcaattttttagagaacaaaacagaagatttttatggcaaactccattaatgccacattaaggctgacattttaattaccccaaagtcaggaaatgcaaagttcaggttcccacagcaacagaaactgtccccttgagtgctggcatcacagcagattctttcattccctgattacacaacactgggtgtggggacattgtttttatccacgtatgtggaaaggagcacagcttttatcctttgatttttttcctgtaactacagttgaggatatgggtctttagcttccctcccaaaaccatctatacgtattatcctggaacggaagactattatagctctacatgtgcacacggacagaattaaagttgctgtgggaacattaactctgatttccggacttccgtgccagtcacatttaaaccataatgttgtaatttttggcatgtaataaatgtgcatttcatgtacacagacagaaagaagcataaaatgtattttaaagagcaattaattactaactttgtgattaaaaaacatttggtgcatgttccttcccatttagcatcagctgctggtcttagccaggcctaatagatgacatactgtgtctcatcctgtaactcagatgtacttactgtatgttcctgttcttccagataattaattcccttagtaaagctgtagggggaaaacaaaatggaaggaatatgcaagcatgtaaatagggtaagggatatttcgaaggaaattattcatttctgtgaataaaccttttagtccctgataacgagccagaaatctgctaagtgggtgtagacaaaggtttctggccatcttagagcatctggttcggggccattagaacaacttgaaagcagatttccccttgaattgcaggcatgcccactgggggagtgattttactctgtaaaaacttataggcttaaggcttaaaaagttattttactctataacaactttttagtctatgctgtattcaaactggaaagtaaaagttatagggaatcaggtaagatgagggctttgctaaagaacccctgacttaaagagtaattttttttcttcctttacatttaaatctggtttacccatttgtgttagagaaggcagtgtttcaaaataactgtttgaacgggtttgtgattgaaaggcgttagtagcaatactctatggtgccgtgtttaaaaatgcgaatgcttgagtatatatttgaaaccagatgaaataaaaaactttactgaaaggatgtatagcttaaactctaggtaaggctttaaggcagacacgctcaatgaagaacctcgtgctatccgttcattctgtctcctgttgtgtatttctttttgttcagtttggttgcatatgatatttaacctttaagaaaaatacttcagttttacagggctctgatttgcttttacttgggctgtctgtatgtgtgaatgtatgtctgtatgagtgaaaactgctcaagcaagtttgaaggtctctttggcaaatttgactgcatgttcagaaagtttccaatcggaaagctgattcagtgtaaaaccttccaaaaacttcctgaggcacctgttcacatgaaaagattggatttctgttggaggtgctcagaaggcagtgtttataactgaagatctctgtttggtgtgccaaaaaatgaaaaacattttggccccagaaaacctccataaatgttcaaaatgtataatcaaacaaaagcttcatttggattcaaatgcatgtatctcagcagatgtgtctaaactaactggaatcccacaggagcagctgaactggattttggtatgtcttgataactgaaagagttattcttagactttggaaggacaaaaatggtccatctgtgaagaaccgtaatagagacatggcaaaaaacagcatcctctgaaagagtttatttatggaatttaggacaagttggacaatcctgaaaacattttagggtcacactaatttgcagagaaaatatagccaaaatggaatggaataacaaccacagacagttactatccaatggcttgttattaattttctaataaattccgtatcagttaagcagtaatagagtgtctttggtacaactaagtgctctcgttgcccccagtgttctgcattctgctttattctatgttctgtaaggaattatatatttatcttttcatttaaactgtttttctgtcatttcattgccaagtaagcccctcatctgttaaatgtggatttcctgtcattaaagatagtctttcccgttttaaaaagtcacctttctgcctcttagttaattgatatataatctctttggaattttttcgttaccttttataccctttatttagagattttagtgcttagtccagcacttatacattggaaggccagttcgttttttttatttgctctaatttcctagagtttccactttgtgcatttggggacacacttattttaaaaaagcacaggtcttgaaactttgtatcttaatctacctctattttttaaattggccctctttttataaaacttattatttccctacaacaccaatttaactgggtttcttccatagtcacttaatgcagtaatttctggtagtcgttcttattcattcattcatttagtcattaattcagtcattgatcaaatgttatcagatccctcattctgcaccaagtcctcagctaagattagggacgaagataggaataagaccccatccccacactttggaacataacggggtaaatataaatgcagaattaaagtgttccagtatgcacaaaatgctacagagcccccgaggaaagagcctcttgaagtggaaagagctccacaccaaaaatgaaattaaactggatcataaaggagtgggcatttgtaaagtagaaggcagaagtaatggcattccaggcagaaggaatagaaagaagcaaaaccatagaggcacaaacagagcgcagagttttcagaaaacagaacagttcagttatgacactgaggccttcttatactttgcctcattttaatcatgggaagatttgtatttgggtaacattgtctattgttataattcagctgagctgaatcctatatccatttcagagacatttgctttccaaatatataataaagcaagacatctacttattttctaataggcaaaagaacccttccttccacacagccagtcaaagtaagaaagtattctgagggggcaaggcgcagtggctcacgcctgtaatccccgcactttgggagaccaaggcggccagatcatgaggtcaagagatcgagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaaaaaaaaagtattctgaaggacctagtgatgattttgatcagtaaatcacaaaataaattttctttttatttttcttttttgtttaaacagggtctggctctgttgcccaggctggagtacagcagtgcaatctcagctcactgccacctctgcctcctgggctcaagcaatcctcccacccagcctcctgagtagctgggaacatagacttgtgccaccacagccagctagttttttggggggttttttgtttgtttgtattttagaggtgagatttgatcatgttgcccaggctggtctcgaatcctgagctcaagcaatccgtctgcctcggcctcccaaagtgctgggattacaggcatgagccaccacacctggctcagaataactaattgttgagaaaagttcattcatggagccagagtcacctacaggtgtcatgctggaactttgtcatggatttgtggcccttcccgactctaacagtctgtcctcttataaaatcctcccaggtcccttggcaagtctggtctcaatgcccattggctcaagttacactgtgtcatattgctctcccaaacagtgcatagatatgattatccacatgtaattgttagggcccaatgctgattttcacggttctgttcttcatcttgccatctcatcccatgcaggaatacatctttaattcttatctacagctgctagtgacagtttcatgtgtgcttcctctgttcatggcagatttcattatataaaattagtgcttctccatatctgtcaagacttctcacatccttacttaaaataaaagaggccacatgcactactgcccttagagttggatcatttaggattgattgagagcaagcatgaggattctttaaggacttcttgctttaaggaaatttcaagtcggatctttccaccagtcacctcacactaggtaccataatcacataccttattacttcatcagcagaatccctttttttttttttgctttcttttttgcttttcttctgcctctgaatcatttgttctctctgaggaatgtgtgccagttctaactttttatcagcagtgcaagattaaaggttacctggtctatacccattattgtacacatgagaaaactgaggcccaaataacacaagtgttataacgaaagtttcccagcataatgaatgacagagtcagaaacagaaccctgccctttctcccaccatttatgctgcttgttactaagtctgcttctggacaaacttaatgttctctgaacagaaaggagtcaggactattcatccatcaatatagtggatgctttcaatgtggaggaccacaggctaagtattgtgcaggacgcagttttataaactggagccctaggctcagagacttagagtcttgtagagaagatcaaataacattcacaaacaacttccatgcagcgtggttaaagatatgtccccatacacagagacccaccggagcattgattcactcactcagcaagtatgtatagaatatatcttttgtgcctgtcactacagtgagttccatgaggacacaaaggtggagaaaaacagaccccaccaccaagaatcttaaaacaatatgtatcctcacatcaccagtatctgagaatttagaaagtttgtaaagtatattttaatccagttaacagtaatatctaggtaggtttattagacatggctccatttgagctcttttgaaagactggaaatgaggcatcaggactaggtatgaggggtttgcacctctgttgcagagctgtggaagggtgttaagtagggcctaccatgagcaagattttgagaagatctaatttggcagcctggatgtgagaaggagcaactggaggaaggagagggtccagacagcactgtcagtatttcacactattggtgacctgaagggggcggtaataggaggaatggggaggatccaggtgcaacagattttgtggatgagggtagacagctctgggagctgagtgttagttacaacaaaggcagttatcaaagataactccaaggtatcaagtaaagatgaaaagcatttaaaggaatcaaattgaattccattttatatagtgccgagtatgagctaccacaggtgttcccagtggagacaactaacactgagttacaaacagggtcctggggcacagcaggaatgcgtgagattaggactagcaaacactttggccaagagcactataagccataaatatgggagtaaacttcaaagaagtctttgttgagagaaaaaaggaaagcaaaaccttgggaaatatttacatgagtgataagaaagagaatgaagaatgaataaatagaggaaaagaaaagagagttctaagggataggagaaaaaccaggatagtgcagagagaccatcagggagaggaaggatcagcagtcagtatcaggtgccacagacaccaacgagggagagacctaggaaaagattaccttaggttttgggattactagcctcctgattgttgtcaagaaaacagaatcagatgtgtcacaaaaaagaccataaagaggggttcaggagcaaacataggataaatgggaaagcaactattacaaagtacaagtttaatgttttaaaaagaaataatgaatgggtaactcaaaagtggagtaatgaatatttttatgatacaagagttcctagcccattatagactgagaaaaaccagtgttaagggagactctgcaattaaataggcaaagtgagaaggaattagatcttccatttcacagggcaattggaatggtaaatatatgcgaaaggaatttgaaggcactacccaagcccagtgaggcagtaattatattatactggttctttctctacttcttctcaacattgctttctattattttttatgagaaataatgttttacaagtattattacttcacaaatattaactcagttccttaccctcagtaacctctgaacactaagcagaggataggtgtcatacactttgaacatttaaatcatcttaacaatttttaaaacaatttttaaaaacaattgtttttgaaatgacaaagcataattctttaaaagccatgttctgtgtacttctttcatgatatgcccaattcaggtagctctgtaattactaataacaaacctatgtgttgttctcaaggccaccttcattgtcatgggacatcctcaaattcattatttgtagggagggtttcaatttgtttacttaaagtatgctgctttctgtgatggtccaagacattccaaaggccaatcccacctgtacacaaaagtatctgatatacttctactgtaggatggtgatctggaaccaactgaatcaaacgatactttgttctactattaaattacctgtaaaactaaataaggagattattttgtcactactgaaaattatataaacaaccacatggaacaatgttgaacatgagtctttataatttcacaaggccaaatgaatttatagttgatgtcaaaattgaccttgaggagttttttcctttcctctccaattctaaaaatgagtttcctcctacttatttatcctcactagttttagcttggttatgttatcagttttataccaagatattagaccaaagagtacagaatttttaaaaaagcttggtgtggcatgtagaatactacaaagaatttcaaaaagcagtaactgaattaactttgtccttcaattttttactgtaatcacgttcttccctatataatcactgattatctctttgcctcatatcttaaccaggtatttagatgtaaaggagacaatgaaagaaaggtgcatataagtttgaactacaaaagataactctgtgtctaatggaaaagacacatgcaaattctaaactaaaacttttagaagttaaccccagggtaaaggatacatgtcattttctcagggaaatactgtaggtctttataggtacacctgactggattttttccaattttcataaatctagcccattccattttcttcctgacctaaaggtcccagatgggtgactagatcctgggattcctgaagtggcctaagtaatcctgggttgacatgctaacaggcactgcaaagcaggcctggtttcactgggcagtgatacaggcaaagcgtgcccccacttccagccctgctccagagcaggagttcttgacctggaggccttggactctactggtaccattactgggcctttcttttagaggttcatattctttcctgcgtgttgttctgggacacaggtttaaagattttgttacattagggtcagagaactaacagaaggaaaaagccacttccccaggacatatcctaatcagaatctgcaccctcaaacctggcacccaagagtgaacttagaagcaatgaggagaggtccctgtgaacatcccaatgcagaatggctcctgatgtcctctcgggtccctccgatatgccttcagggtgggggcaggtatgataacagactgctaaagctatttcttgaacatgttgctaatggactaagactggggctatgtgttgttttccaatattcagaaaatattttctcacccccatggtctacttatttgctctttttaacatgaacttcagcctatgaatgcattttatgtgcctttaattaacctccctatgtttccatttcctcatgtgcataattgcataatgagaataaaaatagtatgcatctcatagggttattagaaggattcgatggaacactacatgtaaagcccttaaagcagcaccagaaaaacagccagcgctccgtgaatttgagtgtcggctacagttttaagtgcttgaaaattattaatatgaactaaaattgatgcagcctaagtgaaagttgttgcaggtccccatcctttccccctgagaacgactgaggctgaaaagccctagatctatgggaggagattgtgtgtaagacagttacatccttcacttcgaggaaaagccagtgcccttcttcttgtcccttcttggattcaggcctgaatagactgggaagtttctccattatctctttgccttcttttattcccccacttgtatgttttttttttcctaaaaatgaaagaggactaatatgcataatcttattacaaaacaccccatttacagataaggaaactggggctgaaacaagtttcaaatctctctgaatgttgtcttcttggtatagggaagggttagagtgttattaatattatagcattacattctagtgttaacctgttaagttcctttttgtcttcaagtgcattctagtcaataagagattttcacgctgggcatggtggctcacgcctgtaatcccaacactttgggaggccagtgtggatttatcacttgagcccaggagtttgagaccagcctcagcaacatagtgaaaccccatctctacaaaacagttagcggggcatagtggtgtgcacttgtagtccagctacttgggaatttgaggtgggaggatcacctgagcccaggaagttaaggcttcagtgagccatgatcatcccactgcattccaccctgggtgacagagtgagatcctgtctctaaaaaataaaaaaagaagagagattttcaaattatagggaatggacttgtgtgctctcttacctcagaatacattgtaggagctgtacattttcctgtgtgcacccatctacaatctgtccattcaccttaggtgccctttcaccatagctccttccagccgggatacccgaagagggcaaaacatcagatccttagaatgtgcaaacttctgtgctaccatatcagagagccctttgcaaagacaaatacttacaagtaaagaaatgcatcttttatttttttgaaagtccgtcggcttgatggcatgagagttgtctgaaataattcaaaacagaggtaaacttagaagagtaagtgagtttcacttccgaggaggattgcttgtaatcaccctgcttacttaccttcttctattctgaagcagtctgcagtagttgggaaaagtgtaatcttaagaaattcagtaacagtcactggctcattgtacctggtaagttttccccgtgccgtggtgcccacggtttttggtaatgcatggagataatttcggacgtctgcttctcttaactcctgagcacttttgcttctcactgtagaattccagagacacatgggtatggaacttgatctaaaagcctcctagtaatagttgcagattagattgaaagccaaactagactgtacacaagtctgtataaatcccaaaatagagctttaaaataataacttactgagtcatgatttctgcatctcatatgcagtattccttaaatcacatgttgatggctaatcaacaaaatccaaagacgcaaattagatggtacaatatttacagagaaaatatatgtgtagtttgaaaagcaaggattctcagggttacagtcccacccccattccccccagaaatgatagcagttgcaatctgaactctccacattgtaaccaagaaaggaatgaatataacaatggaaagagagagatttaagatagaacttcttagttaaaggagtctggaccttcaagaaatatgtttaagaaagattcagaagaaatactaggtaagatgaattattcctttttctcaagtaaaattctagcagcgtacttgttaaatgtttattttggccaggtgacagaattcaggagggcggaatcttgtttaccttgtccactgctgaatccctagcacccagcaaagtgcttacacaaattaggagtaggtgctcagcaaatgtttgttgaatgaataaatgaatgttgtggggagaatgaagctaaaataatgatgtagtgcatttgtaagcattatgcccatttgtgaaaatataggtactaattttttacccgattatttttttcattcagcagacctacaaaacaaagtgtatcacaaataccctctgcttttcatgctggggaaacagaaaagctttcttttgaatgtaagctgctacatgttttaattctaatagcaatatggcaggtcaactttgtagtataatctggtgcctgtttttgatagataccatggaaatagatacttattttcaagatgctcaaacagatgattaggcaaaagctctagcaaaccttgaaacaacaaaaaggaaaggttttcccactcccacctcccgttactgtaacatcctgcacagttttctgcaaccccacatcctcctccttgtttcatctttttcctgggtctaatctttgtctagggaatacagcatgtgactgtcagtctagcaaggagatagttcttgagaaatccaccccctacacactgtgttcccaagctcctcttacaggaatggcatgatttgatcagcagcaggcagagctggcccagggaaacaagagcttggcatagaaatcttagtgccctcctgctggaagggccctcaagagagatgcttcatgcccaccctccctcaactggctggacagtagatggatgtgtaggaaaacaaattcctggctgaatgaatagaggattaaatgaatgagagatgagttcactcctccagaagtccccgccatcccacttgaatagaaaggctaactttgaagccactctgttctccatggcactattttatgtatactcagctttggaatatggttgccatctgctgccagtgcttaggactaaggaagtattggggtgggtaggaggaggctgggagggaagaaaagagacacttaaaatgagctaatgatctcctttgtgttagagcctaggtttcagaacatcaatcctgtacttcaagaacaaaacaccagtgtgtcttagaccacaccaggcgccggcacatcagataaagcctgtgctgtgtggtgtttagccaccgagcctagagaagttctaaaagtgaaattacaggtgcaaactgaggaaactaaaaggagaaaaggccaagggtaaaatacaatcaggagggctctgccgatatgtatctttggggctacagtagttgaaaaatgaatctactaattaatcagttggataatactataaaagcaaggaatttaaggatctttagaagaaatgagacacttttccatacactctgagcatattgtgagcctttagtataatctcagggtgaaagtgacctggctattgtgtattgctgtagacgtaactgttgattaagtgttagagattgctgtactagaggcatgcatggtggtcctttaaaaacagaaaaggctgttaagctcagctagtaagacaatcgaacatatctgaacggcagagaatagctcatagagcttcctagcttccctgatgttgtttgcataaattgttgggggatgtttgtttgtttgtttgagacagagtctcactctgttgcctaggctggagtgcagtggcatgatctcagctcactgcaacctccgcctccagggttcaaattattctcctgccttagcctcctgagtagctcgaattataggcatgcgccaccatgcccagctaattttgtatttttagaagagacgaggtttcaccatgttggctaggctggtctcaaactcctaaactcaagtgatccacctacctcagcctcccaaagtgctgggattgcaggtgtgagccaacatgcctggtcaaattgttggttttgacacaaaatcatattgataatttatgtactgaaataacatgccagagaatagtaattaagctggggatgtatgctagtgaaaaaaaaaaatattacagtgaagtttattttgggaaaggattagctaattggctaggcatgacatttgaaggccatgtactgttatgtattcaatagtaggcctgtatcttgaattggaggaaggctgaaatttctttttgcaagggaagaacctcatcagcgatgtatataagtataaatttagagacaatgacaatcctagaaatgcaaaataccactttagggagcagtaagtgattgctgagcagtgtgtcagactcagtgtctgagagcagcaaatcagaacatatttgttggctgtgtgagctctggccttgactactgtcttccagcaggaacaagtcatatacaactgtgactcagccacaattagaatactagtaatgccctaaatctatctcatgtacagtttctcttcctaggaaccttgtgtgcctcatattctatttgtccctacaacatccctgtgaagcatacacacctttgttttacaggtgggataacaggtccataaaggaatagtttaattctttgtcttcaaatgtgaaatgattgataatcagtatactgacccagctcattgtaatgtttttcacattatttcaggtttcctaggcaaaggacatattttatcttctcattattatttttaattagttttcagaaaaggtgagataaaaacagaatctaacaaatatcccatagagatatttggtgttctcttttctttcaagaataaattaagaccttctctgctcctctctgctggctctctcggcagatagtcaaaatcccatgccaattttcaaatgaataagggatcattctaatagctgatcacagtcccctctgttgaggaaacagcctttaaaattcatgtctggaccctgaataagttactcttggttataaacttttaacagtttgacctgaaggtttttaaactgtactaatatataacctgcttgtgagttcagcaataaatttatccccagtatgtgaagggccaaagagaaaactagtgtcttttattctctccagtgaccttcactaaatattgcatatttactttgtaaatgaggacacccagtggccaccaagagaaaatattctaaacaatccttgacactactgttaatgtacatataaataccctgttatcaatgctgattgatagatatttctgtaacatctgttaccaagcaggttagcttccctaacataggcaaaagtgatcggagtttggcctgatcatttttctatcacatcatagattggtcatctcttcttattttttattacaaagtatggcttagctttgggttccactgaatcctctgttgacagggggacccagtgagctgtctctctggggaaatggaatcagggagacagagacagcatggcatgtatcagaaatcataaatgaatgagcagagtttgtgggcaactcagtgaacacataaaacaattgcttggactttaaattctattgaaaatagaactgtgggtaggtagggaaataaaggacaagaagaagagcattacacagaacttcaggggcaaaaaagccctgtcaggaccatatcacatagacatatctcagagtaaatgtgcgccctgaggttcccacttgtttgtgaagtgtagcgaagagctgaccaaacaagcactcacatagaacccacacattataaagaaacatgctgggcacaatgagggatccagttacatatttgtagttgtcattgtagttgtggttataacaagacaagatactagcctttgggaggctttgagtcttagagagataagacagacacaaatgaaaaaagaaacaataatatattggtaagaactaacttaggtgctacatgtataggaagttcaggtgaacttccccaacactcctcaacattcaggtacaaaaaaattcccgtatttttctaaagaaaattaaacctgaggcccctgtcaccaaattcgcaagaaatacagacaagttttggggctcccttctcatccctagattggtacaagactcattaaatctaagtccttagtccatgatggtctccaacattgacattgcttgaccaccccacaaagatgccattgagcctcgtccttctgactgccagcactactgcactagctgggtttacagatgccctccacagtggtccttgctgttgaccattggcccagcccccagatgatcactgttcctctcaaagtggtgcctttttatgtccagcctccagaagtgtgccaagcaattaccccaactggagctgtatgcaagtagagaccttgctaccttctgcatttgagggaaagtggattgtttttctctccagtaatgctatccaattctctaactccaaagcatcaatcagcctcactctccttacccattctgggttaataattcattttagagaacagacattaggaaagaaaactctttgttttatggtttattctttagggcttaatgggctctgaaaccacaactccctgaggcaaaggagcctataaagtatacaaaaacctggccattcattcctacaggtggaggaaaggggagataccttctcattaagaaagttttctaattcagtgagaacaagccaaaaatgaatgtcttagtttattacctcaccaaccagtggaaaccaagaaaagtgaactctagtaatcacagaaggcttcacagaaaaggaaaaagtttgaataaggttcatggggatgataagacttggtgaggagagaaaccacaataacttcagaactgcggaaaattcagcagaagagaagtaaaaatgaatgtaatccacacacaggaaagcaaaatggccaaccttttggattagcacagagattttattttagagaaaatcaaatccaaccaaatcagtgaagtgaaatcagataatttgaatgttagctatagctataggagacttctatagctcaatgtcttttttgacaatatgtaaataatataataaatattatacaaaagactatataaagaatatcataaagataaaatgcctacttgtgattaaaataattataaagtatgccttctactttacttatttaccagaacctcccaaggttttgagttctatctgacagcacttattcttcatctcagtatgagccaaaaaggaacttaggtcctattcttttttttaatgatttcccgtgcctggttctataccctaggtgcgcagatgaatttcagctactctcttaacctagcccacacaaatcatctcagtgcttccattttaaccagtcatccaacaaaacagatttacttttttccttggcttttccctgttgctttgggatagaaggtctttactcctcagtgaacttatctatcatggctcaagtccatagagaaattggccgggcacagtggctcacgcctgtaatcccagcactttgggaggccaaggtgggcagatcacaaggtaaggagttcgagaccagcctgaccaacttagtgaaaaccgtctctactaaaaataccaaaaaaaaaaaaaaattagccgagtttggtagcacgcttgtaatcccagctactcaggaggctgaggcaggagaatcacttgaacccaggaggcagaggttgcagtgagctggagatcgcgccactgcactccagcctaggggacagaacaagactccgtctcaaaaaaaaaaaaaaaagaaaatcttgcattcccctcctaccaacaaacagagatactcttgaaaaacagcggtctcattggaagcaacttttttttatttgttagaaagacccaagggaagagaacatttgagcatgaatttgaagacctgcttcaaaagcagtttcagaacagcacagcaacagaggactaaaggaagttctatgaattgggaactcaatgatattttttgccagaaagctttttttttttttaatgacactattgagttctgttttctcactcgtttaagtccagagaaaagttttcccaaagtcaaaaaatcagtttcttacctaactataattcatcagtgtgtgatgatattctttaaagaaatgccatacctgagagttatactgaatctttgaactcactgaatttataaatctgttttttctataaaataagtatatgattatgtagagaccacaagaacagattatcaagtaagaagatgctggttttcatatactcaatttttaaatttgtgattgcttcttaagcaaaacaaaagacctaacttattaactgtacaattgaatatacagatccttctttaaggtctattcaaagccaagttcaaacagcacaaatttgtgaatttaagtagatcctttggttcatttttgtataccacccacggatgtagcatctctgtatttttgttccccagatttagtgaacaaaggaaaaggttacaatagggcagtagctaaatttgtaaggaaagcgctttagagagagaaaaaatgaaactcctaaaaggtgtctcaaaaggtttacaatataagaggatttaaaggcatcaacctcagatttcattgacttttttccttagtcccagcaagtcttctccccctcatttcatttcaactttggaatgacggcgtaagtgtctttcagaatgttgtctggaattatctatccaattctttattcacagagtaaaacttaattttcacaaactgtactgtaaagtaaatttcaacagtttacctcattggaatcagatgctcaaagtataaaaaattcataaagcatatagtgtgataatactcaagactgaagttttaacttatggttggaattggtttcataaagtggatgctcaattacttgttgattgattgattatgccctcacctcataagtaagggatttgaggtagcttaaattaatattcaattgttaataaatatgtaggaaatgtatttctatataactacaaaaaaaagaaatcagagtagaggtaaaataaagaatggataatataatgaggctggtgaaaattttacatagaaaagcataccatgaggtcctacatagttgctaaaagggggcctaaatttttattctgagctccctagtgaacagagccaagagggaaacatgatcagttatgatattcacaggctccacaaagaaaagcaaaacacagcttttcctgagcactgaggtctgggagaagttgattgattaatatatgtttccaatatcaaagatccttatggataaatttcttctattgatttagatttaagatcctttgtatccttatggttccatttatactggggtattctcagtaaatgtttcactaatgaattggtgaaaattcaagtgacccccaaagcagcttcattcataagtcagttgtatttacagttttacaatatggataggcatgccctcatcctttcttagagagaacagcagacttaacataaaatcaggcaagccaaaggcctgggctaaccaagggagactgtgagacctctaaggccaagtaaaaagacttttctggaattactttctcctttggacctgtaaaatcccactagtactgtaaatctattctcagccttagataaagtataaagctcttattttttggtggagtgaagagaggaaaaagaagtcaggaatggaagataagtcaagatttggggatgggcctgaaaatcacagagcaaatgtttttctagttctcaattttgcctctttgttccccatacttcaaacttagtaaaacttcgtggtatgacagcaaaaaggaagaaagggaaggaggaaaatagaaagaaaggcagtctccccattacaagtgctatagatcttgcaagtaaactatttttttggctgattagatgtgtatattgagtttatatttattttttattcaaattataccacaatatctaatttttaacagtcaaaagatgttaaagggtgttttctaattcttctgtggatttgtcttaactgtcaaaagggacttactctgagtaaaacaaagtttgctaaataatagttagcttcaacagttgtaaactatatgtctgtcataatccagatttctgctaatattagtagttacctacatttctctcttccctttcaatctttttaaaaaatatttctcttctgaaaagtaacttttctcattttggccaagattgtttgctttctcatacaaaatagtatcagctcaacttaagtaaatggaaaatatcagttcaacagaccttatgcatcagagtaatgcaatcacaaagtttgcatcagttttagaagctttgattatggaaagtagttacaagtattttaaagagggatgcctgaatctcaatccacagctcttaatttggggaaaacacagacccctttgagattttgatgaaagccactgaccttattcctataaaagtataaacatgtccatttataaaaactatacataccccccaaaacccaaacataaaaccaaggacctttaaatacttttaagtattctctagaaatgttctatgaatgaataaaaattcaggtaatattaaaggcatacccaattacagtattgggatcataaatagaatggtgttgtaaatactgtaaacaagttagtaatttttaatctttgtctagataaaataataagtagtgactaaaaaagcacatccagctagtccccaactttcataggtagccattcctgcaaacatgtttgaaagtcaaatttctgcaagttcgaagtcaaatttctgcaaatttcaacaattgatatatgttttatgtgaagaattctgttaccaatggctaaaaaaacatgctgaaatccttgatggttcctccacactgggcttagacaatctggaagatagaggagaacctttattgggagatggcccaaaacaccccccttttcacccaagaatgggtaagtaaaactgtacagctcgccctcccataggctgatgaccctccctagtctcactacagaggtaatagcagctgggatatgctaggtatatagagccaagataggagaaagagatcttgtctgcttgctgccttccacttgcatgtgtgatttctccagtgctcccagccacctcccaagactgtgatgatactaatgagatagaaagagagagtggggtggtgcagagtcatttgctgtggatggaacctgttagcaagaaactactatacctcctatagtgcagggattcagcaggactcccttggcatatatgaggaggtaaagtacatgtaactgaagtcttaccccaggcagggggtttggagaataagggggctcagtcaccaaaatacatcccccctttctccagagatgactggctctttcctagtgtgactaacttggcaagctgcaccctgtttcatgtgcaagacccactaacctcatctggtgccccaaattgaaagctcaagggctttctggccctgccacttgacttaggcttattaactggaccgaaatttatattggttttcatttgagagctgatgtttccttccaagtccagagacttcaaatccccatccccctctgtagcatcttacccttgcactagtctcattttatatatccttttgctctcctgattgagaaagaactggatttcacacctaattaaaagagattgtattgcctgctgtttcctttcttgctcattttctcttgtgagcaggcagctttttattctcatgctaagtcctatccctggacccctgcagcttaagggacaggcaggagcaacgttcctgcaaaacagagagtcaggccctctatccccaattccccacaggcagattttcccttcggtactcacccctgctttagccccgtctgtgttgtgctctcgcagaacagtctcttagaatacatgatgactttcattactgcaattccttccatgttttgagggaatgccatcacaagctgactctgtatttttactctagtaaaaaggaggtaagttattattttaaaacacagagaactatttttatcactatttcattttgccatcagttttgtgttcataacactgtgcattttttattttgggtggggaagaatccccaaatacacatgatcacataatctatgtaaagttttgtggttttgtacagttgatagggttggggtttgggtgtgtgtgtgtgtgttttttttttcttgaatagcccaaatgcctattcagtgccaatctaagaaagaatagagttagcattttcacaccattccttcctatacactccctgaataaccatctaatcaagatttgttttcaatgggggacaaatcttctacagtagagtatttcagatttattccattggaatctatacattaatgcccattggatgaaaaggacatgctcacaaaagcctggactttgccttgctgtggcagaaactttttcccactgtattagtgttaaaaataaaagaaagcctgggaaaggaattgcctcagcattgtgtgctggaggaatgaggcatgcttgaatggggaggcagggtcccccttcgcatctgtactcatatcagcaaaaacgattcagcttttcatggctgttcactgcagtgtggggccagtgtactcagggagatatttaagaattgtgtgtataaaattcaaccaggcatgtcagatcaggttgtgtacgtgtgcaggtttaggtttgtctctgtggtttttaatgaagttggtggcaatattatcgcaagagtcttaactcagactattcagtagataacttgattgtttagatgaacaaaatttgcaatccaatctggtcaaacagtttggatttttctcatggaattgtgtgtgtgtgtgtgattatctgtgttcatttcttatctctaaagcaaccttcatcattactttcagtgtctttcttttttctctgctgagaattaagataactctcgatctttgggcacttcaagttccattcctcagtgatccactgttatgcagtggaaaaagctttaagaggcatagtttctaatcccaacactgccatgtgctactgtgcaaaactttgggcaagtcatttagacattttgagagcctcgactttctcttatatgaaatagcaataataagacttgtcctgaagggctgggcacagtggctcatgcctgtaatcccagcactttgggaggccgaggcgggcagatcacctgaggtcaggagtttgagaccagcctggccaacatggtgaaaactcatctactaaaaatacaaaaattagccaggtgtggtggtgcatgcctgtaatcccagctactcgagaggctgaggcacaagaatcgcttaaacccaggagttgaaggttgcagtgagctgagattgtgccactgcactccagcctgggcaacagagcaagactctgtcaaaaaaaaaaaaaacaaacaaaacaaaacaaaaaaaaacctgttcagaacacacataggattgttgtaaggaataaatgagatgttacatgtaaaaaagttgtatacacagtcaaacactacatggatactaattattgtgataattgtgatagggctacttcccagaattatctgaaagaaaactgtcatatatgacatctctagtgttattgttgtaactaatgttatgagcaaatgtatgtttaaagagtgttttcacttgtgtagaaaaaaatgttgtaataaatccatcctacacagagatgatcacagacacaaccagttttactgcttattgttttacttaaatgaaagagaccttggttatagtaaaattgtatatagaaaatcctaaaccatagtgccagttagttgtcttacttcttgcactgtgacatctaaaaaaataagtcctttaagttacacaactgaggctatgtcaaagcatcacagcctaaaaacataaaagccacactaaatcacggataggtatagaagtagctggaggtagtagtggacaaagcctttcacacagctttacaacagagccgtggatccctaagggccagacctcagtaaagggcaaactatgcaatataatgaagcagttaagagggtgaactctagagccagactgcctgggtttaaatgccagtctaccagcaattgcctgtgtgtacttgagcaagtttcttagtttctctggcctcagtttcctcatctgtaaaatgggaataatatcatctacttcccatggttgctgtaagattaaatgaaatcatatacagaaagcagttagaactgtaacccctaaaaaatgttatcttgtgattactatcatggtatgtatgtatggcgaactcagcaagaacttgaaatttggtctgctgctgattgagctcctgaacagcccttcctgggttatttgtgccttcttttggggccatattttgtgttcacatggttacaggggatttaccttaattctttaatctggcaaagagaacttgtcttatataagtaaaaacgatggaatctgtagcctaatacaatattttaggcacataacagacctgatagagtcagaacgagaaagaatgctcttatacaaattagtgcaaattgtattattgaacatttattaagttaagctcataccatgtgagggtgattgagtgaagcaaggtagaaacgctcattgaactcagagtttcctgaacaagtcttctatcgcaaggtagagcggaaagagtttgaggaggtaggccttcttcctatctgcaggctgttacctctcaggtggcttctcacaagacagagagatttgggtccaggccaacaatcagtgcttgggccatttggttttgaaagcccacttatttcactttcccaagctgattgttcagttgtaaaggcaagaatggggaatctgattgaagaattatttggagggggattctctagagccatctgagagatgagctagaaaaatagaaaagccctaagatctactgctgtagccacctgttttctttctcattctgaatccaaatcttatcaatagtatcccttgccataacagcctacgttatagggtggcgctgggtcaggctatccgcagcctccacatagctgttgccttcctcctgggagctgtttaatacttccctgtggcaagtacataaagcaccctattacccaaggagatcatatatcccacttctggcttactcctgctatcctggcctaattattaacaatgctctctttcactcttgaaagtgccctgtttgcataataaatatgatcaccaatgtactgtagtctcctgggtcagaactgccatctctgacctttttaacattcctccttcattaagcctcagaaaattcagaaaaccttccatatcacatgcaaccaccctagaaagtgctcaaacaggttgtcagagatgacaagaagaatgagtagatacagaaagcagccatggagtgcccctttagctagcagattgctttctgtagcccatccatcatccggaaagcatgatcatgactgtttggtagatatcttagtctgggttgaattttccaataatttttgcatacatggtgtgggttttgataatatgccatatgacttaataggaagggggtttatttgttaactatgaatatggtcactgtgtatgaataaaataagggactttgataagttgggggaaatgtaaactttcccaaagaatctgggcttaggcctgtctaaagtgaaggcaaagtaaataaatacataaataaaaataaagtggaggtttagtgttccataagaacaagtcttccatttgcctttcagttctttgctgaagctgtaggaatagcaggcaaacaaatcatctggttattaggccactctacctcagccgaagctctggggagttaatatggatacccaaaatggctgcggcactaaaggccggaattggagcaaaattcaaggtccttttccctcaggtcatcgtacctacagcttgtatgccgcagcctgtccatctccccacttgcgtatgtaagggcagtgcttctaggagccatgagcattactcacctgaaacctaggtgttaggaatgcaaccagctagatctgacccatgccctgttttgtgtctgcgttgacatgctgcaggtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagtgtcaccccacctggaggcctggcagcaggggctgagggggctgtgggaaggcaaggtaagagagcaggtagaagggaaggtttgggatcatctttcagattttaaacagaccccaccacaagcctcttctagaaaccccaactgtgttcctcccatcataagaacaaagcaccctgccaccaagagacaccgtcacaggaaccctttatggagaagggatgtcctagggatgtccagactgcagaagagaagactcaggtcattatataagccatattcaagtatttgtgtttcagaggcagcatactgtagtcaggaagagcttgagctcttacacccagccagatggcctgggtgtaaattcaggcttagctactactaaaccttgtcgccttggaaaaattacttaacttgtctatacttcagtttccttgtgtataaaatgagaataatcgtgatacgccttccttatagtgctgttttgagaataaattaatacatgtgaagtctttagagtacttccaagcatataataagtgctctataagtggtagctattattaagatggttaagaggaggagacattcagtttgtatagtttggctccaaaaggtggaactagaccaatgattggatgctatcaggagatcctttccacaaaataaaagaaaaattttgttaacaatcagatctgctctaatatcagatagactgcctttaaatggagtgagtttctgtaattagacgcattcaaggagagaatggatgaacatttttagggattttgtacacaggattcagtcatcaagatgggcaagatcatgtttcatccctggattctatgattccagagctaagatcttctgatctctcagccaatcctttttcatagctccatagtggtacagagatatggaattcccatagaattgggcattccatggatgtgcctccatataagtgagcacataagcgattgtgatgtcacctagattctcttggacctaagaatacctataacagtgatgatcattatatttgaaattctttttttttttttttttgagacagggtctcactctgtcgcccaggctggagtgcagtagcatgatctcggctcactgcagcctcaacctcccggactgaagcaatcctcccacttcagcctcccaagtagctgggtctacaggcacatgccaccacgctcatttaacttttttattttttgtagagacagggtcttaccatgttgcctaagatggtctcaaactcctgagctcaagccatctgcctgcctcagcctcccaaagttatgagattacaggcatgagccactgtgcctggcctcagaatacccttattaaatgacaaataatttaccagggaaaagttacatactcgaattctgatacatgaaaacaaattagtttctcaaaacaaccttgtttctcagatcagctagtaggaatccaagagagaagacataaaacagtgaagtttagattggggactgaagggaaggaaagcaacagagatagaggcaaggcatcaaacatggaattgtacaactgaaacagaacgttgcttaagataaactttgccttctttgcagggtaatgtaagtcaggacattatgtaaattaatgtatgtacttttatgagaatcagtttttaaagatcacagtattcacacttccaaataaacagagtgactcactactgaatttatgaagaaacttgggtagtggtgagttgctttgtttacttgggataaatgtgaatgtactaataaccagaggtaaatcacaagaaattttccatatggtatggatatcaccattattaggtgaattaatcaaatagtaatgtttttattttgtagcatcttatgatttatagagtgctgtcacatagtttatatcctttcctcccctggatagctgatttataagccattaaattaaggaacatgggggaggggtgcaggaaggaccatctgtgaaagtatctccttaaccaaagttgactttgctggtcttggatccataaacatatctgctctcccctctgtacatctcttcaagtagacctatcagatgtaaaattcacacattctgttagatcacataataaaataagtctttaaatttgcaacataaaattttcaatgtactaccaaaaagtatcttcgtgatgtataaatacatttctccaatggattcactgaaggattctgtggttaaccgagataactagatttggacataagaaaaccagcaaaggatttgtgcactcagacacagatgcaaaagctataggtagagtcattttataaatctgagttatgcttaaaatgtggacttcagttttctagtaaattatgaacatcctcagtaaattatgaatgttattgtaatggtgtgtataatatagccccatctgaaaataataatgtgcatatatcaatcaggcacctaatttaaaagaagtaatgctcttccctttcattccagaattatttggcagtggcagtttggaaatcctatcagtctttcaagactattgtctaactgaaggatcccctaacctaacaaagttttagaacaattggtctagatttcaaaaagcaagacagccggaacatgtggaaataattcaagacctgggttcattgtagctcgcatttccaaacaaagttcttttcaatttctagggaaaacataaaaaaatggagcctcaaaactttccaagagcccagtggaagtgataaaaattcaaagcaaaaagtccaaatgttagtataaaaagattctagaaagcacggggatacttgtaagagtagagttggactctgtgttcccacccatactctaaccaaaaagagtcctaaaaaaaaagaatagcttgacaaagttaaaaagaaatttgagttctctccattacagctgctatgcaaaccaatagacctgcagagtaactgtcttagcaattcagtaactccaaagtttaatatagatggtagttgctttcaacaactgcagatataaattgtgtgtgatggtacacaccaatagtcccagatactcaggaggctgaggcgggaagatcacttgagcccaggagtttcgaggccaacctgggtacctatctcttaaaaaaaaaaaaaaaaaaaaaaaaaaaaaccctgaagagaataaattataagattcatattccaattaaaatcttgtactgctctatgttaatgatccacattcatgaaagaaagtgtttggggccaggcatggtggctcacgcctgtaatcccaggactttgggaggtaaaggtgggtggatcacttgagccgaggagtttgagaccagcctggacaacttggcaagaccccagctctacaaaaactataaaaattaaccaggcatggtgctgcatgcctatagttccagctacttgggacgctgaaatgggaagatcacttgagcccaggaggcagaggttacagtgagcggagatcacaccactgcactccaccccgggcaacatagcaggactctgtatcaaaaaaaaaaaaaaaaaaaatctgtttgagacaaagaagtagtccatcatattggctttggagctaagctctacctttaagaatcaaggaagctttagttgtaaagcatatttcatagtgattataacccaaaaatttaaagtagaggcataaatgaaagacgattgtactgtaattagatgatttggatccagttttgtttcctctaaatgcctgtgtgtccttcaacaaatcagttaatttcacaactgtctatttctttgagtttaaaataaaaatgattttttctgccttttgatgtaaacgtatgatgcatgtgagagcttttcagaagaggcaaagtgttacttaattagaaaaattaaaaatcctcatcattattacttttcgcccctactacccaggagacacttagtttctttgctctatttcctgtctctgaataatacatgcttgacatgtgtccttcctctttggaatttaaactctgaaactcctttatactccttagattgctcttgaatattcttcataacaagaatttttttatttcttaacaatttttataacagtaaaagaaaattcctcacctaaccactctttatccactgctaaacaaaccacggaggacttccttatctctaggagtttctttcattcacttactgcagcttcataaaagttgtgagaaaggaaactaagagttaagggcatgtttgaaagcaacagaattagagagaaaaaaacaaagataatacaaaccatcctgtcagggaagaaagcagtgctcccctctacccccttcatcaagagaaaaaagcagaagtcaaataaaggaatggaaatgaaagggaaagacagagaatacaagaaggataagccttggtgtcaacatggatgtggaaggcaagcaatagggcaaattcaaagataaccctggagcagtgtgatccctacactagcagcatgcaaattatgttcccccacccttcacccccaccccagacatcctaaatcagaaactcaggcaatggagcctagaaatctgtgtaacaagccctggttcatgctgaagttgagaatcaattccctagagaggtgagcctgggtaattagaagaatggcatcaggttgcttttgttacataacattttttaaaattccactaataagaatctgtttagaaaaagtaaatcaaaattatggatcaaagcttgattttgtagtggataaattatatcacagaaactaatcactcacatatgaggtaagttgagtcttccaaattacataggtcacatggcaaatgtatcccttctggtatttagcaggactgacttgtattattcatatcatcatgtattatctttacaccttccctttagaatgtaaactctgtgagagcggaaacacacacacacagagacatacatttcacacacgtatatatacatgtatatcacactttcacatgcccattcatttggtcaatgtgcacattcaccgaaaaccacctgatctccaaaaactattgaaataaaataaataaaagaaaattttaaaatgtgaacacgctttccaggagaatttaattcaagggacttatacacagatacattcttttcacagcaagagttttaaatttctttgttttttctctttttttatttgctatagaatatattgtacacatatctgtgttcacactttcgtgttttttttttacccacaagagataaatattttggcgttttctgaatcatattatcaacagcccgttcactggtgactgtttttagcccattggtatcctctgcacatacggtaattttgcttattactttgagaagttcagctatttcagccatgaattcagtgtaaatagacatagtaacaatagtagcataacaatgttggtgattgggccataatagtcatatgaagataatgtgttaatcctcatatggagcttggactattaattatatcaagccagtgggtgtaaagtaacaagtataaggcttggagtgagaaggccatgatattaccactttctggctgagtcactttggctaagttctgtaactgacctaagcctcagtttttcagatctgtagtacttactttacatgattgctctttgaattgaataacataatttatgtgaaaacacttaattatgaatgctgtaaaactatcaaagccattaatatgtgttatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttctggggatgttaatatccactctattcacaaaattttaagaaaagtcaagtagcatggatgaaactctccaaagttctgcttaaaactaaaatatcttagttgtcactgaagccacagatattttgtgaatgcagcatgttcccaataggcagtccctcttagcctcacagtccaagctggcaacaggatcacatcccagggaatgaacagaaaggctggcaggcaatcacaccgctgatatctcaggtgtgtgggccccccattttttttttgagatggagtctcactctgttgcccaggctggagtgcagtggtgccatctctgctcacttcaacctccacctcccgggttcaagtgattctcctgcctcagcctcctgagtagctgggattacaggcgcccaccaccatgcccagctaattttttgtatttttagtagagatgtggtttcaccatgttggtcaggccggtctcggcctcctgacctcaggtgatccacctgcctcagcctcccaagttacagggattacaggcgtgagccacggtgcccagccgtgtgggcccccttttaaacagacgtctcttgacggagactagactctgcagccagtaaaagctccatatgattccatctgaatgtacttccattgttaatatggaaccttccccattttctggtcgtgtcttgatgttccccattcagaggacctggactttcaagtgttccttctgctttcctcaccagtggccaccttctgctacccaccttctcctctttctcctccttccttgctgcctgctgtctcatcaagcaccctgtcttggttttttgacccatcactgtactcacgaaagaggagggcattgtactagggcagatgatggggaggcagagagaacaggagagtcaggtaggaacagtgcttctgaaaaatctcctgataacagcattcattgtctttttcacagctcaggagaagccttggttaaaatgaggggaaaaaaatcagtagaataagtgggttcttgctgagcccccagtgcaagaggttcctattcaaaattggggtgtctttacccattaggatggcttttacttgaactttgtgagcttcaggcagaaccctctgcatcttctaacctaagcaggatctttcttcctttttttttttttttcacttttcagtcatggtagagttaagtgtcagagctggtccttgagaagaaggtgatgagcaggcattgaaaaattgagaaaaacgtatacttttaccacgcccaacacccttggcaaggcagtaaagggcactgcctccccctcagtttcttcccttgctgtttggtttctgtgcctccagtgctcagtcacgggtttcctaggaaatcctctgtctgtgctctgtgctgacattttatccatataccacttcttgccattcgcatatgtaattgagagagtagacgatacctttaactctgaattacatagctgcaatataatcacttgttttactgattatctgaaataattttttaaaaattcaggattgacttccatatgccatgcaagtcattttgcagttggtttcatttatccttggttcctttgtgatgaatggaacagtttaatttttcttaaaatgaccacatgctctgtactaagtgctttatctcttcaattttcaaaacgccttcacgagacaggtacttactatattattctcaagttatagataaggaaactgaggcttatagaggttaaatgacatgcccaagtcactcagccaaggaaatggaattcatatctgactcctacatctgtataggcccaaaatggatcatttaaagtgaaggaacttatatgaccttccccttgatgttataattcaattatccactttttactttgtgtccccttctgacaaatcagacttgccattcctgaccataggcttaaacctggaaaaccatctctgaccatttatcttcactttttgtttctttacttggagagcaacaatcgacagacctcatccattttatgcataatgtctaaaaccattttgggattgctgtaagtaatatgcaagaaaatagtgggaaaaaaaattttcttaaaacacaatcattcattcctgctgagtgactgcgtttcaaattcatacagaaatgaaagttgtgagcacctcactaatctgaaaatataccccatttagtaagacagtttctgaaatacctacacttcaccatcacagcaccttaataattatagagagcaccttcctttaaggagctcccaagttctttgcaaacatttctctttattaagtaacataccattgttctgtggcagggaagggaacaggatactttgtcttatttaaaatgtgagactgttaatgcattcagtgactaagtaggttgcccttgggtcattcactgacaaggccaggactagagtcctcaggggttgcagtccaccacggactcaggaccactaaatccacaaaggaccatgtgcaactgcctggtccaactcttcacatacagaaaatgaaataaacccagagaaatgaaaacacttaaaaagcccagggtcacatggataattaatggtagaaccaatactacatgcacacaaacaacatacctatatatgctatagagagaaacatgacaactatgaggaatcaatttatagacagattagaagagtgtgaaaataaagtcttcatcagtgaccttgcctcgaggaaaaacacacagaaggtgaaagtttcaaacagcagagcattttaacataggtgaagtttcaacttcttagcagccaaaataccatctggaatttaaggcacgcttcccataaaaggtgacaggtggacatgttttaaatgatagttggccagcctatcatagcctctataaatcgtctgaaagcatgaggatagcaaagaccagctgacttccaggcatgtttacagctgacagaaatgtttcagctaaaaacatgcatgactgtctctcttagggaatctcttacttcaaaaaaaaaaaaggtaccaatgtaaacactatgcatagactgaagtcttcagcaaattgagattattagcaatgaggcttccctaacctttcctgttttaatctaaaagtaaaattatcttctaaccatgtgatcttatgcagcatactgtctggtcagtgtgcttcaaaacatatctgtttatgtttgaaaacacaataacaacaaattcctgatgagagaaagtttaataaaatggatcatgaacatacagcacttaataccaaccctgctacatagtcagcacttaataccaaccttgcttcatagtaagcactcaatacatggtgattgttttcattgctgctattaccataatacatcaaagctctcctatttcataatgggaaaaaatgaaaaacagtcaaggcatatattttaagtggaagttagctcaaattttaaaagacttcttaccttgatgcatagtccaaatgttgaaatattatcctaaggagtttcagaggctttcagttttagtttggatcatggaaggacttttttctctgaggtgagggcctacactgggcagtcaggaatgaggtggtagagatggaccaaacacgcagttcatctcacctgtcaggagcagagctgagaacaaacagcacaaagaaaacaagtctttaagtaatcatcttaaagagatgtcacggacccatggactttaagaatacctcatgcactgagtattattatttaccttactgtttgtaacaaacttgatcatttggtttctaagccaaaccaaagcagtaaactgaggaaaaacaagggtttccgccaacaggctgagagcaaaggaggacgcaggaaaactattttaaaaattgacccaagagttcaaaaggcatatggaagcatttaatgggggtgggaggtatccttgtaataagaataccatgcatgtattcccacactgctcttggtggtctgcaaagtgatttcatatgtattttatgtcaacaccagcacaatgaggtaagtaggactgtatacctcagaggcatttggtgatttgtcagagtggagtgtagtgtgttggtgcccagatttgaataggatcatttgagtctgatatcatcatgttgcccaccgcctactcagcctctacacccgatgaggccaatctgcagctcactacagtcaatagagaacaggcaattaacccttaagttatattttagaaagatttctgtctaaaatagataaacttgaaagtatagctcttcaaaataacgtattcctgtgttggcaaatattttccaaactcacaatcaacacataggtgtatttcttagactactagaagtggggacttaccccaaggaaccaagctatagtgaccaatatccttagttctcaaggattctagagcaccccatgtctccaacgatctttcttctctcttatttcttctatttgtttgataatgttaatgggaaacactaaatcccctaatcaggacactgaaagtgacccccttcaaaagtagccctcccttttccacggagtgaccttgaagacttttagtggggaatatctggtagctttccaagaaagccgttttatggcacagggaaatggaaaacaaaactgtcctggcatcaccataaagcaaaatttctctgcacatgagaggctaggagggcctggatttttccaaacgaggatgatccattaagcaatcaaattttattttttaattgttttatttttcttttttgttgtcttgtttttcctgtccttcattctctatcccttgctatgtctcgctctgtcctgcttgctgtctcttcctacatcaacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgcaaaaaaaaaaaaagtgtcaggatatattcttgtggaagagaaaaagaaaaagaaatggagggtggggggaacaataaaaagttcttgaggcttttttaattcaaaattttatagaggggcaaaagtgacgtttaccagatagaatgctgatttttttaatatatttacaacagtatttgtgtaaaaaaaaaaacaaaaaaagtgaaattgttaaaagtaatttttttcattttggttttgcatacactgccaccaattccttctcttttattttatttcacacacatatatatattttttggtaagtcaagactgttaaggttagcgatactgcttccagatagaaagaataaaaggcaactaaagttatatttgaaagagaggaaggatattttcttcatattttttttaatttttcttaatttttattattttaagtattgcctgggttgatgagggcctctgtggccagcccatccctgctgtaatttgaattgctgctttgtattttgatatgtagttctttgactttagcaagcttaagttgccccactgaataattttttcaactgattcatctagaattctgttctttttcatggaagagactttatctttcagaaagagattgcttgcttctccaaaatttcattgagatcttacaattctagaatttctattgactttactttttttcttagtgaaacactaatagtctagaagtcttgataaatggggtcttttcttttgtgatcagccaggaagaggagttcacaaaactctgccatagctcctcacccttcccaactacaaagagcatcattatgagaagcctgttatagatcaagatgcattgatgccaaaattacttttttccttccaaatatcaccttctgactgtttccaccatggttaagagggctgaataagatgatcattctttagatgacgaattaacccttgcttcttcgaaaggttttagggaaattaacaaaaaaattcccagatgccaacagccaccattcaaaagaccaccaatctattgcatcataccagatgccactctctcttcctagtagggatttctctcctcggtcctgatcaaggtgttataatagagacattttcattatagacagtgtcctgaagggattccagctcaaatataggaattcttaaacctagctgaaactcccaaagtgatttcattgctgggcatattttaacatacttaggggaaagcaaatctttaaacaaagcaaaacaccaaactacagttttaaaaagaagaaaggagagcgtattttagtttcaaaattacattacattttaatttaattttccttctaattttcctgtcagcattttatttacaaaaactgtgcagcaaacgagggaaaatcttccaacacaaacaactctgtaatgactaaattggttttattcatatattttagacatttggttaacttggatctttttcataagttctttgtgatgctttgtaaggttagtgtaactgaagtgtttgtgagtttgatttggtcccacagtgcttaattcagtggatattttgctagaagttttaatgtaaacttgggtggttaactgactattaagtgtaacctattgtgatttctaagaggagtcctgccaagaactgtatgtccaaaactgatctgttttaacagttagtgaggaacagcttccgagataaagtaagttcatttttctattgctaattttgctttttaaaatagcagtgttgtaagactaatatttccacttaccaccaatagagggagcattaattaactatgtcatggaattgttttgatattttggaaaacaagtgattccacccataaaatgaaaagagaagattgaccttaagaaaaaaactcttaaagctaggagacaatgacatgaaatcactcaatacatgttacaaatgaaagaaggccaaaagccactttaaaatattttaaactgtttcacagtagatttgaaagtgtctttgttcaaatttagcaaagtaggaagaattttcactaataccgcctgaaaagttgatcttaggtgccattatgggccacgtgtagctttctgtttctcaaatctgagagagacccatttgccttaatgctgatttgccatgtaaaatgctaagcaattgggttagaatccaccttttcttttggtagaacatgtagagaaaaagctgcaggtgacttgaaaccctgaggagtctatcatcctttccctgtaaaggaagtgtctcttaaaaaaaagggagtgggggaggaggtggaggatccctaaagaattcttaatgaggtgatataatcattgtagtccatgacaaaatggaccagccaggtttgcatagcagtagacatattcctactgtacatttatccttcccaaatatgtcacattctaaaatagttgacaaattattttgtggaaagaggaagaagctggattggagtgggagatctaatctggaggagcaaagaggtagttgtttattgctatgttcctggcccatcaaatggccactttccaaactgacccacattttaggaaataaaccaatctggacctgtttcaaaaggatagagatgcttttagattgtcaattctcacttttaagttaaacaatcacaaatatctttagaaatagggaaagacatttgcttcaaaatcaaagaatgagtgtggatctttttaatttttttttgtttcaagtcctacagtcatcttacatttagaccttcatggtagggtgatatgagtgctaaaaaaatttctttctagtagccaggaaacagatagataagataaaagcaaatgttccagatttaagacttcttaggatgagtacaaggaagagagaaatagtatggaaaggacattttttagcaatttataattttaaaatggaatttgccaaacaagggagaggaaaaaaagtcaaaggggaatttttatctcaagatatttagatatggtttataaaaaaataatattttctaccactaaaaacactggtattatctcagcatcatgggcaatttttccttattacatgccaatatttgtacaaaaaaggcccccaaatgtgtgaaatataatcctaaaaaagaaaataattggaacacatggatctgttacaattctacacagggggaaacaagctaagcaaagaaaaaaaatctgaaatgaaaatctctgtatcaaaatggtttcctgtatcttttaattgagaggtaaactttagctcctaataacagttttatagaccgttctcttcccaaattcctaatgctttgaatctatttgtgccatgattaagtgtgctggataatttcctgctcatattctagcctcagttcattcctagtcatcttagagatcatagtagctcttggccttagaaagacttgggtttgctgtgtttaaaagtcataagggttttattttgtatcatcaaaatattctataaggtcccaaatactctttttcaacccatgaacagtaagaatttgtgaattctgataatgaaaaaagttttcctccaggtatgtttgtttcacattcagtcctaaagccttgagctatgtgtacttccctcacacaggaacaccagctgtcctgtctgtgctctgcctgcgcccaaaactcaatattttctctcagcacagaagtcaaaaatgagatatgccccttataaaaccccttcgattcctgagaaaacataataaagccatatgttgcttccttgttggggctcctccacaatgctcccaacacctgtgacccctaggaagacagggagcaaggtggatctggccaggagtcacaggatatacacccattctggagctttcctctgttgttctagaagatgttatttgattagttggggctgggagcaggggatatatgattttgtggaaaaggtatcagataatcaaatcaggtctgcctctgctatagccagtgtgctgctgcattaaaagggaacaaaaggaaggtgcaacgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcagaaaaagaaattaaaaaaaaagaaaaataggatactgaagacagaaccatgtgacttggtgacaaacaaaaggaggggtgcactagaatttcaataggctccctaattccatagaaaaagcaaagcaacccaatgcctcctgagcctgcagtgcatgaagagagtgcttgagctgacccagccaccaggccttctggggctagacataacttcccactggaacagcagcagcctctttcccctctttgtgttttcatgaagaaaacggctgttctcttaggtagccaggaaatagattacatggggcaaactttcaaaagcaatctctaccctggtgctcaggctacatacagaggcagaaaaggggcacggaagagcccttgctcttgagagagagtattttcatattcccaagggctttccgtgtagagttgctatttctgatatcacttaaacctttacaagaaaaaaggctgtggtgactcagtgttcctataaattcagaatgtggaaactactaatccaaagcatcatttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgcccgggagtactagttttaaacatttccttaacaaggagaacaatccagcaaaaagctttctttctctatacagtgtatatctctaaactttttttcctcagttttagagaacatctgttttatctggtggttctttgtttgaatgcaaactcataactttcaagtctccggtgcaagagcataatctacagatcatgggcaaaatctagccacagtcctgagagtccaggcttctgggatgcccagctgggtataaaagtccctactaaccctgtttcaaattcagaggtttctttggtttagaatgcctcaatgagattttgatacatccaagagagaaaaaaaaaaaaaaaaaaaaaaaaaccttgggggcatctgtttctactagtgttgcaacagttgtttttacccagcaaactcattgcaatttatatgtagattctaataatgaaagagtcttaacccatccagtatgtcaccgctgctgtccaaaatgtctataaatgagtatacattatttatacatgtgcacacacagtgtgagcttccctcagcacaaaactgtttcacattcatattgcccagtgacaacaagatacatttttgaacttctggttagaagtcgaaggtctgacatatctcacgtatctgcttatgctttgttgccttagttgggtgcatcagtatctgtgatgagactttagggcattctgaaggagcccaaccatcagtaatttctatgtatccgtttcatgagaaacttgaatatgcttatgtggagtagagtgcatttaacaaactctacagttctattggatttattgacatgtgtgcacatgtgtgtgtttgtgtatatacttattgtcatctggaagtgtgtgtgccccccaaaggaagcacacacaggcagaggtcctcgtgcatagatacagttgcctcttcccaccattgtgtttaagacttgtggctcccttcccaggaagcagtcacctgcccactctgttgctttttgtaatgtttcagaattgggagaaacaaatgcagcttgttgaatccacagcaaacccacagggacaggctgttttcctccataataaggtataacagaagtcttcaactggtgagcagacaagagggagcagcagtccagggcgtctccccaggtctcctggaggtggcaggggtggggaccaatgccaggcaggcaaagcccacacaaactttggcctgagccatcccatagctcaaaggtcttcattcctttcctctatgcaatgcagtgtgcacacacacacacacacacacacacacacacataaattttattctcaaactaaagcttcctaattctgcctgtactcacaagatatcatcgtaattcacaaactgtgtctcctgaaaccaatgtggcctttgccaaagtctttccaggagtgggttgtttaccatgtctagcaaaccaatagactgttggggggaatgttttttggtaatctgtaggaattgattgctcttgcccatctcaagcattgaagtagaatgccactctagtataatatactgaatgaatggactctgagggtttggtggcctggaattcaggattcagttttctcactcccatgcccttcttttactagatggtttgttattttttatgatttgtacattatttctgttttacagaagtcagaggacattttctttcctcttctattctggtgacttttccccttcccctgttaagtaaggctacttacagttgcaacttttttgtcgttattactttttaaaatgtatattgtctttctatatccaaaagaagtctgtaactgtaaccataggtatttctttttactggaaaaacaattagttgtttcggttttattttttcctttaattaacagtactagtgactttgtgaaagaatatgagttactatttaggtatgcttacttaactacaatacactacattgcagtatttctgaaacctaggacatacacattatatataacaactctatattgaaatatatattacattatattcattttaacttttgaatctgcctatgatcatgagttgattgaaatattatgtctttgcttatatcacccatcaccaacctgctgcagttaatctggtgcatctagtaataatcattagtgctctaatttgctttttatattatcagcttcagtattgtctttagaggattttagaattttttaaagctcagacttagcaaatgtaggaaagtgaaaactttttttgaaacttttttgttggtgtgactaatacaaagaggttcatattcaaagtgatcttgtttagctgacccactcaatatctgaagaacaaaagaggtgcatatgaatgtatctgtgattttcccctgtaggactgtcactgtctatatttgcttttaaaaatatgaccaaggggctacttaagtgccacatgatctgaccaacaataacaggctgcgtttcaaagggccagtcttctgaaaagcgtaagacagtgaattacctagttgtccccactgtattctcaaacattcattttaatactggatctttacactttcttttttcaatacgcttagaattattttaactagtcttcaacctttccctggaggcagcttggcaatatagtgttcattttcctgggagttgnnnnnnnnnnnnnnnnnnnntttggggggggggttttttttttttttttttttttttttccaaaaaaagtaaaaccagagtttcaggaactctttatccacagaggctaatagaaatagaatttggaaatatctatctgagacatttttaaatctgaggaatccgtaaaatggtggctcttgggtatccagccctcaggatctccatttacctgttaaagtgaggatttggtgcctttcttctttagttgggccatcaagaaaacttcagaaatcaggcattctgtcttcctatacaataaatattttcagatcatattttcagataagagtcttcagcttccctcagctattcaacccaatgcatggaaagcctcagttgaataaacttttccaccatcccaggtgcctgaaactagtgtccttcttcacttctacattcaggacaaaatgaagtcaggtttttaaaacctcagtataaaagaccccctcacactggtccaatatgaagacttctcagcgtgaacactggggaattccttcctttcatctttcctaatagattgttgttttctaatcccatcccattctgctgtacctctccagcaagtcccttttcaccttagccaagctccctgcaatgctctccagttgtgaagccttgtattcactaaggaactacgtactcttagtctgctttgaaagggctaatgtctagtgtaatggcaaaattaccaatctgttctccaaagtgttccagcagatatatttctactagacaaacataattgtgaattgactgttagtgaggctgtttcttctctaatgatcacataatatccaaattatatcaacttcattatttccctctttccttttcctaaccctttccctttatttcttgtttctcttgaagactacttcaaattacctatttgtcttcattactgcccccaaaactctaataattgtgacccctaactgttcatttctcttcctttctccaccccattctgaacatccttctttaagttttatttaatgaaagaacact

SEQ ID NO: 791 - DNA, 2684 bp, Homo sapiens
attttcagatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaa

SEQ ID NO: 792 - protein, 737 aa, Homo sapiens
KKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 793 - DNA, 32050 bp, Mus musculus
  misc_feature (1)...(32050): n = A,T,C or G
agtagataatacttaaggattttactgttggccccttacgtagaacccctgtctccaggactgtttcgacctcagagatcctgaatacagcatttctgtaaggatgaggatccatgggctggacaggggtgaagccagcagttaggtttgggttaccagggaatgaaagctaggttctctgagtagcaggtagaggtgagaaaaaggcattccagaggcgcctcagatgggacatcccgtttaaagtagggtgtgcaggtgctgtgatctgattgaagtgtcagactctatcagaagcaaagttatgacctagaacaaaggcagccatgactgcattgcacatctgactggagagagaagggggtgggcacagctgcaggggacacaggaggggaggtttataccttgtccaggcagactgtagaccttccttgcactgtgctgcatattcattcagtacatagtaatgagcaaaataaagtgattcagggcctagccttcagcattgtatgctaggtgccccaaggggtctggatagtgccgtgtaatagttacatagaagggcaataatttgtaattagtagcaagtaagttggtactgctttttaaagttctaaagtttcgtagatttttttttaaaagtatgtgagtggttctgtttgcaagagtaactttattcacttgcatttgttcaagattcctgcttcacaggctatggcagaaaagcagactgaaagtggctctccaagttctgatctgtcttctgctaagaagcaccttttggtgctggagagatggagtgggtgctgctcttgcagacaacccaagcacctccctcaggcagctcagaatcgctgcctacagctgcagctccagaggacctgatgcccttttcaggactctgaagtgaagctcccagcatgcgtgctcacgtgcgcgcgcgcacacacacacactttaaaatagttttaaaaaaaaactttttaaaaaaagtatcttttatagtgtgacttttgtcagtttgacttgtcttagattacatatagaatctttttgtttgttttgtttttcaagacagggtttctctgtgtagcccaggctgtactggaagtagctctgtagtccaggctggcctcaaactcagagatctgcctgcctctgcctcttgagtgctgggattaaaggtgtgcgcgactactgattggcacgtgtagtaccttgtaccgcatgacctatgtgtatatgacggacatgtggaatgttaacgaaggctttgtaacacctttgtgcttcctactcgtagtgaatcttgcttgtatttgtaagtattttgtgtgggtatgtggggcgcctttgctgtgatgtcctcagaggtcaggagacagcttgcaggacttggttcttctctgctctggggcgtaaacccaggacagacttggtagcgggcagtgggcaccttcactcatgagccacctcactggttattaattcacagttcaaataaggttaattttgactcactagattgattccatgtcctttagtttgaaaaatattgttcaaccaagcttgacagtggggaggcaggaaaagtgcccccctccatgatgcctttgctgcaggcagctgtaaaggggaggaggggagctcacacctgccctgccctccaggtgcaggtatgtgggagcactcagtttgttaactcagattctctcctcagagctctatgaacctgcctcctgacaaggcccggctgctgcgacagtatgacaacgagaagaagtgggatctgatctgtgaccaggtatgagcttggcatgagcttggtatgaccaggtataagcttggtataagcttggtatgagcttggcatgaccaggtatgagcttggtatgagcttggtatgagcttggcatgagcttggtatgagcttggcaagatcaggaggtgcagtctgtgtctgcctggacaagacagtaaggccaaagggttgactgctgtgctgacaggaaccagccgatttggcacagtgtaggctgccttggtttctaggggctgcctggctgagatagctggtagcctgtatgcccatgagaggctgcccagtgaacagtgatgtcatggtggtttgtgcaggatcagctgtgggctaggtgagcagttagttttctcacaaaagtttgtcagactcaggattgtgcctgggcctataggctatgctgaaggaccctcttattctggcccagacatgacaaacagtgaggggttggcttggggggggccgttgtactgctgccacagacttttaggaggaggttcccttgtccccttgtctgggttctgaaatatcactgtaaccaaggactgcagctatcttgtatggatagtgtttaggactgagcaagaagagaaagtattactttgctgagacacaagatactataacactcagtgcctgggtctgcacatgtttgaaggtcacaggtcacgaggctttgactgcagagctcggtatgttttggtaggtctggaaggacctggcacagggtatgggcattgtgtttatcaagcactcaattgcttagtgttgtcatgaacaagctttttttttcaggctctgagcaaaaacataatagctaatgttggggggctgattacctattaggagccccacacatgctgaaatatctcaatctcacaaaaccctgagtaaggtgtaaggtgatttcattcagagaacccacagccagattgggcaagaccaacaggtgccggtctttattagctgttttcttctaccatgacttaggctttccccgagctggcagcaaggtcctgaggtccaggttctcaccagaaaaggcctgttccttaggctctgcactcagcattgaacttggagaacagcagccgtttggtgctcaagtgctctactagataagttctgtcctttctaggtgacatcatttcagtttttctcggggtccttcatttgtttttaggtcctgtttcctagcatactcctagacccctttatgcgtttcttcccctgagctcttcagagcgcttctttgtggaggcctttggaggaccagaatgccaaggggtttgctgagtttcctcgtgggtagacctgagtagtgctctctgtggaaaggtgttgagaggtcaccctgctgagaacttcatttggttgctgggctccatttcctgggcaaagagcagatagggtgtacttgctctgagcgtcagcaacacagcaaaactagttgagccgcagctacagagtttagagccacaaaaactagattctttgaggcaaagctccctccctgtggctttcctgtcagttagccaatcacgtatttgctttaggtactaatcacagctctgtagtcctgcatcttagcaagtggtagactcttaaaatagcttctgacataaagcactttaggtgttagagagcactgagcggaagaggagactacagccgcagttaggacatgcgtaaggatcgtcaaggaagggaacttagggtttggatggtgccaagggacaactagaggctgagttccctcaaattgagcagtgtaggcatcctccttccttagcaccctccatgaacattgtgtttctgtgtgcatacatgtgcgttttcctttcaggaaagatttcaagtaaagaatcctccccacacctatatccagaaactccagagcttcttggaccccaatgtaacacggaaggtaaagtacaagacagaaagtccctgtttaggcacagaccttttgccttgacattgattcttgattaatgggagttgaatatccgggctttgaggtctaaagtgactgtccagagctagagggaagcctgtaattgcactccctgtgttttcttctctgcctcctttatttatagtataaaattggatagctgggtatggtagtgtatggctgtgatacacttagaagactgaggcaagaggattgtgggttccagactaacctgagctacatcgcaagatgctgcatacatcctcctcaaacatagacagggttgagaaagaggttagagagatgactcagcagttaaaagaccatgctgttttcccagaggagccagcctcagttcctaacatccacagcgtcttacaactcttgtaactgcagttcccagaactccagtgttgtcttctggcccctttaggcagtgcatgcacacggtccatagacatgcaggcaggcaaagcactcatacacaaaaatataaataaataaaatcgagagggggcaggcgtggtggtgcatgactttcatcgaagcactcaggaggcagaggcagggagctctctgagtgtgaggccaacctgatctacacagtgagttccaggacagccaaggctacacagagaaaccctgccttagaaaaaaagaaaaaaaaggaaaagaaagatggttggcagggaatgcccatcaagtgacagaggctccctgtttacagaagttccggaggagagtgcaggagtccactaaagtcctacgggagctggagatctcacttcgcaccaatcacattgggtaagtcaggtttgtcatctgctctccctgacaccagacactgcctcccacacaggtttgggtccccttttttggtttatccttccggccatgaatagcatctggctccacagagctttagacgtgccatttctggcttttctgcccttctgtactgccagctgctgaccggttacttctggcaagcttggggcctctcttggggtcctgtggctttgactggaagacattcccatagcagctgagaccagagtctgcctgtggtctggtactgggccaagaaaggcctggcaaaggttgggacgtgagatgtattatattgaacaatgaaattagttactaattggtgactagttagattttttggtatagagattacttatttgtttgaaagaaaataatctttgtacatgagcagaagaggcttcctaaagcactggaggtgtaagacaggatcaggcgttggctgtctcccgtgctcacagatcctattgctgccagtgcgctgagtgggccccagggtctgtgcaagactttcagcctgatcagggaaccaggggttgctgaggaagctaagggctgatgctgaggctcagggagagtacagcgcctctgtcccatgaagctgttccagcaagagtaagaaacaactggaaagagtggccacacagaagggacagtgaactaagaccgcagcacttcaggtaggggtgcctcagtgagagcagtgaagggtgaagtgggtttctgggtagatgccagcctgcgtccctgagctttctgagagtaaggtggaaagagccactgacatcaccagcttttcctcttttgtcaagcgcagcctacgtgtctgccccaggcctgatgtgcctggacccctttagagggagaggacatctgtatgtagccagctgcaacagcactcagaagggaagcagcacaggagaggacaggaaagggacccttcctggtgttgggagctgcgctgtggtagccaaagcatggcttccacactacagtcatctgtgacccagacatggaaagccaccaagaaaggtgtggccaaaccctgctgtccccactcccacccttaagaatctcacagaaggaaaactaggagagtgcatcacttaggctttgtgtgtggttgagagtgacactgtggcagtcctgagcaccccgggcctctctcaggccttgccgtcttctctaagtcctgctgtaactggtgggaggatggggggtctgctctccttggcagaggagcacaaagaaacagtcccctgtggttagcacagttccaggccccagggcttcttagcattggctcacaagtttgaggtctagacccagcccttggttcccagggaagagttaagcccgtgccatctaatctgaggcttctctgggtagttctatgaggagacaggatccttctcttcaggaagcttgtcaggctagtcaggggtggaaggaggccaggaccaagtgagaaggggatcctgctttgcttacagccagatggacggggtcctgcgggagtgaggcccgcggtgtatggggtctcttgctctgggctgaggctgcctgagtaggattccagggccctctagctcttgtggtttgtattggttttctgccttgtcaaagtgccctttaacctcccctcaaagtgtcaggatccctaaaatagcagtgtagactcagacaggaaatgagaagggggtggggagctggagagcagacagacaggaaatgggaggcctgtcggcccccagagaggaagctaacttgaggcagctccagtgtcagcttcagctggagctttgctggcaaatcagccaagcctggtgctctagcgccagcctctcagctgcgggtgtggctagccaggatggagctggtgttccagctgtggggtagacacagccctgcagggcagtttggacacagctggactatgtagttccatggacatttcaggaggactagagtactcaggagaacaaggcttccatcctgaggggtttaatgtctctgcactgaaatagacctgtcacaaccccccaccaattctaagggagtttgctcttcacttttattccagagttagcataggccaaagggaaagcaaaaatgccccaggtcattgtcctcctgtctgctcacctgcctgcctttccacattgccatcttcctgggagagccatgactggagcgtgtatgttccctaagcttttttggttctgccggacccactccagccgaacacagaactctcacaaccatctttgctcattgcttctcaaaattgaactcagcggtgagccctctggccctgtaaggctctctttgagatttatggcactagggacttgcaggcttttccaggcccagctctgtgagtggtgaatgctctggatgcctccccaattcctccagcacatggtggaaaaggacttcatgcctagcattgtatcagatcaaagggacacaggaaataatggggttataacctggcccaagaggagagactggctagaatctcatctggctgaagcccatttgtgatgtattctcctgcctctgggaagtccaggctggcagcatgaccacataggggcctgtcataggttatggttttcaggattttctcagcctgatagtaggttccagtagcatgcaagagagcaaatttattgagggctagattgctgggtcagagcctccaccaaaccaagccagtttgcacactacatccactgtgtttgctgtatctgcaggtgggtgagggagtttctcaatgatgagaacaaaggcctggacgtgctggtggattacctgtcatttgcccagtgttctgtcatgtaagtaccacagggcaaaggttggggactcactgggaagcagacagtccccatctatttagaagaaggatgagggctgggaatgcaagccagcagagcattgcctgccatgtgctgaggctgaggtgtcaggctccagcatgggggaaatgtggggtgggaaagaaaaaggaagagtgagattccaacagagaaggtgggcatgggcatccccagagcaggaggaagtagctcaagtgttgctgcagacatgagcaggcaagacaagggaatagcaggcatcagcaaggactggaaagttagctggagtagaagacatgttctagggagcatgaagagaacagtccggcaagggagcttggagtcagaagccaagtgatccaagtaccaggctgcaggacctccaggaaatagcctggatcctcaggagacaggctccttagggtttcatcatttcaacaacattgagtcttcatgaggcagcttgggccctgagatgtgagagggtgactataggcctattgttgaggaaggccagtgagcgtggtgaccttcgacccgaacagatcgaattaagtatttgggagcattttcaagacatccttttcatatggagggagttagctgttggttagcacaggagagcaagcatggtgaggtgcagtgaatgagagcttttggagtcaaagttgtgttgtgcactatctgtggaacctcaggtacctttgtcctcctgactaaacaaattagatgggaaggtgtgtatccctcttagcctcctcccctggtggctgctctgctgttagttatcacccaggtgataagcctgcctctaatctttggacatagagaaagaaggctaactgtgatagtaaatgaagttagcagcatatgcaggcttacactttagttagacaagtcagcctaaggaggacagtccaggtttgctctcagcttcccatgggtcccgaactgaaagtccctagtctgcagaaatccgggtcttgagccttggaccttgcctagacatctgcttgtccactgtccctgcccttatggctcttcttggtccagtgtgtttcctccaggggacctagcaatgtctcccaggtttagcttcccatcccacttgcaggtcattctctttaaagccagagtaacctgcttcccatccacatctctgtggaagtcctacttcacggttctcctgtccctttaaataatctttttatagaaaaaaatggggaagttttgcttaagtgaatttttagttcagaacttttatagtaaaaagatatagatcatttccccaaatatgcctgtctttcttgaaaaagcaaacaatcccattgctccaaaccaagactacactttggtgtccagggcagtcagtgcctttgaaagtagagtccagggaaacaagagacagtgttttggaatggctcgagaggaaaggggtgatccatggctgggtcaccctgttacatgccacctgtcaggacacctcctgaccctggcagcctctcctctgtgggtaccctttgttccagaaagccccagcctttgacactgggcgttcacagtgggcaaaatgtcctatgggggaaagcctttgggagatatgccccagttcttagaggctggggtacagggcaggagggaccagtgagataggggctggggatgtaagagagtgttgtgtgatgtcagctgacctctttgctctggacactgctacttatggtaacagacctgttgcaggaagtaaccagaaacaacactcacttcctcaggggctagaatacctcccctcttcacagttctcagctcccagttccagggaagctgaagatgaggagaaagacatagaagcctcagtcataaaacatcccaccattaagagagctaggcctgggatgtagctcactaggagacctcctatgagcatactggcctggcaggagacccctggctcactcctcagcactgacaaagctaaacaagccaaaccacagaaggcagttagtagtgtgagacagtggtgtactggctgagcttaaagggccacctctggcttttcagaatcctaattcttttcttttcagacctgtccagctcttgatgagctgggctactttagggtgctcggagtctcttggtcactgccactggccactgagtaggacctgcagttggctcatttccctccagcatctttggtacagatatttaagtagagtcatggtgatttaagatgtcccatttgaggctgggagcacaggaagcctgccagccctcacagcccttgggccatggagaagacttgagactcccctctcctagagctgtccaggcctcctctgccctgccttacgttggtagctccaaccaggatcaggtctcccatgcctaactctgtctcctcttcttgctgcccctgctttttgtttgccacagaggcctgaagagggggagatgggcttgctgggggcttggcacagaacttcccttgtatatgtgcctgcgtgtgtgcatgtgcgtgtcctctcatgctctaggtttgactttgagggtctggagagtggtgatgacggtgcatttgacaagctccggtcctggagcaggtcaatcgaggacctgcaaccgcccaacgccctgtcggcccccttcaccaacagcctcgctcgctctgcgcgtcagtctgtgctccggtatgtgcgcgcttactctgccccctgcctcccaccccagccccagccccggtcttggtgacccggtgagtgcttacgctcccccctccactcttgcttccaggctcagctctcttgccctctgcctgttcgcctgtctctgatctgtcctctctctccctgactctgcccagcggtctgtcctgggtaagtacatggtcctcctctgtcccccctgatgctccagctgtccccttccccgtcctcactctctcctagccattccttcctgacctcaggcagggcttgggctttactggccagttcagctcctgcccccaaacccatttcccccttaactctctcttttcccatcagctcgtagagaacagccccagctactcgctggctccttcctttcccttccctttccccttcaggtcttttctctccaaagttgtgccttcttttgtctgtggtttcacaagagcggtcctgtggtggactggatcactttgcagaggccctgttactcagaggctgtccttgtagatccgtagcctttcctttgacctgtgtctctctcgtgactcttctcttctcggattttgtgtcatggacactgctcatcattctggtcttgcaggagcagattctgtatgtgcttccccctctcacaaagcattaaggcagtagagagatgatacagagccaggcatagcctgagccttcataaggcctgtgttttctgctctgcctttgggggacttgagaatgagatgagcacaaagactcacctgccccactgaatgtgccaaagatgtaactaaacgagcatatctttgtgacctaccccaagaactacaaattcctcaaaacaattttgtatttcagaggtctctggggttagcatgattttgacagagtatagagctggggccctgggcagttgccaacaaagacatgtaccaaagaggtgaatggctggcttcactgccttctgcaccctggctgtcttggcatttggtacaaggtcttctttcctccatttctgctgtttctacagggcagcctggtggtctaaccttcaccagcagccttgtccctacctgatcacttggccctatcccccaggtacagtactctccctggccgcagggccctgaagaactcccgcctggtgagccagaaggatgacgtccatgtctgcatcctttgtctcagagccatcatgaactatcaggtaaggggtgatgcttgccactgatgtactgcccgctttcgcctcatctctccaaccaagacagcagagcaccagcttgtgaaagtcaggtttgctagtgcagacctgctggcgtctcctttctgaccatcaagggccctccctgtcctttcctttgcagtatggcttcaacttggtcatgtcccacccccacgctgtcaatgagattgcacttagcctcaacaacaagaatccaaggtgcgttgattccctcattatatctaaagatcctgattcgtctttgcaggtcctttagccaggacctcttctgctggagaagtgaccaggctccacttttaatgttcacagcctagtgagggaacaggcattcctggtccatctccttcctaaaggaaatgaactgtggtggcttggatggggcttggatgttaacttccttcatctcttaggaccaaagccctggtcttggagctgctggcagctgtgtgtttggtgcggggaggtcatgaaatcatcctggctgcctttgacaatttcaaagaggttggtctcttctgcatgctcgtgtgtgtgtgtgtgtgtgtgtgtgtgtatgtatttaagaggagaaggggggtactaggtatatccaatttactgggatctctagtgactttaactgctgagcagcctgcttcagactgagactacaacaaaagccaaagcaaaactgaagtcttttagatcttgttccaggacacctcccagtttccagttaatgaggctctggatagagtgcagactgtggttggagacatggctcagtagtcagagcccttgctgatcttgcagaggccttgagttcagtttccagtatccaaatggtggctcataactgtctttagttccagttccagaggatttggtgcccccttctggcctccataggaacagcacacacattcatatacattcatagcggcaaaacannnnnnnnnnnnnnnnnnnnctctctgtctctcagcacaagctccactcctcacccactggagtgcagcctgggcatcttcactttataagactcctcaggtggctctgctgccatgagcctgtgggtgggatccaaagcaagagcaagtatatcctcagggaagaaggctgttagggaggggagagaactcctgtatggaattttcccatccctagatctacgtctgaaacccagtttgcttgaactcgggattcctcaacatccaggcacagctgtggtcccaccccttcctcctctctgggcctcttccctagcatccattgtttggttcaggaaacagctcttcctctttaaagttgagaaactcacaggagcccctggcccctttttagcagagggctttcctgcatactggttcctcagtgtccccttggggccccagccttctgctgcagccatggcttgactcctttttttctctttttatattgtgatggcttcagatctgctgtctgtgtttctggcctaactttagaggcacctaaatcctaagctacactggagtccttcactgtggtgagggtcagagacctaaagtcagactccagggtctgggttttcttctggtgtccaaaatggcacagtctccatatagagttaaagttaatttggtttttgttttatttttattttatttatatatttattgtgataggctttgtttggtcggttggtttttgttttctgagacacatttttacctcatatcacaagctggcctgaaactatggcagtcctcctgctttagcctcctgaaggccagcgaggatgttagccactgtgccccactgagttttggctaaacttggtctgaaccatgtcttctccatcatattcctgggaaccagaatttggggatttcacttctgcatagtagagattgtttctctgagactttttgcgcattcaggtgtgtaaagaactgcatcggtttgagaagctcatggagtatttccgaaatgaggacagcaacattgacttcatggtgaggacctgggtctgggccagatgcatgccatgtctactgaagcattgctgctgaggccagggccgcactgtgttctgaggctgcctctcttccccaggtggcctgcatgcagttcatcaacattgtggtgcactcggtagaggacatgaacttccgggtccacctgcaatatgagtttaccaagttggggctggaggaattcctccaggtaagctgagtatgaccttggaaaggtgaagtgtttcagggtacagtcagcttagacacataactaagtacaagtaagaatatagtcctagatggatctgaaaccttcctgtttttggcctgggacctgggtccttctgccaatgtctggaagacactgctctgggaagagctgtgaagcagggacggggcactgagggtttccaggaggcctgtgctgactccgtacatgctgctcttcacttttccacagaagtcgaggcacacggagagcgagaagttgcaggtgcagattcaagcgtacctggacaatgtgtttgacgtggggggcttgttggaagatgcagaaaccaagaatgtagccctggaaaaggtggaagaactggaggagcatgtgtcccatgtaagtgtcctttgcttgccagagccactgtggaaggctgggcacagctgggctctagaaatgcaggagctgacctacctgcctccagtggagccacagggaaccctgagacccactgagcctctctagatggaacttgggtccaagccactgggcactacttaccgcaacttaccgaactctgtggctgggtttggccttgaacttggaacagactctgccttgtatctgtttctctttcatagtgtcaggtccgctggtccctgagagtcatgtagggaagccacctgaataagactgccttttggacatagcttttcaggtcctggtttggctttgaatcatgctgagtgttggggcttgaacacagctctgagcatgtcttccccattttgtagctcacagagaagctcctggacctggagaatgagaatatgatgcgggtggcagaactggagaagcagctgctacagcgggaaaaggagctggagagcatcaaggtgccagggaggggaggggcagtggggcggcctctgctcacccagattccagtcctctcctaggcacttcttttcttctcagatcatgtcaagggaagacactaatctatgcccagcactcaggcaaggatgacctggtgatccaccctacctcctgggttttttttttttcttcctcctcctcctctctcctccctccttctttcttcttgagataggatttctctatgtggccctggctattctagaactcagtctatagactaggctgccctcgaattcagagatctctcctgcctccgcctcctagatcctggggttaaaggtgtgtaccaccaccgcctcgcttcctccccatgatttatcttgagagagaatctcgaagctggagttggccagacccggacgagaatgggagtggatgatgtgctcctggtcccctaggatccagggcaggcaggcttcctgtccacttgctgacttgttcttcaaatgcttctccgctctttactgagcatggttagagtagcccgactgcttattactgtctacaggggtcctggagggcagtgcttctcctatttcagtctcttgagttttttctcctaactttatagcttagttataaagccacaacctctttgtcttggaagaatatggttatgtggctactgagcgcggctcagtggatatctgcttatcccttcctagtactggagagggagccaggaaggatagagcgatcacaaaggcttctccgtgaacctcccatctgagctggtatccacagccaatgaaataaaagcagtaatgaagacgtaaggtctgtggagagagcagcagtgcccatctagcaggggaccaatgggagtttcaaaggggcatccttttccttcagccttgagggccctatgcagtgagaacagacttgagcagagaaagatgacctattaccagtggaagcaagctttcttttctgctctgccacactccagctttgctgttcctggatttcttctattttgagcacactgagatgacccttcttgggaatctgttgggtaggaattctgactcccaggggaactgactatagagccttcagcccattcttccctcaatgttgctgtctgcctgataggagacatatgagaacacaagcaaccaggtgcatactcttcggaggctcattaaggaaaaggaggaggccttccagcgccgatgccacctggagccaagtgcccggggcctggaatccatgggcggcgaggccctagccagggtaggccctacagagttgactgaaggcatcccaccctctgacttggacctgctggctccagccccacctactgaggagactcttcctctgcctcctccaccagctccccctttgcctccgccccctcctccactaccaggtaactgggacttccaagccgggaggggcaggttttttgtgaggccagtactgtagtcagaaatgtctttcttaggaaacagctgggaaatagcatcatttgagggccaggaggatatcaagtcaggatgagagagagggctaagggaggaccagtatttgtgggaaataggaatgctgggagcagattctgtttcaaggatctctgaggtgctgctctcaattattcctctgaaggccgccaagctgaaggttaaactgacaagagaaactccgtcagggactagtgctggctctccccttcagtatacttctaggatcaacttgaccagagcttccatagcactcttctctgggtctcaaaggagagggaggcaggcagagtttgggtagcctagagtcttaggactgtgggtcacgatggcatttattcttcccagacaagtgtccccctgccccacctctccctggtgctgctccttctgtggtgttgacagtgggcctgtcaggtgagtgtcctcagggctctgggcagtgctattggagtttttcctcagctcttatctcacatctgtcctccttcgaaaacctagccattcgcatcaagaaacctatcaagaccaagttccggttgccagtcttcaactggacagcactaaaacccaatcagatcaatggcactgtcttcagtgaacttgatgatgagaagattttggaggtgacaggggtttggggtccagaagggtggggctagtgtgaggcctggagactgggatgactttagagccagatcttctggtcttggaaaagctttcaggcagagcaagactgaccccattatctagtcacgactgcaggacacatggtcagtgggtattgtcactgtttgagcttttaacattgtgccttcttatttctgccaggacttagacctggacaggtttgaagagttatttaagacaaaagcccagggccctgctcttgatctcatctgctccaagaataagacagcacaaaaggctgccagcaaggtgacccttttggaagccaatcgtgccaagaacctggctatcacccttcgcaaggctgggcgctcagctgaggagatctgcagggccatccacacgtgaggctcccaccaacttgtgcctggtccccagatagctgttgtcccagttatccccacagcacctgggtttccctggattccagggttcctgacaggacttgctcacttttctcagttacccactaaccagagcagagcatactgactccaggctgggtctcaggctcagtgagagaagctgcatgttctgcccagtaggaagagtttatcgggcgggaacagcatcagcagctgtgtcctgtgtattgctctctagtccttctaaggagaagggaagatgtggacagatgtcacacctgaagtgctgtgttgttcatcctacacaggtttgacttacagacactacctgtagacttcgtggaatgcctgatgcgcttcctgcctacagaggcagaggtgaaactgttgcggcagtatgagcgtgaacgacagccactagaggagctggcagctgaggaccgcttcatgttgctcttcagcaaggtggaacggctgacccagcgaatggctggcatggcctttcttggcaacttccaggacaatctgcagatgctcacaccggtacagcctcttccctaattactatgcactgctgtgaccagtcatgtccactgtccttccttctggcctatgccttggctttatcctcctcccaacctgggtatcatagtgttcatcttgtctttcagcaactgaatgccatcattgcagcctctgcctccgtcaagtcctcacagaaactgaagcagatgctggaggttgggaaagggagtgcctggtgctggtgggtctcaagtcctagggcaggggggtcctggggctgttgtgagctgcctgccttgcatcttaccaacagatcatccttgcattggggaactacatgaacagcagcaagcgaggtgctgtctacggcttcaagctccagagcctggacctggtaagatggcagggacagcatgtgcaggacatacagaccctagtgcccaagccagggcgctcagtgctgccaccacctctccctttcagctgctggacaccaagtccacggaccgaaagatgaccctgctgcacttcattgccttgacggtgaaggagaaatacccggaactggctaacttctggcaggagctgcactttgtggagaaggctgcagcaggtgagggtgccctcttcaagacgatcccaggaagctgaacaggaggaacacccggtccatttctggcttttgctatcttctttctcactactaaatctatgagcaggggcaaccccaaagagagtgagccttccatgtgctcaagtaggatcaggtttcccttagcctggcccagagagtgtagttctctaatcatgtctgtgatgtgattagaaaacctgtaaagccccctacagacagatacacagtactactgtttctgtcctgcccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgatgccaagactgccgaggtgagtgaggaactggggtgggggggaaacaaacatctaaagccagcacagtggccacttgaggtaggcatccaactcttggccagcagtgtgggcaggtgagggggtagtaacaagggactttaaagatagcagatatccatgtctgaagctatgacttaggaggggcttgggtaactggctttcctctcctggcagcaggctttgctttctgtgggcctcctccccactgggatgacccctctgtctgccctttacttactcaggaggcctacaatgcagttgtgcgctactttggtgagagtcccaagaccacacctccttctgtgtttttcccagtatttgtccgattcattcgttcttacaaggtaagttgaagaaacgtttcaggagttatgctggtagaagatgattagtcaagagcgagcctgggcttcaagtctgagacttttccagttcctaaggtctagggaaggaaccatggaagctggcgacaggcctctaaactgtggactggtgggcagggtgggggcccaggcccttcctttcattgttcagagcaggaagtacccctccagagagtggccacctggggttagctggtcccactgccacccacccttcatgcttagtgtcaggccctcccttccagcctgtgaaaacctcaagctccttcccctctcttggtcctatctaaggaagcagaacaagagaatgaagctcgcaagaaacaagaggaggtaatgcgggagaagcagctggctcaggaagccaagaagctggatgccaaggtgggtgggaccaagagctggtctggaagacaggacagagaattgaggattcagggagcagggagcaaggagcaaggaaggacatggagaaccaagacacacacacacacacacacacacactctctgtgtctgtctccctccctcccttggagtggctgacagcgtgagtctagagggaggggtagacaccgatggacaggacacagggttactctcagcagggtcatcttcagcctacatcttgggacaggaaccagttgcttttgggttagtgatgacttccttccccttgtaatatctggcttagactccatcccagcggaacaaatggcaacagcaggagctaattgcagagctgaggcggcgccaagctaaggaacaccggcctgtttacgaggggaaggatggtaccattgaggacatcatcacaggtgggacgtttgtccactgggcccaattcccagagcctgacctaattccctttggtcctgcttcctagtctgttttcccataagacctgatcactgtctctcctgggccgtagtgttgaagagtgtccctttcacggcacgtactgccaagcggggctcacgtttcttctgtgatgcagcccaccatgacgagtcaaactgttagcctgacaggtactgggcactctagctgccctctctgcatgccttggagtcatcttctggtagcatcctcccagtgatggagacacagactttgcatgctgcatgctctgagaaacacagcttatccctgcatgggtcctcccactaatactgtcctagctactaagatccaagggttaaggtgtctctgggccagggttaggagctaggccagagcaggcaagacctaatgctttggatgactgaggctccagtcatagacccaaagtatcttgcttgggtcctggtctcccctaagagttctagtagctcctactcagggatagatgtccctaacctctgcttcttgacatctagtttggcttaatattttcctgggtggcctttagtttcctatgctaccctctgagaatcgttccagcagtttttctagctggctctcaagccttcctctaagagcttccctgaccttttcatggctgacttcttcctcaggtgctgtcttgctcggtgtccctgcctagtcactgttcatgcgcttgttttccccacaggctttaaccaccaacgcatggtcgttcacagtcaagtcaggagtgctgtaccacccagtggccctcctcgagctccaggtccccactgagatcctcctggaggcagaagtaccttaattctcagagtcctgcagatctggacagtgggcccagggcccagcagaaggctgtgttgttcaagctcctgctgctccagctgaggctggctcgtccctgtgccactgtgggcactaggtctatagtggtctgacatttccctagtgccccccatagtgcactttgccccaagtcttcaacttcatttcctgaagggtcagttcagggctgggaaaaaccacttccggcttcagcacacgagggtacacagcccccctcttcccagggtctagtgggatcctagaggaggaagtacatccaagaagaaatacgggtccccccaccccgcctttgcaatcccacagtcagctctgatttagagagtatccacactaatggatccctggactctgccaatattggataatctttgcctgggcccactctgctgaaccctagtaaaaagggacagaggagcaatggcaggcccactggctgcctgcgtcttcagggttcttttgttgctgttctgctctcctagacccatgtcccacccaccttggcacccatcttcttggcttcctgagccagctgctgtcctgcattgcctcctgctccacttccttaaaaccaaaggattgtggaggaagacctgtggctttcaaaagtggaaaaagaagggctaacacttaacatgcagagtgggtggcagtgggagcagctgacccctggcggtctccctctggatgggcacttcctgctccaaacaatgcaaggaagggcttggaccccaccctgcctgctgtcttcccactgattgaagagcagaggcactgtctgtcccagctccaagactgctagaggaaggatgtgccgcaatctcacctttcctcagctaggtggactctggcccaggaacaggcaacagaggatcttcacagactatttgctcaattccctactgggctctgaccctggaagggaatgcaggggcactttgttttgtatatgtatcttttcctttcttgtacataaatcccagacctctcaacaaagtcttgcaccaagctgtcttctctttgtcagagtggccatgaggatatgagtttgggtgggaagtgttttcctccatttcaggagtgatgagcctagatggcaggggaagcctggctgggctttaaacacagggaggaagctgtcagaactggagtgccctctgctggtccccagtggatagtacatgaagaggacaaaggagttgtagatcatgttataaatattatttaaaaaacaaaacagaacacatacatcgggtcccaggggagaggaagtagtggtggagccccagggccaggtcaggcaagagcaggcactgatgctagagggtgaggaccctgccctcggccacccaggctgtgtccaagcagcctgtctctttcctggagaccccttctcacactatctactggcatcacccaccccgtggtatagactgcccatctctggtctggggctgagggcaaggactgcactagtctgagaactaggggacccttgaacaccaaaagcaaccttgagaggtgctaacagtagtgtgttgggggtgggttactttaggaaaagtggacacagaccagacaagacgaaggagtctgaggcagatgctgaggcgaccctggagccactgcctcacgaagtccaaggcagaaagtagctcgtggggtcattggtggtcgtccagctgctgtaggagtgtccgccttcgcctctccagctccccctcactcagctcgctttctgacgtgtcccagcctgtctgttgagcaaaggtgtgacttacctgagccccctagtctgtgtcacaggctggggcgaaagccaggtcctcccattcaccttctccttcttgattccgaagcctggggaacggttagggagctctgcctgccggggttccctgtcctgttcctgttctctgtcttcactctccttaccagctttgtcttcggggtccgtctcactgtcaggactggtctgtaagagttcagagcccatgtcagcagttgagcggcacagctgggaggcaggtgacatgactgcagaatctcaagacgactcctccactcaccgacttgtgtcttcttttcttggttttcttttttggtttcttggttttccgaagaccatgatctatagggtttaaaaaaaaaaaatctacgctgagtcccatcgggagaaggcagctccttgcctgggcagagataggaagtcttgctccacagtgaggccctcccatcccagtcagccctcagcggtctgggatttgctgtgcctctatcccagcactctagttcccgggctcctagaaactgcttacctgacccaagaagaaggtgggaagatggggagcctggtcctccaagagcagcacccccactttcaactgaatcaagtgaggaggagggctcagagccagattctgaggggttccgcctcctccgcttggggggccggagggatggtgggggcagctcctcttcatctgactcagagccctaggcagaggagtaatactggtcagcccagaagccctcatctaggaactggggacagggagttcagagccaaggaggtaatgtatggggagaggtgtttaatttgtatgaaacagtccagcctcacccatgtccctctacctgccgactcactgagggtgagtgtgaacgcttgcgatggtgtttcttgccctttctgccatgctttcggcctttggtgtggaggtgctggcattcagtctgctagaggcagagggagaggtgagaaccttgccttcctgtctcagctagggccctctgtctattctagggcaccctcagtccttcccttctttagctgggcaggtaaaagagcctttacggtgacaagctattgaaggtctcatgcaagcctagagttcaaagatacatagatcagggtggccaagtgccttacctccaacacctgcaggaactctcggaagagccggatccgctccgactccagggtgatctgctcaaaggctgagtcgcacacaaagcgctcacggaccttgaacggggagagcactgctgatcagaccaggccctgcctggaccagcttggacaccgccacgagaactgggcagggctggggcagaggaaggaagggaactggagctggcccagggcttgtgctgtgactggggtgggccctcagtggtggagaagctccgctgccctcaggcctgagggtgattggggccaggctgtgcttctgacctcttcccaggcagtgcccagctccagagcaggcacggcctgcctcagcatgcttcgaaaggcagcttctctgcgccgcatccttcgggcctcctccttttcccgttccctctcccgtgcctctgctttttccagcagctgaaggcaaagggaaacagaatagggtcaggggtaccttaagaggtaggaagatgtgtcccaaacccaagataatcagcagggcagttaggaggaacaagacattggggtaagtgagaggaccacccaggcttgcccgtcccctcacactattgaaggtcagcttgatgttgcctgcgtccagcgcagcagccctcttgtcaaagcttatgacgtgggcgaagtcctcaaatgctgtgttcacctccacacagaagccccgatcctgtgggcacagcagtgtgtgaaggccaggggcaccacaggccagtgggcaaaagggatcaggctgcaaggtgttcaagcctggcctctgccctcaaataggatccataagacttgtgacacaccttagaaaccatgctaagtcttcatcttactggccccatccgacctgtgtggattcatatggagccaaaagagtcagcaagtgtcttccgtcttgatagatgactgagttattacaattaggtctttgttcctctggccacagctgggccttcctgctgctcatggaagctgccatgcatgcttaacatctggtctataccctttgcctcatgttctgggtgcttactgggtagtaggttctctgctgagtgcttgacacgtttctccactaatcctctcatactaggtcagtcttctaattttatgcagaccagaaaaatgaaatcacttattctaacatatcccaggtctaaatcccaaatctgctttcagccactacacctaccctgaatgcataggtccaggaagagatgttggccatcaagtgtatagctctccatcaatatttaaatcatgttcattgtcttaagtacacagccaggttctgtatttctcaccaaaaagcctccatgtgctagtgaagttaaggtgcaggagaggaatctcacttggccaagctgataggtaaatggaattctgtgtcacaggccagcttgcctgtcctttcacacagctggcttcctccagtcttcctgcctgctgatggcaggagtatacattgctttttcccaggagtcttttctctgtcaaggctcagcccttcctgaacacatcctttctatgagtgaggtcacaaccagaggactctgggtatacagctctgtctccctcccttgaaacctcagtctcactgaagctgaagccttctgtttttgttaaactatcaggccaggatcatgtctctgccatgcctcaaggctggggttgcaagcatacccagattttatgtaggtgctgaggactcaagcacaggtccttgtgcttgcgtggcagcccttatctccctagtacgggccttcccctgggaaggcttggactacatcttcttcactctcctccccaggagcacacagctcacttcacttagaatatccctctatcttgcttttagcgtctcaagctaactaactggttctttccctcggtttcaattccttagacacagcacaaggaaaagaaataaacaataagagattgttataagcaagacacttgacaaaatggtaaaaaaaaaaaaaattctagctgttatttatctcttatatatggattgtccgcaattcgcagaggttttcgggccaaagagcagactactgtgcgatgtgtgcagtactctcctctccagggctgtttgtggtcacttcccctgtgttaatgttcctgagaactacccttacactagctttttacctgacctacatcttccctagcagtttccaacccatgccaaactggctactcttctaatgcagcagctctcctgtacccatcgctaatcttctacctgctccaagctcagggccctgcagtcttaggtgatgagagatgcccctacagttcatgtgactggatggacggccacaggaacttctaagatcatcaggcctccatggctaggagctcaaacgaaggctagaagtccaaaataaccagttgctttgggtagataaaacccatcaggccactagttcctctagctaaatgttagctatcttcggatagacatctatccttcattggctttactcctccctgcccaagctgctttaaaggatcacgtcccaactggaatgcttgtcttctgtaggcacctctttatggctcaaccctcgttgcttacaatctttaacacttaacaacagaattgccattcacttcacaaaacagcctggcgattttattttactggttctatccagagtctaaacatttattttgtatatatgtgggcacccatgtgccatggcacatgtgaaattggttctttcctcccagtatgggttcctgagatcaaactaaggattggtggtgaacacctttacctactcagtcatctcaccagcccaactttcaccgtttttaagacaaagtttctcaggctggagagatggttaagagcactgactattcttccagaggtcctgagttcaattcccagcaaccacatggtggctcacaaccatttgtaatgggatcagatgcccccttctggtgtgtctgaagacagcgacagtgtactcatgtaaataaaatgaataaatcttaaaagacagggtttctctgtgtagccctggcagtcctagagctcactctagaccaggctggcctttaactcagagacccacctgcccctgcctcccaagtgatgggattaaaagcatctgccatcatgcccaaccaactataaccatctttttaataaaagtcttatacatggtacactaaggcacaaaagagatacaagcttttctattagaaaataggggaagagtcacctccagacttggccttgatgctgttttcttctcagcatccctatagtgtcttgctcttcttttttgccacttagattcttaacagctgcctgactggtcttccccttaccctcttatatccctctaacccagtctctggcatggtgtggttctccaacctttatatcaaagagcactgataatcggagagtaccgggatcaagtccagagacatgggtgagctaaaaagtgtagttcaatccaaagccctttgtaaagctctagagggcatgtggttccagagaaataggagaaaaccccaggacaatatgatgcatctcactgaagagtaactttgaaacgttgaactcttagggaaatttactcaggtttttagataggatccgttgtgcagcccaggctgacctgcagctcacctgctcctcgccttcaagccctgggattaaaggtgtgagccacagtgcttggtttattaagtccatattgaacaggtgactgtattacaatacaacatttgtggctttgtaaggcaatctgcctaacagtaccatgtccctctccacgaaagagacacagttgctatctttggtaactgggggttccttggtggaacacttaccacttctgagacaaactaatgcttagaaaagttcttaagggcttaatctattttatgtatgtaagtacactctcttttttcagacacaccagaagagggcatcagttcccattacagatggttgtgagccaccatgtggttgctgggaattgaactcaggacctctggaagagcagtcagtgctcataaccactgagccatctctcaagcccctaatctggactctttacccctaggtcctgcttttagtcaccatactgtatggtatcttaatacatacagtatttactagaatagaatagtgtttactatcaggatattagagttcctattaggatagtaatagagacatgtatttaaaatagtattcacttccatgaagaaatacatttttttccttttggaacaaaacgatcccttcacttacacttgagagtttgacaagcatgaacaactatttcttcagtagagaaaatgacagggcacatggactagtgaacagcagctgacacttgccagcactacggtgtagtgaggtgaagaaagcctcaccgtcctcctctaagagggcaatggcatctcagccagtgtccatggtgcgccttgcagaacgagcccagtgctgacatcatccacactggcaagagacactgaagattttatgtgaagccaggcacagtggtgtacactataatcccagcatgtggaagtgaaagaaggatcaggagttcagggccagcctggaatacataagaccctgtctcaaaaaccaaaacaaaacaggcttttatgtgaaatctccagattgtaaagtattagcaacaaattccaaattcttcaaaaccccttccaggcaggcaggcagcagcagcagcaggcaggcagcagcttagcatatgggaattcgagtttacaaatgctatgcttgcccctcgggctggcgtgccctttccacccattgcctttctcctgtagcacccctatgtcacaacacaccacccctccatctcctcatcctgagggtggggtccacatcacctttcctgggaacacctgtccctggctaatgcttctcatagaagagcaaaacaatgatttgttactttggtttttagtctatttttctgatacaggatttcaacctggttggtactttcttcctcacactggctttgaactcgtggcaatcctcctgcctcagttggaaagctgacctgcatcactacatcttgctagaaaatgtgtctatttgtatccccaatgcaagctgccaggttcctggaaaacatgacttatggagtcctggttcggggaatgtggcttccacccagtctatccatgtgtagccccaggtctctctcaccttaaggatatcctttatgatcttcttctcatcgtggaatcgagccttcaactcctccacatagaacttgaacaagtccaaaggagtagagcctgcagaaagggagagatggggcctggcgggcggcagcttcccaaggctcagggtagggtcacggccaggaccagggagttaggtccagagaggctgacagggtaggaaagcagagcagacaaggggaagcctggctgccttacccggctggcccagcatgttggcaaagcgaacgtcagtgctgactgccgggtacagctccatccaggtggacatggagtgcagctgccctgtctcatgcagctcgtccaggaagctctgcacaggaaaaggccacaagaggaggagaatgagatagttggggacacatggccagtgtctaaggaggagaaaagggatggcagagggacgagcagaggcaactcaggcaaaggcactacagatggagaaagcatgaacatacaaccaataagccagcctggaggccatgaatcacagacctacctcagagcacagtttcctgctatgaccagcttcatcaacccactatcactcctaagctgaggaaaactacctgtctggctctcacccaaaggaaaagacacttggtctagctgccactcctgtctgagggtggtacatacagcctatctccctgaaggagcacttctgcagagtggcctggtggaacttgaaagaggccagtcaacagccaacctcgttcagaggcaggccactgcaaaaaggctgtgctctagagcagagcagagctgagccaacctctgatcgtgatgagtatgaaatacctgaaaggcctcccgattcttccgctgctgtcgccgctcccgaagccgggcccgttctcgctcttcctcctcctctctctccaaagcccggatatgctcctcaaagcagataagtgcatcttccttgtccatgtctacgggcagggaagaagcttagcaggcacagatgagtaggacgtccctcagacctcaagaatgcttcccatgtaggtgaagcagggctatatgggagcagtcactgtactgggagttcttgggcgagtattaactgtactggaaaaaattagcaagcattcaactctgatgaattcagcttttagaaaccaccctggaaacctagttatcctgcaatctgaggcatcacatcctggggaactggacacagtcaggcttcagcgcaggttcagaaggtaaccacaagccaacaactcctaactacagttaaggcccacaagaccatgttcaccatgatctatagatatcatcaccatcatctctaggatttcacatttttatccctaaaagacatacagtgttcatataaacagtggacccaggactaggggttaaactcagtagtagagtactttgcctaactgataccccaggtcaaattcttaccatcacaaaataaagtaaaaaaataagatacaggctgacctaaaatgtatgtaagggccaaggtttaatctgtagcactacacacacaaaaccagccaaccagagaggtaacatcaaacatctggaaatccccgaatcccaagaggaacagtaaccaaacataaggggatgggcaagggggcggctcgaaggtctcaggacagtgcggagggaagaacagagagccaggcttactctgcagctgctggtcctgagcaaagctggggttatccatgaggtactgctgggcctgggaccaagtggtttggaagttgacactgctcatcccatccaggatgctcttcagggcctggatattccgacgccggagctgcttggcttgttcctgggaagacacagggttaaagtgaggcagggccagcatgggaggatcctggaaaggaggacaagactcaagacttctgggtcccacaaaggagaggaatcccaggtcacaaaccagtgtcgtccttgccctccctcacccagggttattggctcgggacaaagttccacaccagcttccaattcaggagaagggacactgagcaaccaggtccacaagaaatggagagcagcagagtccagcccgtgagtgtccattaccttctccttcttggccaggaagaagaggacatcatcataaacttcctttctctctctctcagggaccacagcccagacctccaggtccccaaaagtctgttctgcccgcctgtggagcacatgggctgtgagtaggtcgagaacagaccatgcacctgtgtgttttcagggtccctgagccacagcccagtctagtacagttccctgaccggtagcgggtggtggaggtcatgcgttcatgctgttccaggaaatgctgcagggtctgcttggcctccttggctctcagccgggcctcctctttctcctccttctcccgctgagccttgtaagcattaaacgcctgcttcttctcacttagtttgggcaaggcactggagtagacagttgaggaaaggagaggatgcagcgtgaattaccctgttagcccatgaagcagggtcacagacatgggggaaaggtctccaccacaccaaattggggacctaacatacaggtgtggagaatatgggagggatgaggcatgagggaaagaaatactggaccctgttgcttcagtgttctcaagttaccatcagacatctgtctccttagggcccctatttctctaattttaattcaagccagtaaccatttactaagcatctcatggctgtaccatttccctctttgcatcttggagctattctagcttttccttctcttgcagcc

SEQ ID NO: 794 - DNA, 2892 bp, Mus musculus
tctaggtttgactttgagggtctggagagtggtgatgacggtgcatttgacaagctccggtcctggagcaggtcaatcgaggacctgcaaccgcccaacgccctgtcggcccccttcaccaacagcctcgctcgctctgcgcgtcagtctgtgctccggtacagtactctccctggccgcagggccctgaagaactcccgcctggtgagccagaaggatgacgtccatgtctgcatcctttgtctcagagccatcatgaactatcagtatggcttcaacttggtcatgtcccacccccacgctgtcaatgagattgcacttagcctcaacaacaagaatccaaggaccaaagccctggtcttggagctgctggcagctgtgtgtttggtgcggggaggtcatgaaatcatcctggctgcctttgacaatttcaaagagggctctgggcagtgctattggagtttttcctcagctcttatctcacatctgtcctccttcgaaaacctagccattcgcatcaagaaacctatcaagaccaagttccggttgccagtcttcaactggacagcactaaaacccaatcagatcaatggcactgtcttcagtgaacttgatgatgagaagattttggaggacttagacctggacaggtttgaagagttatttaagacaaaagcccagggccctgctcttgatctcatctgctccaagaataagacagcacaaaaggctgccagcaaggtgacccttttggaagccaatcgtgccaagaacctggctatcacccttcgcaaggctgggcgctcagctgaggagatctgcagggccatccacacgtttgacttacagacactacctgtagacttcgtggaatgcctgatgcgcttcctgcctacagaggcagaggtgaaactgttgcggcagtatgagcgtgaacgacagccactagaggagctggcagctgaggaccgcttcatgttgctcttcagcaaggtggaacggctgacccagcgaatggctggcatggcctttcttggcaacttccaggacaatctgcagatgctcacaccgcaactgaatgccatcattgcagcctctgcctccgtcaagtcctcacagaaactgaagcagatgctggagatcatccttgcattggggaactacatgaacagcagcaagcgaggtgctgtctacggcttcaagctccagagcctggacctgctgctggacaccaagtccacggaccgaaagatgaccctgctgcacttcattgccttgacggtgaaggagaaatacccggaactggctaacttctggcaggagctgcactttgtggagaaggctgcagcagcaggctttgctttctgtgggcctcctccccactgggatgacccctctgtctgccctttacttactcaggaggcctacaatgcagttgtgcgctactttggtgagagtcccaagaccacacctccttctgtgtttttcccagtatttgtccgattcattcgttcttacaaggaagcagaacaagagaatgaagctcgcaagaaacaagaggaggtaatgcgggagaagcagctggctcaggaagccaagaagctggatgccaagactccatcccagcggaacaaatggcaacagcaggagctaattgcagagctgaggcggcgccaagctaaggaacaccggcctgtttacgaggggaaggatggtaccattgaggacatcatcacaggctttaaccaccaacgcatggtcgttcacagtcaagtcaggagtgctgtaccacccagtggccctcctcgagctccaggtccccactgagatcctcctggaggcagaagtaccttaattctcagagtcctgcagatctggacagtgggcccagggcccagcagaaggctgtgttgttcaagctcctgctgctccagctgaggctggctcgtccctgtgccactgtgggcactaggtctatagtggtctgacatttccctagtgccccccatagtgcactttgccccaagtcttcaacttcatttcctgaagggtcagttcagggctgggaaaaaccacttccggcttcagcacacgagggtacacagcccccctcttcccagggtctagtgggatcctagaggaggaagtacatccaagaagaaatacgggtccccccaccccgcctttgcaatcccacagtcagctctgatttagagagtatccacactaatggatccctggactctgccaatattggataatctttgcctgggcccactctgctgaaccctagtaaaaagggacagaggagcaatggcaggcccactggctgcctgcgtcttcagggttcttttgttgctgttctgctctcctagacccatgtcccacccaccttggcacccatcttcttggcttcctgagccagctgctgtcctgcattgcctcctgctccacttccttaaaaccaaaggattgtggaggaagacctgtggctttcaaaagtggaaaaagaagggctaacacttaacatgcagagtgggtggcagtgggagcagctgacccctggcggtctccctctggatgggcacttcctgctccaaacaatgcaaggaagggcttggaccccaccctgcctgctgtcttcccactgattgaagagcagaggcactgtctgtcccagctccaagactgctagaggaaggatgtgccgcaatctcacctttcctcagctaggtggactctggcccaggaacaggcaacagaggatcttcacagactatttgctcaattccctactgggctctgaccctggaagggaatgcaggggcactttgttttgtatatgtatcttttcctttcttgtacataaatcccagacctctcaacaaagtc

SEQ ID NO: 795 - protein, 608 aa, Mus musculus
SRFDFEGLESGDDGAFDKLRSWSRSIEDLQPPNALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEGSGQCYWSFSSALISHLSSFENLAIRIKKPIKTKFRLPVFNWTALKPNQINGTVFSELDDEKILEDLDLDRFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPELANFWQELHFVEKAAAAGFAFCGPPPHWDDPSVCPLLTQEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGFNHQRMVVHSQVRSAVPPSGPPRAPGPH

SEQ ID NO: 796 - DNA, 24634 bp, Homo sapiens
atccacattccagggttgttgtgaaaattagatgataacgtgtgttaaagcacttagtattatttggaacataccgggtctgtattgtggtagcagatctattgttaatttcattattattatttaaagtggcataccctaccacaattacctgaatatatgaaattacataataaacataatgaccaacacatttagacttacacctaagacaggtcagccttagggagaccaatcttcccagtttgcccataactttccctagttttccccagcgtcccaggaaactcctccatcctaggacttagccctgacatttttttgagacagggtcttgctcagttgcccaggctggagtgcagtggcacgatcttggctcaccacaggcttgacttcctgggctcaagcagtcttcctgcctcagtcctgcctcagccttgctgagtagctgggaccacaggtgtataccaccatgcttagctaactttttgtgtgtttttagtagggacggggtttcaccatgctgcccaggctggcctcgaactcctgggctcaagcgatccaccctgctttggccttccaaagtgctgggattgcaggcgtgagccgctgctcccaaccagcttccacttttctaactactgtccttgcccccttggccattcttctttgtccagcaggtcttcagtgtcatccccttaggaatttgatgcttcttctatgttcggcgcctctcaccttttccaggttatcctgttaaaaccaagagtggcccactgcattcttgtctcagcagaagtcatacctcgtgtgattctcttatctcctaaaaaaaattctttttatagaaagaaatgaaaaacatttggtgaaataatttttcttaaaaaattcagagcttttatagtaaaaaatgtagctcatttttccaaataagcctctctctcttacttgaaaagcaaacaaattccagccaccctaaaccaagagtaccctggaacctcagtattgtagtgtccatggcaatacctttgactctgtttttaaaaaagaaggactttgtgtgggggagagaatgtgtgttttaggaaggattgagagggaaagggtgaggctaaatagagttggagtgaagataattgtttgtaaactgcatataccagtacaagaggatacagtgttactgatggaatcagcaagctgtttccctgtcaggaggttcctctgatgtctacttgagagccccattaaacacctcctgatcatgaggacactaaagcctgctcccacttcctttggaacattctgacgtctgtaaatatcccttcctattccagaaagcctcaacctctgtgcctttgaccccatgtctgagcagaatgcttcttgggggagaagaacctgtaagagatgctcccttagtctttaatgacctacatggaggaagaggacaagaaggaggagagggactgtttctcagaggggtatatcctgaagtgaggatgataagagaggagtccctgtgagtttgtgatcttggccatcttccttgtcctggccacattgacaaactgctgacggtcgctgggtgcagtggctcacacatgtaatcccagagctttgggaggccaagatgagagattgcttgagcccaggagttttaagaccagactgggtaacatagcaagactccatctctacaagaaaattttaaaaaattagccaggcatggtggcacgcacctgtagtcccagctactcgggaggctgaggctggaggattgcttaagcccaggagttagaggttacagtgagccatgactgtgccactgtattccagcctgggccacagagtgagaccctgtctctttaaaaaataataataataataattgctgatggtggaagacatctgttccaggagcagaaagtgacaaaccattcaactcctgcagaggctatactacaggaccctggtctacaatctcaacttgtaatttcttcccccagggaaactgaagcccagggagcctgtatacctgaaaaacctagaaacctcaagtagccagaaccatagagaacctggtcattaaaacccagtgctaagatggggcagtggtgctcctccaaacaataaaggactgtcccactctgggtttgccagaaccccctttcccttccatttagtcctgccatccagaatcaactggactccttcaaagcactgaagggccctttggttgctggcatttgccagctagcaagacctgcagttggctcattccccaccattccctctatggggcagattcttcatggggagccacagcttcccggagatgtcccaactaagctgggagtgcagaaagactgccagctcccgagtggcccatggggaggacactccttctggaatttcctggctagtggggagcagaggagttggcctccatcagcttcccatctccttagactgccctccttgttgctgcctgtgctgcttctgccgctgttctgtgttagtggctcttccagctaggatcaggtctctgctccccagttctgctttctctccttgctacccctgctgcttgttgccctagaggcctgaagggtgggggtgggctcacggggggccttggcactgaatttctcctgtgtatgtgcctgtgtatgcgcatgtgtgtcctttcatgctccaggtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatgtgtgcttttgctctgcccacctgcctcccaccctacccttcagtgcaggtctcgggttcagcagtgagtgctcatgctcctccctccactcttgcttccaggctcagctctcttgccctctgcctgccagtctgtctctggtctgtcttctctgtctccttgactctgcccagcggtctgtcctgggtaagtacatggtctcagctgcacttacccaacgtggggttccagctctccccattcctcacccctctctgggggagcccttcattcctctcactctgccattcctcctgggtctcttgagcagggcacatctcatacaggtccatggccttcactgggtgatccagctcctactctcattctgtttccctctagttcttcactctgcccctttagctgcttggagaccagctcccacccaacctggctgccccttgcattcccttcacctcttccttcaggcctttctctctgaggctgccacatgctcatttgtctgcggtgtcttaagagccgccctgcctggaggtaggcggatggactggatgacttctcagagccccttcctactctgggaggctttcctttgggtcccatggccctttccttggtttctgtctctcttgtggccatgctttcctcctagtctcctttgggttgtgtcccttggacactgttgattattcttgtcatggatgagcagatactgtatgtgtctcctcccttttccatgaaacatcactgagagggtggaggggtggtgcaaagccagacatagccctgtggcccagctgaagcctttaggggtcagctctgccttttctgtgatacagaagtgggatgggagccatgacgctcttgtcccacagattgtgcagaaggtgcagcaactggaagtgggtggagggaatgctcaaatgactgtgtctctggagccatctcagggactaggaaggcctacacaactactatttgtattttgaaggatctctagggttggggcactggttataaaaccgggatcctgaatagttgctgacaaaggcctgtttaaggaggtgaaaacaggctgaccaccctgcctcctgcaccctgtccctcttggctgttggtacgaggtgctattccctattttttgccactgctaaggggcagcctgctgtccgggtgatggtgagtgtccctagatgcttcactggcagcctcagctcccacctgactgcctggcccatctccccaggtatagcactctccctgggcgcagggccctgaagaactcccgcctagtgagccagaaggatgacgtccacgtctgtatcctttgtctcagagccatcatgaactatcaggtaagggggaagcactagccataggtgctctacttcttctgcctcatctgcaaaaccaggagagctaggagggcatcagcttataaaagacaggtttgctggtgggcctacggtcaaggagattggctgggctcccccttccccaccatcaaggtcccctccttctgtcctttcccttgcagtacggattcaacctggtcatgtcccacccccatgctgtcaatgagattgcacttagcctcaataacaagaatccaaggtgagttccttccctcccctttcctccccactctgtccagggctctggagatctgtactccatgtattcctgacaagttctgcctggccttggagtcctgtcaagagccttggtttggccccctcctctgctggaagagaagtgtccctggctctcctctggtctacacagcttagtaagggagcaagccctctttctcccaccctctctcctcaccactgaggctttctccactctccaaaaggacttacccagtcagggaaatgagctgtgtggttgtcaggatggggagttagggtgttaatcttccttcttcaccccttaggaccaaagcccttgtcttagagcttctggcagctgtgtgtttggtgcgaggaggtcacgaaatcatccttgctgcctttgacaatttcaaagaggtcagtcttttcgcttcgcgtgtgtgtgtgtgtgtttgcgggggagaaggcagggagctaggttggtaagcaccatttcctgtgatctgcaatgatttttaacatcccaatgcttggccaagcagcctctctcctgaactcccagtatttttaaaaccagaactttagtcttactagatcttcaggccaggaaacctcctgattggccagctaaagataccctcagctagctgagggctatagtccaatggtcctagttgggccctgcatccaaatcacctaaggagcttgttaaaagtacagatccctgtgctctagttcagacccactggaggcctgagtatatgtacttaagtgactccccagatgggagtctgatgcggtgaacccattggtagaacccaaagcacatgtgttttgaaatgggaggagaaggtaagcaaggatgtctcctgatttgttggctgttattggtgaggggagaaggaactcctgtgtggaatttcccccagcccctgggcctgcctctgaaacccctatctacttgaacataggattcttcgacatccagccacagctggtggtcccaccccttcctcttctttggacctcttccctagcatccattgttcaagccaggaaatggctcttcctccttgaagcccagaggctcagaggagcctctagacccctctcagagagggctttcctgtacactggcccttcccctgcatccccactaggactgcagcctcctgtctcaggcatggccttcctcccttcctccttctttccctccttcctttagtaacttggcagcatcagacccctatgtttcttcttggcctatccccagaggcacctaaagcccagcttaagggcacaggctttactgaattccctcagcaatttggtgggggaccacagacccagagccagattgcaggtcccagttttctttattttcttttttgagatggagtctcactctgtggccaggctggagtgcagtggcacaatctcagctcactgcaacttccacctcccaggttcaagcgattcttctgcctctgcctcccaagtagctgggactacaggcatgtgccaccatgcccggctaatttttgtattttgagtagagatggggtttcaccatgttgcccaggctgttcttgaactcctaacctcaggtgatgtgcccatctcggcctcccaaagtgctgggattataggtgtgagccaccgcgcctggccccaggttttcttttatagtgtccagaatggcctatttcatatatagagctgtggttaagcttggtctgaaccagtcctttgccatgatgttcctaggagccagagcgcaggggcttgggttctgcatggagcagatcctttcactgagaaagtttgctcattcaggtatgcaaggagctgcaccgctttgagaagctgatggagtatttccggaatgaggacagcaatattgacttcatggtgaggaactgggcctgggtccagcacatacccaccagggctgtgtgtgtgttccttgacaacaggggtgaggccaacagcgtatcttgatattccacgtagagcccagaatgattctattcagcaaatgcttcttgtccacctgcctaccccagagagctcttagaaacttcaggatatcatttgtgtatatcagatctacctccttttcctcttttctgtggcctttttgtccttgaattggatcctttttgagctgccctccctttcctaagctcttcctctagcttctcttcccctcactgcagggtctttggctaggtaaggttgtctcgaggaatacctgttgatgtacaaaggaaatcagatagctatatcttcacttacatctgtttttcatgtaatttacttgtctttatacactgaatattaaatgacatttttaaaattaaaatactcttattgcccccataaagacttaactctttaattgactccctgtaattatccacatgatgatgatattctaacagccgcctatcctcctggtctcttgcctttcctctgcccttcctgttgctgcttctctgggcctcctcttcttcaggtggcctgcatgcagttcatcaacatcgtggtgcactcggtggaggacatgaacttccgggtccacctgcagtatgagtttaccaagctggggctagaggagttcctgcaggtgagctggctggggtccttgtaaggtgaggtgctttgggatcagtttagccgtatcacaaatgatttttcttttataagtgcctaatccttgatgctcctgggaccctgcctgtcttctgtagcctgggactcaggacctctgcagctaactccccagtcaggcagctccatgggggcgagaatctgacatggcctgcagcaggaactctttgggaagtggtggcgaagggggatgaggactaagactttctcagaaagttcccctgatgatctgcctgctcctacaactactcctactctctgctcttcccccagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatgtaggtggtcttcctttgcctgccagagccactgttgatggaagctcaagtaaccaggaatcctgagctgacccatttgcctccagattgagtcccagggaggctttagaacccaccagggctctcaagagcatactcaggcctgagccactggatcatccaccagttggaatacacatcgacctccagggctgggcatgaggtggcattggtcttgagacagtcagaatgtggcctttgtcttgtatctgttattggaatataagggaaccacctgactaagctgcctttgtggccttgtgttgaggggtccgactcaggtcttgactagggttcaggctgtgctgagtgcccaggctttagggccagcacagaacctgcccttcctgttgtgcagctcacagagaagcttctggacctagagaatgaaaacatgatgcgggtggcagaactagagaagcagctgctacagcgggagaaggaactagagagcatcaaggtacaagtactctggggaaggcagtccctgactgatcctgggctccagcgccttggggttctgctttttttccctgagtcatatcaagttctctaggatttagatcttgattcacccttgaggtactcaggtgtgggtgggctgatgatttcaccccatttttttagttggagaggaaaggtggggccagtgtgagccagacacacacataagagggtgggaacagctggggcacccacaagcattctggagttccaacccaggcctcctcctaccagcccatcccattgatttttctcccctctacccccgtgttcctcccccagccatgtttaatgagcaggggcagagtgaccaagtgctctgtgtattaggatgtccaccaggtatcctaaattggcagggcaggtactcttcatatttcattctcttctgtattttctcctgactttttgttcattataaagtcatgcccccatcctactttctctttcagaagaatatatgctggctctgttgagctcaatatgtatctgcccagcttctgctgagcattgtattgggagctatggaggatacagagatggttaagacagggtcttgtttatagggggcttccaattgagccattatacaaggccaagtgaaattaaagcaaaatgaggcccaaagggttatggagagagccgctatgtcagaccggtggtagattaaggagagtttcacaggggcaaccttttttcctgggctttgaggggcccatgcagtgagaattggctggagcagagaggacacttcagggtgccagcggagggaggcagcttctgcttgcctcttttgttttgctgccttccagcttcctcattcccccacctgggtttctgccactctgagcctctgagtaccctgacagagaccctcgttaagagaaccctgggtaggaattctcactcttggggcaatgactatgccttcagcccacttttcccttaatggtgctgtctgcctgccaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccaggtaaccacgacgacccctgggagccaacaggggcagcctctttgtggggaccaaaactgtagtcagcagtgtcttcctcagggagaagctgggaaaatggcattatctgaggacttggagggatataaaatcagggtgagggaggcctggaatctgagggaagctcaagttatcagcacagggatgcccaaaggcagatgtggacctgttttaaggatcataaagatgttgctcccaattcctttgaagacagccaaggagaggcttagactgtagccatagaaactgggtcagagaccagcaacaactgccctgtcagagttagatttctgggagcagcttgagcagagttcatgtaggctccttctctgagagttttttttttttttaactctcagagaaggtgggacaggcagaggggagggaagcctatgaagagtctcttgacgcctgggtcactgtgtcatttcttcttcccccagacaagtgtcccccagccccacctctccctggtgctgcaccctctgtggtgttgacagtgggcctgtcaggtgagtatccccagggctctgggcagggctggtgggaccaggggtgtgtgtccttggcccctgtgtcactgatcctccttccaaattagccattcgaattaagaaacctatcaagaccaagttccggctgcctgtcttcaactggacagcactgaaacccaaccagatcagtggcactgtcttcagcgaacttgatgatgagaagatcttggaggtaacagggcctggggtccagagggctaaggttgagggctagggacctggttgccttttgaggagattctggtcttagaaaagccatcagacagggtgaggccaggcttagctccaccaacccttcattcttgagtgtacgtatatttctagttgtgtcaacactttgtgtttgtattcaggaaatattccagagtgacagagctctgggccaatgctgggtgggctgtcatgaggtcctccactagtatgaggctacagcgttttccttgctcacctattcctgccaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtgaggctcccactgacctggctctggtccctagtctgttggcaacccagttctccacccaggagcctgggtttccctagattccaggtcatctgacagaactccctcacatccccctagtcatccactggcttggctagaatttactgcatctgtgctggcagttcagcccagaccttcacccaaggagctctcagtctattgggaacagtgcagtaacactgagtgataccaccaggatggtagaagtatacaggcagctttgggagaatagggaggttcatgtagctgagcttggtgatgaatgagggaagccttcccagaggaggtaatgtctcaactgggacctgaagaaaagatatgagttagtccagttcagggcctggagggagaagcatagtgccttgggtactaaaaattgaatctggctttagtgtagggagaggagcaggagaaggtagagagttgggcagaagtcttgcaggctggacctcgtaagccatgctcaggtgtttggacttcaccctaggtacagtgggagtacatcaaagggcttattaaacaggagcatggagtgttcccccgggatcattgctggtgctgtgacagatgatgcaatgggtcctttgcctttggctgtgttccgtgtacagtcccctgtccagttcttctaggagcttggagaataaaagggatgagggaaaacgtggagagatgtgagaactgaggtggtccctccctcctccacaggtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccggtacagcccccacccaactcatggctctggacagctgtccctccaccctccatctgctagtcacctcccctgcccttccagtccttctgacccctccctgtctttaccccatctcagcctggggttacttcagtgttcatattgtcctacagcaactcaatgccatcattgcggcgtccgcttccgtcaagtcttcacagaagctgaagcagatgttggaggtgggaagaggttgtgaacaggggtgctgggggttttcaggtcctaggtgggggcctggggctatacagagaggaagaaggagccttcaggacctgagcctgacctgcctcccacacattctttggacagatcatacttgcactggggaactacatgaacagcagcaagcggggagctgtgtatggcttcaagctccagagcctggatctggtaagatggtgagggcagcgtgggccaggaagcctggggggcagcagttgtggagccagagtgcttagctcttgtgcaccgccctcaccccctctcctagctgctggataccaagtccactgaccggaagatgacactgcttcatttcatcgccttgacagtgaaggagaaatacccagacctggctaacttctggcatgagctgcactttgttgagaaggctgcagcaggtgaggagagcctggctgggtgggcctgccctcacatccagcccaggacaatcccaggaagctatgaggagagagaacacttgggtccatttgtttctggcttttgttatcttctttctgaccacttcaaagctttccgctggagccttaagcaggggccactccagagggagccttcctccaggcgccaggcctggcccagcccagcccttcccagctaggtacagtgggagcaggaacaagaaggggagcagtcgctctttactcccaactccctcaagctggccccagaggtcttgtgttttgtgtatgatgtatgtgaagtgcttagaaaaaaatcataaagctctctatagacatgaggtagctgttatttctgccccacccatgaaccctagggcaggcctgaggcagtttcattttggagaccagcagtctctgtggcttgcctgcctttgctactgtgttctttggggtcacaagctcagtttccattccattccctccccctgtgagggatcagctagcttggtgtgtacttccttatgtccatacaggtatgtgaacctgagtgagcccatgctgagggggagggccagagtttgatatagctctgggctgggaggtgagcatgccaggccctaggcattcctcagccaggcttttggtgaccagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcaagcacggggtgcaggcggtgggagcaaccagggccaaggcaccaggcccctctaggtggccctagttctatttttttttttttttaaatcaagcagctggctggctacatgtaggggagagagagcgctttgggagtgccaggcagctgcctctggagacatgtaggggagagagagcgctttgggagtgccaggcagctgcctctggagactcatactcaggagctttgggagccccaggttccctccagctcacaggggcctgggtgcttggttttcctccctttggccctgggctctgctttctgcaggcctctcatccgtggtgtgggagctgggctgatcttcctgccagggtgacccattctgcccaccccttccccaggaggcctacaatgcagttgtgcgctactttggcgagagtcccaagactacacctccttctgtattcttcccagtatttgtccgattcattcgttcttacaaggtaagctgcagagagctttttaagaagtttggttgcgagaaaactggctgggggagagaagcctgggcttaaagtatgggccttttccgactcctcctccgagtcctgggaagggagcgatgcaagctggtgacaggcctcttagctgtgaactggtgggcagggtggggcccaggaccttcctgtcattgtttggggcaggaagtgcccctccagagggtggccacctggagttagcgggtcccactgccacccactctccacctcagtgtcagcccctcccctcacagcctatgagcctcactccccaccccccatcttccatggctcttaggaagcagaacaagagaatgaagcccgcaagaagcaggaggaggtaatgcgggagaagcagctggctcaggaagccaagaaactggatgccaaggtgggtgggaccaagagctggggcctggaggacgacaaggcaaaagagtgggggctgggggtcagaaggctagaggagatgaaaacttggagtggacagaccacccagagggccagtgggctggcatccagagggatggagggagggcctttggggattcctagcagtgcacaagcagtggcatcctcagactgcaccttggggcaggaaccagtcccacattaggttagtgatgacttccttcccctccacattcttggccctagaccccatcccagcggaacaagtggcaacagcaggagttaatagcagagttgaggcggcgccaggccaaggaacaccggcctgtttatgaggggaaggatggtaccatcgaggacatcatcacaggtggggcccttttcactccctggggcctggccattgcacccagctcccaaagctcaacctaacccctttgggctctcctcccaccccaccccccatgaggcctgaccactgtgtctctctcctgggccacagtgctgaagagtgtccctttcacggcccgtactgccaagcggggctcacgcttcttctgtgatgcagcccaccatgatgagtcaaactgttagcccccaaggttggggcccgacaggtactgggcaccgcagctgccccctctgcatgcccgtctcccaggattcctgctgggagaccacaggcaccttctttcctgcatgacttgcaatcaccctctggcagcctcccagcaatggggacacatacttcttgcatgccccatgctctgagaagtgtggcatatcccctgcatgtgtccttagggaagtggtctctctcccactaatgctgtcctggcttctactaagaccaagtgggtagggagtcaccaggccagtgttgagaacaggccagagcaggcaggaccagacctacagttctgatctttgaggctgaggttgagggtccattcccaggcctaaggaacctttccctacggttctcttctcataagagctctggtagtagcttctgaccaggaggtatcagatgtcccttgatctgtttcctgacgtccagtcagcctggggtcttttcctagtttctggctctttctgaatgcatctaccttgtctctctccactgcccagtggcctctagtcaccccaacctgatcctctgaaatgcaaagcccagcaatctccccaaccagcaatttccccaactgggtacccctcaagccttatctaagcctcctgtttatctgcctcactgctggctcctccctggccctacctgtggggctgctcttgagggcactgtcctggctcaccctcccatcctgttcacaggtctctctcttcccccacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccaggcctgactttgtctcctctttctgagcttagggggctagggtggccatttagtctgacctgggctatggggatagaaaagaaatctttggggcactgcatctgttttggaggagatgagatcagaactctggggaaaggagaaccggctaggtgggctctagccacacaaagggaagcaggcctgccatgagacactagtgccctctgctgggcatgtgtccagtccccagcctgccccagtagcacatggaaaagagtcactggccatgttataaatattgttatttaaaaaacaaaaaacaaaacacacgtacattaggtcctgggtggaggaagaagtggtggagcctcagggccagggcaggcaggagcaggcactgatgctagagggtgatgaccctgccctctgccacccaggctgcgtccaacagcctgtgactcttccctggagaccccttctctcacacttttatctactggcatcacccaccccacatggcatataccacccatctctggtctggggctgagggcaaggactgcactagtccagggagtaggggacccttgaacaccaagagcaaccttgagaggtgccaacaatggtgtgctgggggtggggttactttagaaaaagtggacacagaccagactaaggaagaagtctgaggcagacggtgagggtggcccaggagccatggcctcacacagacccgaggcagagaacagctcattgggtcactggtgatcatccagctgctgtaggagtgtccgccgccgcctctccagctcaccctcactcagctcactttctgacgtgtcccagcctgtctgttggagcaaaggcacagttcacccttagcctgcactaagggccgtggaagcttgaccagcgtgctgactggcctagggcccctgcccctcaccttctccttcttgattccaaagcctggggaacggttagggagctctgcctgttggagctccctgtccttgtcctgttcttgttctttctcatcgctctccttgccagctttctcctcagggtctgtctcactctcaggactattctgtaagagtccagagcccacctcctcagttcctgtggatagcctgggaggcaggtagaacagaactcacaaaatagcaggggcttaggtagaagttccttcactcaccgacttgtgtcttctcttcttagttttcttttttggtttcttggctttccgaaggccatgatctagagatagaaaaatccctactaagtcccaacaggagaaagacaggctctttttctttgttctagcccctctgttcattcttcacaggcaggaacctcatgctctgaggaagtctaagtccagttttccttctccagcttcttgcttgggcaggtagaggaagttctttctacttccacaggtgcagccctcccaatccagtctaccctcaaaggagctggggcttgtggagggcatcctctcagtctgggacaacagttctccagcttctacgctcacagcaactgcttacctgctccaagaagatgggaggaaggggagccccgtcctccaagggcagcacccccactttcaactgaatcaagtgaggaagagggctcagagcctgactctgaggggttccgcctcctccgcttggggggccggagagatggtgggggcagctcctcttcttctgactcagagccctgggcagatcagcagatacatgtcagtgcagaggttctctgccctccagaagccctcgtctgggaattcgagagaggaggaggacccagggccaaaggaatcctcaaacttccctccaagggagatattgtaaggggaaaacaaagtgtttatttccccaaaacaacccagcttcaccccatgtcccttctacacgcttactcactgagggtgagtgggaacgcttgtgatggtgcttcttgcctttcctgccatgctttcggcctttggtgtggaggtgctggcattcagtctgctagaggcagaggaagaagggtgaggacagcaccagacttagccccaggaaggatcctacttcctaaaatctggctttgcctccctttctcagactagagccttctgcctatcccagggatcctcaggcctccccttccttagctggccaggagtgccctaagggtaagagggaggccactgaggtctctgttgaactggtctaatgagttcaagggcctgaggcagatccagaggacaagcctgcctcacctccagcacctgtaggaactcccggaagagccggatccgctccgactccagggtgatctgctcaaaggctgagtcacacacaaaacgctcacggaccttgaacgaggagagcactgctgatcagactaggccccactcagcctggcctggacaccgccatgagcacagggcagggctggggcagagaaaggaagggaactggagctggcccagggctgtgacgtgactggggtgggccctcagtggtgaagcaccgctgccctcaggcttgaggggtgcttggggccaggctacgctcctgacctcttcccaggcagtgcctagctccagagcaggcacagcctgcctcagcatgcttcgaaaggcagcttccctgcgccgcatcctgcgtgcctcctccttctcccgctccctctcccgtgcctctgctttctccagcagctgaggaaagaagggacacggaacagggtcacccaggagggtggatgccaggtcccactcaggcataccttaggaggtggaaagttagggtctgggcttctaccaccatcccctgaattgggaatatagtcagtgggacagtgagtgagaaggaatggagcaagacacagatgaattagagaacttcccacgccccgcccagcccctcacactattgaaggtcagcttgatgttgcctgcgtccagtgcggcagccctcttgtcaaagcttatgacgtgggcgaagtcctcaaaggccgtgttcacctccacgcagaagccccggtcctgtgggtacagcagtgcatgaagcaggggcaccacgtgcctgaggccaaagctggcaggcagagtggtcacattacagatggtcaagaaggcccttgcctctggaagagatccacaggactgtggtctgcattagaaaccaagttatccaagtcctcatcacttgacaattaagcccccatgcctacccttggtttggatgtcacacagagctgaaggggttgggagatgtctcccaactgctgattaatgctgagtttctcaaaattaacttttgttcctttggcttaaagctctggccccagctgggccctcctgctgctcagcagtgcttccatgcattctcaatcaacatttgctggcccctaccctttgggtctatttattgagtgcttactatgtaccaggtaccatgatgagtgtttcacacattatctcatttaatcctcttggttctacatttaagaataggtcctagtatcctaattttacacagaaggagaaaccaaggttcagagaaactagagcacttgcccaaggtctcacagctgatatacggctgggcaagaaccctaccctgggggggctctctatccccaaagtgtctgctttcaagcaccacacccacccagatgacttagtccatgggagaaacggaggccaccaggtgtgcagctccccaccaatactaaaaacatgtccacaggccaggctctatgcttctcatttaggcctcacaacattccagtgaagcagaggcttagaaaagtgatctcagttggcccaagatgacatgagtggtaaatgaagccactggagttcaaagtctggctctcacgtcagttaagcacaggccagattccctttctctccctccacatagctctcacctcctctggcctttttgctgatggcagaggtgtgctcctctttcttctttccaagggtacttcctcaaccctgctacagtccttatcaacacagcattcattctcagggaattgaaagctccaagtcacccttgttactggctccttccatcaagcagacacctcacctaacctggaacatcctttccaccatgctctccccttcatcaagctaactacctctgctcttttccattgtttcaaaacctcttgaaatgcagcagaaaggaaaaggaataaacatttattgagaacctattagacactttacagatgttatttaattctcacaaccttacctatgaattatccctgatttacaggtgagcaaacaggctcagagacacggaacttacggaggtctcagagccaataagcaaccaggagtaatctgactctaaaacatgtgctgcccccatgccacctccatgactctactctcccaaaggttgcttgtgtctactagccaaatccaaggccgccttctttgtcctcactcatctggtcctcagtgcctctaccacttacttcttcaacactcccctctccaggtcacaccctctctgaccttttattctcttgcatatgcatgttcctgagaacagcacttagtcctctttcactacccaatctgtactccctcgcaatctcatccttcatctctcctgattttcaaacatcctagactggatatttcagacacttaaaattcaacagatctcaagagaatatatttctcatgagcatcctccatggatctccctgacccggatctgtctgcctgttctaagtccagggctctttgcattatcctatgggatgaaaggcaccatcatggtctgcctggctgtggaaagcaagagggactcctgggctcatctgccctccataggcaggaacccaaatggggaaagaggaagggaactgtctaaaaaagttgctttctcaggttgtgtggagagacaggactcagtgaggataggcccctacaggcctatcaaccagccactctgtggctaaaagttaattgtccaataaaatttagctatcccaggataaggcatttctactttatacgattattctgttttaaaatatatttgctttgagagtaattccccaaatagaattcctattttctacagccttgctcttcttgttttatccttatcaatagtgccatcatccactgccctgacacctctgattccttcctttccctccatttcacaaaatctatcaattctacttagtgactctatcccactggtgttgaattctcccttttttttttaaacagcagaaacagtttattaaaatagaaatcttatgtagaacctttatgcataaaaaagattcaagctgcttcacttgaaaacaggaagcagcaccaaatccccccatactcaactccaacccttgcttgtctcaaggcacctacatagaaacccagagtgtctcagaagaacagctggagcgctacagcctgctctcttctgctgtccccactgcccccggctaggatcacctcctacaagattcctgcacagcctactgacttttctccctgctcaccctcttccatccctctaacccagctcctagcatctagtgcttcttggacttttgtaccaagtagccccaacagtaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatggtaagtaatttaaaatattaaatttatattaaataggtaatatggtgttaaaatgcaacacctacgtgaatttgtaaggcaaaacagtacttcaaagaaatgtatatgcagtgagacatttctagctttatttccagatccctttcaacccaggtaccatttaatctctgtaattaggtgtactctggtggaacactcaccattttttagatgaggaaacagggtcagaaaggtcaagtgacctatccaaggtcacacaactagcaagcagttaagctagacttttactgtaggcagtctgcctccagtcccgctcctaaccactgtactgtattatctcctcaaatgcattagaatcttcacttccataaagaaatatgctctttgtttttttcttttggaacacaaggtttagtccatcactcactcacttttccacttttgataagatgtaaatattgagaactatttctcttctccagtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctgaaccaagctgtaatgcttctgcaaaacaggacttatcagggagtcctctgcagggagtgtgccctgcatccatcctgtatccatccataaccccagcctccctcaccttaaggatgtccttaatgatcttcttttcatcatggaatcgtgccttcaactcctccacatagaacttgaataagtccagaggggtggagcctgtaaggagggagggaggggggcctggcgggcggcagcttcccaaggcctgggggctgggccgaggacaggagccggtagtagggggtgcagagaggctggcagggcaggaagccaggccagagaagggggagcctggctgccttacccggctggcccagcatgttggcaaagcggacatcagtgctgactgctggatatagctccatccaggtggacatagagtgcagctgccctgtctcatgcagctcgtccaggaaggtctgagcagggagaggccagttatagggagagtgagacagggaggcagagccacagactgagggggaagagagggaatggcagaggaagaggcagggacaatcaagattgaggaaatgcaggcaagagaggcagagatgaagagatgcagatggaaggctgagaacaatgcaaaaagagagaaagtaaatacacagagagggacagaacaaaaaggtgagaacaagccagtcccgggatgcaaagaaacagaaacctgcctgcagtaacccctagcactaccaccaccactgccacccccaagctgagggaataaactctgcctgtcgggtgccccaccaagggaaataaacatggcctagctgccaagtcatgcctgtagggtgctctctactggcagtttctgggtggtgcatacatctagtctccctagaagagcacagtccagaattgaggaggtacagcagaaacagactgcaggcagagagaggtctcatagagcttggacagggctaggcacagaaagaacaggcagcgtatccagaagggggcagggaatgggtgaagaggttgtgctctagggcagagctgagctctgatctagaaaggacagcaaagatacctggaaggcctcccgattcttgcgttgttggcgtcgctcccgaagccgggcccgctcccgttcctcctcctcttccctctccaaagctcggatgtgctcctcaaaacagatcagtgcatcttccttgtccatgtctaaagacaggcaggaggttccgcgggcattgtcccagcaggataccctctcag

SEQ ID NO: 797 - DNA, 1454 bp, Homo sapiens
tagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcaagcacggggtgcaggcggcctctcatccgtggtgaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttag

SEQ ID NO: 798 - protein, 483 aa, Homo sapiens
AIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEASTGCRRPLIRGEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 799 - DNA, 76846 bp, Mus musculus
  misc_feature (1)...(76846): n = A,T,C or G
atggagtttaggaagaactcagacttgtgacaatccttctgcctcatccttgatggtgttacaggaatgtgccaccattcttggctccttcaattaggaatattgattataaactgaattagaagcaatagaactggacattataaccagaatgttactactcctagaggtatcttgaaatattgtttacattcattacttccttgaaactatggtggttactagacccatgtgaaaattgggccttaaactcagagatccacctgtcttggcctcccagtaatagaactaaaggcatctaccactactacctggctaactatattttaatataagtgtttttccttctaattacatctattttatatattatgagattattgagcagagaacatgagttcagctctctgcattcatgtcaatggctcactatcacctccatcaatggctccaacttcgagggatcagagacctctggcttactaccaggcacccaaactctcttgcacatacccatactcacatatacacaattataactannnnnnnnnnnnnnnnnnnntgtttttgtttttgttcttgttttccgagacagggtttctctgtgcagccctggctatcctggaactcactctgtagaccaggctggtctcaaactcaaaaatctgcctgcctctgccttccaagtgctgggattaaaggcgtgcgccacgaccgcccaacaataaatactattcttgatgtgacatttaatgggaaagtatccattctctttaatggaccatgtggctaatgtggactatccatatattaaaaaatacagttgaacctgactttacacaaggtactaaacttaagtttaacttaaatttaagagtgaaaaatgataggcctagtggctcaggactgttaatctcagttagttggaattctgaggcaagaggatcacaagttcaaagtcagcctaggctatagagtgagtttaagaccagcctgggcaacttagcaagatcttgtttcaatataaaaagtaagaagagatttgtatatagctcagtggtagatcatgtgtcatgtgggtgaggccccaggatcaatctctgacaaagagagagaaaaagaacagccaaactataaaattctcagactaaaacagattgattttttttttaaatcaaagctaagactttgcaggagctaggtgtggctcagtgttaagagcactggccattcttcctgaggcccagagtttggttcccagcatacacacggcagctcagagctgcacaaagaactgccatatgacctgggaattctacccttactcagggtcctgagagaattcaacaccgggattgaaatagatctgtgtcagtgatcacagcaacattactctcagaggccaaaggaaggggacaaccgagtgttcgttaatatgcggacggacaggcagagcagagcgggtagacagacgcacaccggattactactcagccacagaagagaggcagtgtgccggcacttgttataatgccgatggactttgaaagcagtgctaagtggaacaaggccgacacagaaggcaaatgttgcatggttctgctggaatccaaagggcaggctcagagctctgtctagaggaggcagactcactcaaggggacttctgtaagggtggggcgagaggtggggagctgattgcttaatgagtacagagtttctgtttgaggtgatgaaaactttttttgcaaaccaactgtggtggtagttgcataacaacaattatgccacaaaatccccacttaaaatggtcaaaacaaccagctggatatcatatatactttactacaaccaacaatgacaacaaagccccccagcagcttggggacacagctagtgacagagtgcttccctagtgtatgtcaaatgtgggttcaatccccagaactggagagaagaaagtaaaggagcttgacgaggtggaggcaggaggctcaggacttcaaggctagcctgtgctacaccgtgagggctagcctatactacaccgtgagcacaaggccagaccctgtctcaaggaaaaaacaaaacgataaggcatagaaatgaccctataaagaagcacttctacccgtcagtttgctgagaggttcagagccccacgacagtggggtgggactgagaggtgatgtgtcacctttgtacaagagtctctctgtcaccactgtctactcggtcagaactgtctaaatctctgctggacgagtaacagcagttggcgctttattacatttatttagcgtggagaagaccaggtgacaaccctgtaaagtcagttctctccttctaccatgtgggtcccaggggtagaactcagatccttaggctttgcagcaagctcctttacccactgagccattttgcctgccccaattgaacaatgggttcattaggtatcctccccagatattgtgtctatgttaagcagatgtggcaagtctcccaaaggttcaagtgcaaagggcttggctccactggaggcaatgtttacaggtagtgagtgagtagtgaggcctgggctgcaggagttcttcctcatgcctggagctagctcctgtggggctaaattagcaccaggagaacagggttttggtttttcctttaatatattaactaactaattaatccattcatccatttcgaggcagggtttctctgtgtggcctttgtcccctggaactcaatctgcagaccaggctgagatctgcctgcttttgtctgctgagtgctgggaccaaagctgtgtaccaccactacatgcgaagagctggttctataaagtgaggctttccttcccacttctcagctaggttgtgacacagcagggtgtcctcaccaggacacaggaacccatagtctttggacccagtggctatcagaatcataagcccagcaaacctcctcatttagaaattactcagtcttgggtcttttgatagtgcaatatcagaaaacagtctaaaagtaaatgcccaagaagtttataatcagggaaccttgcaagacacacacacacacacacacacacacacacacacacacacacacacacatatacacacacacacatacatatacacactgatacacagagagagagatacacaaattccagcactcaggaggcagaggcaggcggatttctgaggtcgaggccagcctggtctacagagtgagttccaggacagccagggctacacagagaaaccctgtctcgaaaaaccaaaaaaaaaaaaaaaaaaaaaaaaagagagagacacacacacacacaaactgacacatacacacagccaataaacacacacacacacacaatggcaaggttcttacagcaggaattcagagaaagaagacaaaaacagaggtgggcagcagagagaggctgggtgcatgcgcgcgcgagcacacgcacccgcactggacgtggtgcttgaaagtggtgatatcgatgtccacgttcccagaggtggggcccttcttcctgtgctcctgctggaaattctcctcgttgtacacgctccgcttaacatcgtacacaaaagggatttgtgtgtatctgttgctgaaactctggaggctcctctctgtttgcattgttcctggattagctgggaagacatcagggaaaaacaggtagctccgggcagtggtggcgcacgtctttaatcccagcacttgggaggcgaggcaggcggatttctgagttcgaggtcagcctggtctacagagtgagtttcaggacagccagggctgcacagagaaatcttgagaaagccaaaccaaactgaaccggaccaaacgaaacgaaccaaacatgtattagggtcggtgagatggctcagtggtgaaagcccgaggatgcctacaggttgtcctctgactttacatagaatatatgataatgcttggcacacactctcccctccccccaaaaccaataaatataaaaaaatatttagggctgagtgtggtagcatgtgtatatttaatcctagctcctggtaggcaaaaccaggtgaatccctgtgaggtccaggacagcttagtctacatagcaagttccaggccagccagccagggctacatagagtgaccctgtcttaaaagagctttaaaacaaaataaacaaatttttagaaatttaaatcaattagcacttttcttgatttttaaaaaaaaatataatttttaaaaaagatttatttatttatttatttatttatttattatatgtaagtacactgtagctgtcctcagacactccagaagagggagtcagatctcgttacagatggttgtgagccaccatgtggttgctgggatttgaactcctgaccttcggaagagcagtcgggtgctcttacccactgagccatctcaccagccccaaaaaatatatttttattatttgtttttgtgtatgtggacaagtattgtgtgtgtgtgtctttctgtgggtatgttcttttttttctttttctttttggtttttcaagacagggtttctctgtgcaggcctggctgtcctggaactcactctgtagaccaggctggccttgaactcagaaatctgcctgcctctgcctcctgagtgctgggattaaaggcatgtgccaccactgcccggtatgtgggtatgttcttatgtgtgtttactggtgttctacaaggccagaaataggagctggcattggtggctgtgagctgcccagtgcggttcctaggagccactctcaggtcctctgcaagagcagtgggcacttttgtcagctgagccatctctctagcacccttgcctttttttgaggtagggtgtcttgtagtccaggtcggcctcaaattcacaatgtcggcaaggataaccttgagatcacggtctcccagcttccagtgccccgagtggtggggctgcacgcgtggtctgctcttcctgctttctttgttgctcagtctggctcagactgatgagctcctgactgtcttcctgactcaggtccccgggacgggagtcagagctgtgggccaactgtctgccctcagtatattttgaaggtaagataattcacatatactgatgatatctttgcacagtttttccgagacccttcctcacaaccgttctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgagttccaggccagcctggtctacagagtgagttccaggccagccatagtgagagcctgtgtacacagaaagagaagcaggggcacagcagagctggggagcctgatgtggagcagtcagtagggtggagcagcctggaggctccctgcactacccgctacttctcttacttgtctttattgtgagacaggctccccacaaaggtggagtgtagtgggctttggcatcctcctcctcctgtccccagctagccaatgctgggttataggtgtaagccaccatccatgccttaattctttttgattcttccttcctgggctggggacccatctgagggcctaacacatgcagggctactctaccctgagctgtagtcccagcctttatctttaagcaggctttcattgctaaaaaacacttaaaaaaaaatacaagcacgttaacacagctctttttgcttctgctaccctcagccatctgtccatccatccattcacccactcactgattcgtttaaaatctctatttgggatattttaaatgcaaaaaaatgtaacccgatttataaaattttgactcaaaggaccagaaaccctcaaaattagttaaggtacaagaatatcttttacctaattaagtcatctttcacatgctttctaaaaccataagacaaaattcacttccaattaaaaaaaaaaaaaaaaaaaagcacttgtatttcccaaccaaaaacctcattgcctgtgactctcagttttggtggagaatgtattggggatggtctagtggcaggagatgcttgaaggtggcagccctccagctgctgacaggtcacataaacaccttcccttaatgctagtcagtgtgataccaagcaggtgtggtagagagatcctcattactgggctgaacagtggagacttcatggggggacccaaagtccagcaataaggactagaagacagagaaggaggagaggggacagagggtgggcttaaggcagagagaacaaaatgagcagaacagtaaagtctggaagcaaagggggccctgagctgcggcctgatgaggacacagagagtggaagtgtggggggcccacagtccagttccttcagctgtggacatcacagagatgcgaatttttgaaaggatccagtatgcaaattccatgttgtctcttgccatttcggtttcacgcagcctttctataaggagagagaagttccagggaccaccgctattcattcattcattcattcattcattcacccactccttgtgcctgggacactcctggctctgcaggtgacccaagcagccacgctctgggacgcgagcgggctgtcagctcccaggcggcagccagagctccggaccgctcccgacccaggctcacctggtttccggtggcccgcaggagcgcagacgctggggacagactcggctccagcctggctggcggcagcgctgcggacgcggaggccggcagttccggagccgttgctgcagaacccgcgggcgttccggctgtgcgggtgacgggcgaggatggcatctgggccgaggagaaggggtccctgctgccctccacatacccggatcttctagaaatagccacgagaataagatttcccctttctcctgctcggtgtaggcatgggtggatgtgggttcttacgggtctaactttccccattcacttttattagctttctcggcttctacggaagattccactaggtgggaatgcagggtcgcattgatcttgtagagactagaaccagggcctaagaaagctcaacagacttacctaaatgagatgcggtcagaatgctcgccctagtagttctccatactctcagaggcatgaattaagtctttaatacccaccccccaattttcttttaaatttctaaactttggatggctctaaagggcaagagtcggtctcaaacccgagtgatggtttttggggtgttgcacatacggtctcatcactacacagcagaggcttggtctcctggtttttccaaatgctagaattacaggatttgtaaatacaaataaacaaataaataaataaacaaataaataaataagaagggtcccctggtctttccaaatgctggaattacaggttgtgtataaataaataaataagagaaaggtctcttggtcttttcaaatgctggaattacaggttctgtacatataaataaatagtatgaaagggtctcctggtctttctaaatgctggaattacaggctgtgtaaatagatatatatgtatgcatgtatatgaagggttttctggtctttccaaatgccggaattgcaggtggtgtaaatataaataaataaatgagaagaccttcctgaaatggaatgacctacttgcagtgtgtgtgtgtaccttccccttccagtagtgggtattgaacccagggccttgcaaatgctggtccccagcctggaagtggccattcatgatgtctacctctgacctcgtgcattggaactccctgtgggtccctggaacctccttctgccacttctgcctgaaaacatgtaggagcgcctggagggagagcctgggctttgaggcaagactaatatttgcctagggggcaggtttcaccagcatcccgaggtgagccacttgtccttgagcagaccggaatgcgacagctttctggacagggcctgtctgttctttcaagttgttcttggaaattgacgactctagtgagcaggttgctcggagttcaaagatcatttggctctcttccccgacgctgtcacagcggctttccgccatggcgccaggcattcgcccgtgcgaccacagagaggcgcgcgcgccccgcgctgcggcctccacccttggcgccccggggagcccagtccccgagagttcctgcctcggctccccaagccgcgtccctcttctcgcgagatctgccggccctgcgcgctcttctcgcgaccccccgccccgtgggcaggttccatattgggtaagatctggattcagagcggggcctccttggagctgttctcgcgagagttccgcgagaggctcccggccgctgcctgtgggatcgccgccactggagcccaagcggggcgctgaagcgcgagcgggtgtcttgcggcgtcggcgtgcgctccctccccggggagcggctgcaggaggaccgcggcgggagcagcctcgagccgtgcagccggctccggcaccttgccgacgctcgtaggagccgccgcggctgacaggggcggcgggtcgcagcctccacacctgcgcgggtggcgggcgcggggtccggtctgccgcgggcgggcgcagaggagagcgtgcggctgcaggcaggagcccccgctcggccacctcctcgccccgctgctgccgctggaagatgtcgcaggagaggcccacgttctaccggcaggagctgaacaagaccatctgggaggtgcccgaacgataccagaacctgtccccggtgggctcgggcgcctatggctcggtgtggtgagtgtcgccgggcctcgggttaggggtggggtggggggacgcggtggagcaagcagggtggccctgcatgcctgagggccaggcctgtccccacagctcagcgatgcgcccagcggcaggaattctcctccgggcgtgtctgggggtgcagggggcagctggagcgggacgtgtcctgcacccctcgccctgcatacgcaggtcgggggcgagccgtgtgcgggagcgggtcagctgcggacgcggtgggatgcttctctaccctgcgctctccctgctcccaagactggccctcccgggggtcctctgctgcagcgcggcctcaggaccctgcctccgggtaccgccactcgggacgcgggagccctgccccggggagcagacgagctgggcggagctccagcgaggagctgtagggcaaagcctgacccggggactgcggtcacctgaacgaaacttgcaagagaaagcgctcctttcccggaatttttttttttttccttttttctcccccttttcccatttttgcaagcctccatcgaaaaatcctgtctcaggaaacgttcctttgggattcgcacttgaattagcagcaccccgaagagcttaaaataccgactttatctcggggaccacggtgccagcttgcgtggtgtgtttccgattcggttgaaagcgtatttccttttcggggagggagggtggcagcgccttgcaaggacgctccagctcgccgcttagtcacataccactgctcatttcagtattgtttgacaaaacagttttccataccgagcagaggggcgcccctcaagatcaagaaggtaggactagagctggaggtgtagatagcttttaattgaagtaattcatgggggtgcttttcttttttttaagtcccttagaagatttgcggagttttatcagtcttgtaagtaccgaggtacgtggtggttttcgggagatcctggaacataggaaacgatnnnnnnnnnnnnnnnnnnnnnnnnnnnnnnnnnnnnnnnnnnnnnnnnnnnnnnnnnnnnnnnnnnnnnnnnnnnnnncttttgctaccatgcatggccctgggtagcaggtttcagattaaatttctaccataaaacttccactccagaaatgttctaaggaactttgaaggattcacgcagtatcttttactatatcttttagagctccctatctgatagtaatctgatagattcagtagatgagcccttcctgtgttttagtgacttacatgcattcatggtttccgaaggagtctgggaaatggtttttgttttggaacaaattccaggcttctggatgtgctaacctttaagtatgagtcctgtgttacttaaagtcatatcgtgaatttcctgtttggtagaatcttctgggtaattgagattgtgcaattgtgtccagcaacagatcacattgcatttgctggctcaagctgcttaagctatgttgcagatgataccaacttggacatctttctcacgagtctacagaatggcagtttacactttaaaggaaatgtcaataacatctctcatgtatttgtgattgatctgttgcatcattgtttctctaatagttaccagctccttaagtatctccattcttcgttcctaattggtacagtaccaggcgtttgtttccatttgaatgctcagggagtgaagctcaggggcttctgggatggtgaatttgcaaggtttcctgtggacaccactgtcctggcagaagagccagcttcacagtgaagtgccacagtgaaaccaactccacttcctctagtgctgctgttttctgtgtaatataattgagcacaacctcacaattaaatagacttctaccaaacagcttcttaaacataggtagtgctggcccagtgatggaacgcagtgggacagccctggccttgcctgtgggaggccctgcattccagccccagcagcagtgcaccacacaaagcaggttgcttgaaataagggcccaaaaggtatgcagcaaaaatcctgtttctgctctcagccctgcatgctggtcttccagagacaaccactgtttagttccttgcctgacattccagagaggtgtagtttctagcgtagagatttactatgtagcctattgatgaggaaaagatagctgaaattgtgtgtgacccagcaaatgtcaccttcagttagatttgcaagtgttaacttctctcaagttatttgaaattgtgttttcaattagctttttaggtgtgactgaaaaatacttttttgtttgttttttgagatgagctgtcctagaattcacattgtagaccagactggcctccaactccgatcagctggactttgcctctcagagtgcctggattaaagacttgcaacactacacctgacttcttgaatttcttttttaatccactttgaggcctgtgttccctttcttcaccttcgttctctgagatagtttgatgttggggaataatgaagtccatttgaatggatataattgagggggatttaaactgagctcttgagaagagaggaggctgttctactggtgacagtggaataagtcaggagggacctgaagtctcttcaaaaaaggaatctctgaattggacatgatacactttgatttgtaacttaatttttttcttttaagtttaagattaattttaatttgtattatgcagtgagcgacagtaacaaaaaacaagcagcaaactgtagtattaccaactgtgactcaaagttgaatgagagtctagaaattgagaattggcttgtttttacaaatatctttctttttaaaagtgtaaagggaactaaactaagttctctaagttttaaggaactgtatttactgcctgaaaagggaaacaagcaaaatcattaagaccacattgttgcaaagcattgattgtgtggtttgggacataggggaaaatctttgtggtgaatttaaggaaatacaaacgggaacgtcagtgtctttcctctggggaaaggggctctccagccccttgctggacacacttgggtaccatgccttgggagtgagaattaagaattacttctagatcattcacagctatttattcattagtctggattacataacaccaaactctggctagaatcaaggctagattcttgagctaaaagtacagaacgagacagctcattttgtcattgggcttgtagaagaatggatggatttaatggctgcattttatgggttgcttgctgtgttgtaggcatggagatgcttagtttatgatcggcatgtagacatgtaacaaacttgtagctaaacatggtaatttcttctaactaaatctgatttagcatgctatataggacaagattattccagtaaatataacaaaaataaatgaagctttttttttttaagtattaatagccattcaccattagttttaattagccagggaaaaaaaataaaactccacaattaggtatgacttttcactcttgacgaccgagaaggctgggcctttactattagttgtaataatagccggtctctcttccttcccttcctgcctttcttcctactttccttcaggacacagccttctggtcttgaactcttgatccacttgtctgaggctctctaatgctagggtcataggagtgggccaccaagctgctttagctgacctatctcccatttactgttttgtgactaaaagtagactagttaactggatgttaccagtcttaataagcatttaggtttgaggccaacctagcctcactcagcagagtgaactcagtgccctttctcaagaaaaacaataaataaacaaaaagtgcccaccaaatatgattggcaagagggtgtgtgtgtgtgtgtgtgtgtgtgtgtgtgtgtgtatgtatgtgtgtgtgtgtgtgtatagtgtttagatttatttattgttatttgtatgaatgttttgtttgaatgtgtatttctacaccacaaagtgcttggtgcctctggagcccagaagggggtattggatccctactggacttggagttacagaaggttgtgagccaccagaagcccttgccagtgctcataaccactaannnnnnnnnnnnnnnnnnnncactcatgatgagcactacaccccaggcctctgagttctgccacttttcagttttgaatattgaggagtattcttttgatttctctttaattcagcctcagagatgatctgtgttggctttgccttctgtggacaatgttgggaattgtgctaaacccttaaagcttaggactcaaatgtcgaggagttccctggatgctgtcactttcgtattaactggcatcttaatgtgattctttggtttatcatgatcttcatttaaggcattatcagtccctctctttctagagtaggtgggttgcttttccttctctctctcttctgcatctttagtaacggaaccctgggggctggtgcacactaaccatgggatccagtgagctgcactccagcctccaggctggcgttttagcctagttctgtggatgagctggggttaacagaagaccctgtgctgtatgaccatcagctagagctgaatggatctgggagcaatcagaagggggagggtttgcagctgctaggaatcctacctggtcatatttgcctttgtaaagaccaacttctgtgctgaaaaagtaagccaaggtgggttgcagacagagcagagctggggtctagctccctagcttttcatttctgttccttaactgatcgaggcactaactaaactgtttgtggtttatgtaagcacaagagagataaatcatggcagggacttgacctatgccctgtactcttcatccacaagtccaaaagtgccagagccagaatttttgttgagctcggaaattcagggtactccacttcagctctctaaataacatgcttacttcaaatttttttttgtttttttttgtttgtttgtttgtttgtttgttgttgaagggttttgctgccaaaaggaagggatcaaagagattagctgctgagttcagctgaaaaagaaagaggagctgctggcaggctgagtgttttctaacatctttgacttccaggctttttcttaatacttgctcatattttaagtcacttgtatcttcctcagagtatccgagcatttaaaatcacatttatcttaatctttggttctgtgtctgttttccattcctgcctttccctcattgtgttacttggcactgatgtttttgtctgtaagactccaaggaatgttaacttgaatagatgtgaccaatacctgtctacagataccttgtaacagctctgctctgtcctgtcttggctgtcttcatgtgctgcacactctctggctctcttgctctcgctcgctcgctctctctctctctctctcgctcgctctatacacgcacacacacatacacacacacacacacatcccgcctacacacactgctttatcatctggttgcagaaagtaagttcctgaaaacaggttcccatggcaacataacagaaaggtaatagaacaaatgtttattctgtctagacctgttgtctgactaactgtagaccctgaacatgtttgctcctgtcacactgaacaatgtgattacagatttccttgtttccctcaaaacctcctccttgtagatcttagtggggttgccactgtgcttgtgacgtgaaggaagctgtgtgtgtgccctactgcaggtgtatactggttgtgtccccaagcttgcaggccacagcttacctaaaacagcagcagttgctcctttgttgtcataagttctttagcttagtattggtagtgttaagcgttgtttataaagtccaaagaaagcaagggacctggggaggtgccatagtgcttgccgtgaaagcatggggccgtgacttggatctagacagcatgtgaaagccggacacagcacatgtgtgagctcagtgctggggtgcagagacaggaggatgggtggagcctttggactagctggccagctagcctagccaagttagtgaggtccagattcagtgagaaaccctttctcaaaacacggtggaaggcacctaaggtcaacctctgacctacacacatgcacacacaaaagcaggaagagacctaggttgctttggaagtctttgtagcttttctttctttcatattgttcagtgtcatcatctcaaaactacctttatatttctaaagacagcccttcccctttcaagtgacattctagtagcttgtcaaatctagggcagcttgatgccagggtatgtattggaaatctgtgtcagagaaccatttccatctggtgattcagatctggaaaggatgacatcagcgtgtgcccacaagaggtcagaaaacaaaacaaaacctcttttgatgtgtgaaggctctgggaggctgttttagttaaatggggtgtgagagtaattggtcttgatcttgagccctttgctcggatccacttggaccattgtcatgctcataatcaggcctttgctctttcctgtaacacgcagcttggggtgtctggcttgtgcgagtactgagttcatcttgtattactgcattcctgtagcagatctaatttaattcccagaaataatttttttattcttagtatcttcagtaggtgactcctctttacccttcccccttaaacttcacttagggcttttgctagctctaacttccttgaacctaggtttagaaatacatcgtttaatctaccagttgccagtgaagactttagttctttctcatctgtaaaaaaagaaagaaaaatccaactccctagtaatcattgtgcaattctgatgttgacatcttgtgttgacatagttgtgattacctgattgtgtgtgtgtgtgtgtgtgtgtgtgtgtgtgtgtgtaaatgttcttgcatgtgtgtttgcatatatgcaaagaccagaggttaacttcagttattgtcgactatcactttctactttattttttgatagtatctctcactggatctggagtgcatggattgcttagactagctggccagaggtcctcaggaatcttcctgtttccaggcacatcgtctcctacctgttttttgttgctgatgttgtttggtttatgttgatactgggatcaaactcagccttcatacttgctgctggagcacttttctgactgaactgtctccccagttctgcccttgtgtgatgctgcagtctggcttgcttaggtttctgattccttatgtcgtgttctgagtgccctatggttgggtgatctcttttgaaatgagcgactcaatgttaaatgatactgataccaggcaaaaggtttaaaaagtaacagtgttatctgagatgttggaaaaatagttgcctggttaagaacactggctgttcttccagaggatctgggttcaattcccaggacccacatggcagctcacaactgtctctaattgtagtcccaggggatccaacaccccacacagacttacatgcaatacacatgagagttttaaaaattgtgatctggttttttttttttttttttttttttttttttttttttggtatctctgaacttctttacatccccaaacatggtgtaacatagggttcttggtttgtgcctgttctgagcagagggtgatactttgttgtgggtctgactgggtattatatatttaacagcagtgttgtcccctaatcttaagatttatgacaatttcccattgtgacagccagatttgtcttataagtggtgccttatgttgggggagggttggaaattagtcacctttaattgaaaacgttttacacaacagtacatatctagaataattggtcttgactaaaacctataggctaacttgaacactgtacctgtcagcagagaggaatgctacacatggggcttccttcagcatgaccgtcattatcttcaggagaacatgagaaagcattatcgaggtcccaagcttactgtggttagaaccgcttgcacagatcgtgtgttggccacgtgggtagctgtatagtgctgtgaagaaacaatgaatgtgaataactttgttttccttttgtcgtgattcctcttaggacttgtaaatgtttctggaaaggaaagcttattgagtatgttagcattaagtccaaatctgaaggtagtgcttttcccagcatctctggttttcttttcttgactttttttttttttttttttttttttttttggggcattcgagacagggtttctctgtgtagccctggctgtcctggaaacttactctgtagaacaggctgggctcgaactcagaaattcgcctgcctcagcctcccgagtgctgggattgaaggcgtgtgccatcatgcccggctatctctggttttctcgccctttttctcctactgtaatctttcagtaggtagctcttttcagagttcaaatatacagtgttcaggccagccaggactatatagtgagaccctatctcaaataaaataaaaatgttagaaaagcaaggaggaatttcatgtgaacacaggaacaagaagtagcagtgttacccattgacgtggaccagcttatgcttgacacagtccagatatataagccatccctggcttggagcataccatgcacactagcctggctgcagatcatggtagtctccttctttctacctctgtctctgctgggattacaggtgtgcaccactgctcttattttgaaggttcttgttagcattttagtctttaaagtattagacagttacagagggtgagtttttagtaatctgtggattccagcagtaacaaaaaaattagctttattcttgactcagagccttccatttacactcatattttggtgtttcctgaattaaccatggtaatgcgtgaaaggttctggcatggtaataaataattctgtattagaatttgtaacttttaatatttaatgctgtgctttatatctttatttctatgtatatgtgtgcctgttcacaagtttgtgtggaagctagaggtgcagtctatcttccctcagacagagtgtcatcagcctggatctctagttaggctaactggccaacaagtcccaggaatcctcctcttctgtctctacacagtcctggagttacaggtacacaccaccacacccagcacttaagtgtggttctggggatagaacttgggttctgacagccccactttgtgtcgtcctcatacttcaaagtgctctgttgttctgatatcctgtgtttatctttgggcagttttactcatcatcgccatcatcattttgcatcatgactcatttttaagttttctttttctatatatatccattttgggcacattgccgtacaaaagtactcttggtggttggcactcctctgttgtgctaggagtggtggtacagaccagtaattccagtagtcaagaggttgaggcaggatgattttgagtttgaggtcagcgtggggcaccttgtgataatcttatatcaaaagaactagggacatctaatcttgtaaattccgagtccactgagatgtacaagattttgtagcaccctaccttccctgattagtttttatttttttaatgatttgtttgctttctgtgcaatggtgttctgtttgcatcatgtgtgtctttctttcttttcctttgctttgatgaagtaccctgacaaaagtaacgtgcaggaaaaaggtttctcttggctcacctctgaagaatacagtcctttatggtggtggtggtggtggtggtggtggtggtggtggtggtggggttaaggcaacaggagcctaaagcagctggtcccagccagtccacagtcaggaagcagagagtgatgaggtcatgctgctgttcagctccctgttcaggatcccagccagggaatgactgggtgttcccagcccagtcagtgtaataaagataatccctcacgcccagaggcctgtctcccaggtgagtctagatcctgctcagttaacagcactaaccattatagtgtgtgtgtttatacacacttaggtttaagttttcgatttactgtagtgaagaaaatttgttgatacctatcagacagtgttccagactcaccagcatgtggaacagactgcttagaaataaagaaactgattagggaactatattcacatagtgtggacataaacccagaagtggtggttgtctgtgcactatagtatttaggatggtttcatggaggaaaaaagtattgagagttattttgagagctgagtagactaatcagtacagcaggagagaatatcatgtaagtgaacagatgccaagaggaccagcctgaccccgctgcggctctcagctgtgtttcacagtcactcgggagtcaagatgtaggtctacaattggactcaggtaactgctttccctaatagttgacttgtgttcctgactagcagaacttctgtacaaagcagagagctgttatcttcacttatacagtggaagaaacagtatgcctttaatcccagcactcgggaggcagaggcaggcggatttctgagttgttccaggacagccagggctacacagagaaaccctgtctcaaaaaaccaaaaaaaaaaaaaaaacaaaaacaaaaacaaaccaaaaaaccaaaaaacttcctgtttgaagtgttggcttggactgattggaggaagaaagggctgctcttgtacagtcggctgcagtttgtctgcaggcacccctgtctttttgactccccagccttctctattcttgaggtcagcagtgatctggttttggtatgtgtttgttatttttgttttatgatcaggtcatggctaggtgccaaggataaaagataaaccacagcttctgctctctcacagactggagtaggaaacaagtatgcagaggaaaggtggttctgagttccgtctttaaaggattagttacaatgtactgccaactgtagtagttctcaggttccatctaagggttgtagaatccatgtacacttctaacttgtagaaactacaggtatccatagattgacaaatcatggaggatttcaaggactctcagttacattttaataatcttctctttttactattacttcagagatatgctcaacttgcagtgtgagagaaagatctaaaaatactgagagtttactacatgggaagccccatgctagagactgcaggcacagacttattttatagttggatattcatttcaacttggagtatttaaaactaccttctggggctggagaggtggcttagttgttcagagtttgaactgttcttgcagaggatccaagttttattccagtagcttataactgcctgtgacctcagattcagacatggcctctacagacatggtactcacatgcacaagcccccacacagacacaaacaacagttttggggttttttgtttttttgttttttgtttggagaggaaaggatttattcagcttacacttccacattgctgttcatcaccaaaagaagtcaggacaggaactcacacagggtaggaacctggaggcagaagctgatgcagaggccatggactgatgctgcttactggcttgcttcccctggcttgctcagcttgctttcttttccttctttttttttatttttttatttttttaattaggtattttcttcatttacatttcaaatgctatcccaaaggtcccccataccctcctccccactttagtttttaatataaagcacattcaacatacttacttgagcctcttcacagcgttttaggctaggcggggctggtgattccttgttttattcctttggaaacagatgcgttaaagctttgtttgggatcatctcctagtaagtgccaaactagaactcatattttgactactggtttgttttttgtttgtttgtttgtgtgtttgttttttgtattgcatggggtacatttaaatttgctaattggaaatttctagatcaataaaagatttttttttttttaagaaaaagatttcttttatgtgcattgatgttttgcctgcatgtatgtctgtgtgaagatgtcagttcccctggaactgaagttatagacaattgtgagctaccatgtggctgctgagaatagaacccagatcctctggaatagcagccagtgctcttaactgctgagccatctctccagcccaataaaaaggtttttattattattattattattatttattttttgtatatgagtacactgtagctatcttcagacacaccagaagagggcattggatggctgtgagccaccacttggttgctgggaattgaactcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccccataatgagatttgatgccctcttctggtgcatctgaagacagctaccagtgtacagtgtataataataaataacccttaaaaaagaaaaaaaaaagaaaaagaaatactagctttgacttaacattggttatggagggtttgtttgtttgtttgtttgggtttttgttttgttgttttgtttttttttttttgcccaaaagaaatccaaaccaaaaaacccggtaagttggaatattaagtcatagtgcttctaacacatctatccaccccagtgtcctgccttagcaacagattacactgtagtgtgtgaacacccggcttcctgggacagatgctgttgctgagcattgggagagcatctgcctgcttatcatcagcctggagacgctcacgtcagaattccaagtaatttggtactgagtgcttgccatcttctcagtcttaaaggtgtatagaacaaagttggagagcaaattagagaacatctgtagtctgaataaagaattaagatgtcctgttgaggcagagcttagttccttcccctctactgaggactgtacttggtggctcagttttctactgtgtagaatgtggcaggaatgagtggctgcagaaggaatgctgtaaatgagattgtacctcctgtggtgctttttccctgggaacactgctgaaggagtaggatatccaacatcttgcttacaggctgctttgcaggccatgtgcatcaggatagctatgaattccacccaacacatgcatagatgacatcattctatcacagttcaggaggttggacacccctattctagagcatagtttctcagctctgatacactttggcatttggggtcaaatagttgttcataattcttggctgttgtatctcctgtaggatgcttagcaagcagcatctctggacaccacctacttggtgccaggaacattcttctctaagacttggttgtgacagtccagaatgactttggatgtcctctagggaacaaaatcaccctttcttttcttttttaaaatagtatttatttcatgtatatgagtacactgaagctctcttcagacacactagaagagggtatcagatctcattatagatggctgtgagccaccatgtggttgctgggaattgaactcaggacctctggaagagcagtcagtgctcttaaccactgagccatctctccagccctaaatcaccctttctaaagaacttctaggggaagcctgcaaagcagccctgtggagagcccaagatggcaagcactacagctaagagaacccttggaaaaggatcctccagcctcagcaggtataaaagtgactgttgggctggagagatgttcagcagttaagagcactggttgcttttccagaggacctaagtttggttctccgggcccacatggtagctcacacccatttgtaactccaattccaaggcatgtgacttcctcttttgactactgcatgaacatggtacacagatatacatgtaggtaaaacacgccttcccatgatgaaaatgtaaaaacaattagaagagacttgctatggtccatctcttcactgcagctttcggggaaatagccagagccaccttgctaaatagcttcctagttcttgatccacaacaataggagataataaatcaggtttaaagctccacattttgggaatatttgttacccagcactagataataccctaagtgctatcataaaatgtccagatattgtataaggtagaaagttctgtacttcgggaagttagcttgtggagacatcagtccttgtgtttacccatagttaggtttgtagctcagatttatacagagatggagcctaggaactattgctatgaaagctttttccatgctggtagctagaccatagtaacttgagtgtaatatggttagtctgatattttagatttatttgaagtgagttaattatgattacttaaagaaatatttgctattgagattttgaaacagcaaaatggagaaatgtttctagtggtacactgtaatgaggctttggaaaatagccccttttataaaagaaggcacagtgggagggacataacactcaaaaatgcggtttatacctgtgtggaaatgaccttataaaacccctgattgtgctggagtggtaaaataagggcctttacatttgtctgaggctagaggatcctctaaaggcaccttacccgtgtggctattgacagaaggcctggttactatctagatctctgcacagggctgctacagtcttctctagatcagtggttttcaacagaggggacattttgttcccttggaaaccacattttgaaagggagggggaatctgggtgtcatggcatgcacttgtaatctgagcactggggcagcacagaagggcagatcttgggcttgcccagtccagcctacttggtaagttctaggccagtgagagaagagaccctttctcaaggtaccttttcaatttaaatgaactagacagtgccagaatagtagtatgtggcatagtcacttgttgagtggattgtagattcctttcctctgggctttcagtttgttttttagatggtttaaggcttttctaggagtgtctgcttttggaaatttataatttagagcagaatgcatgatttctgttctttccaaatactgctctgatagggagaggaagcagcatgttagtgcatagagctctagggcattagcagcctttgctggagggtttccaacccacaagaactatgtctgagtaactcctgcctgtcttgtacatgtaaggtgtattttcatgggagtgtgtgtcctctatggtaagaattagtatgttgtaatgagagcatgtgattagggaggaagcattagacggtcactgagctggtgctgcgttatatgtgcggacatctggtgtgactgcatcagtgagaatatcacaaaaggcagatttgaaaattacttggtaaaatgaaaaatgattgtgatttaggaatgtaggtttcagatttacatatggtgattatgtccgtgtaagtatcattagaaggaaatgtaattgctactaactagtagtttgcactaagttgaaaacaccactaagtgacagagcagcagtgtgagtcacgtatctcactctactaatggcctccatgagaaatgaaagcttgttttaagaaaaaaagagagagagaaaatggaaacatacactgttcaaaagagtgtaacaagtttaggatatattagatatttatgctgtatgaatacagtatttccctatgatagaatcattttctgcttctgaaacttgttcttttgccctcagtacatgaaagagtcttgctctttgctccatgtgtgtgaacggagaatgtactagaattttaaagtcctgttgttggaatttcaagtagtttctagttttcctgtgaccaggctgcaacagatatgtactttgaaccctattttgtttgtatctgtgccgatgttttgagatatgattttactctgtagtagactggcttctaccatgtcccatctgcctctgtcttccaagcagaaggattataggcatgaaccactcactactactcccagcttcagtgtgtgtgtgtgtgtgtgtgtgagagagagagaagagagagagagagagagagagagaggaaggagatccttttttaaagatttatttatatgagtacactgtcactatcttcagacacaccagaagagagcatcagatcccattagagatggttgtgagccatgcagttgctgggaattgaactcaggacctctggaagaacaagaagtcaggaaaagaatgagagaatgagaatgaataaatgaatgagtatgcatcattacagacttagacttgtggatgtcggaggacaacttgcaggagtcagttctctctccttccactgtgtaggtttccggggctgtattctcaggcctggcagtaagtgcctttaccctctcatcttttctttacctgctgaaccatttcacaggcctcggtatatatggttttttaatccaggatttggagaaatgtttaactgtctgttggctgtttaattggtcattcctggtatcttgtgcattttgttatcccaggtagatagtaagttttgtgacatcagctaccatatttactgttttcttttgtattcataaaataaaataacatcgcttggtggtaggggcactcacctttaatccaaggactggagaggcagaggcaggcggatctgtgtgtccaaggttagcctggtctgcagagtgagttccaggatagccagggctacacagagaaaccctgtcccccaaaaacaaaaccacaaaaaaagaaaaaagaaagaagccctataaaccaggagtggtggcatgtgtctctaatcccaacacacagtaactgacaagaaggtcatacattcaagccagtgtagaaaatttagccagacactgtctcaaaataaaacaaacattagtaaagggtatgcggctcagcttactgaccagtatttgtctggtgtgtgtccaaccctgagggaactgggaagtgctaattgaggaaactggggttttgagccctttgtatcacgatggtgagggaaacagatggacttcttgtcctcaacttgcccagggcaggtggcagtaggagtcattattaatgtctgataattgagttttacaaaatttgctaaacctgccataaaaactagtaccttaggttagatacagacattatatttgttttatatatgaggttggtagaatttaattaacttcctcaagagttattaagtggcaaagctagtattaaaaccctgatagtcctcttccagagcccagcccttgtttaactacctggtgggtggtaaataaacatatactaatcattgtgattattggggactgtagggtccctgtgcggcatctgtcctccactgagtggctagtgaagtcagagggtggaacctgcccctcttgctctggagctggctgcaaaagagcctgggtagtgatcataatgggcagctgttctgctatccagctgagctgaacttgtaggtgtggccacatcctgctggccctccctgctccccacaggttcatccccaaggagaggacagagttacaaaggctgcatgaggcatgacactcagagtggaagttgaagaagccacattgtgtgggggccatggccatttcctcagtttctaaccacacactggtaaagggaaggttgtcttatggtcttatggagataaagggtgaaagacggagagtgcttgcctcaggtgggtaggaacccctgtggaggggtgactctgcctatatatacttgaagaataaagatttagttgtggggtgggtgcgggtaggcgagaaggaactagcagcagcagatccaaatagtttacagaactgaaagaagccagcacaccagagcaggcctgtggtgggggactactgattgggtgagccctgggattgggtcaactcatctgaaacttagacagcggtaggaaatgtgcatttttattctgtattacaagaaaattccttgagtttaaaatagtcatttattattttgaaattgcacgtcggagggcagcttgtaggacggatcttttcaccttgtcaagttcttaagaattaggtatcttctggaccgcccacagtcctgctgcccagaaaagagatttcaagaaaggataggctttgggggttttgtgtttatagatggaatttaacccgaaatgaccagttgtgtagttttctcatccctgcaaccaaacacctgagaggagaaaggagccagggcttacggtctccatttcacagggctcccccgtgcttgcctccatccataccctcgagcagagcacgtgggagggcataccgtgggctgttctgtacacctgagctggcaggaatgggacagaagagagggtgcccaaccaaactatctccttccagctaagctctaccaccatagtgaaaacactgaagcttttctcttttgtttagtatgaggtgatgtactgtgtgttcttgtgtcgtggtgtgcgtgtataggacagaggacattttcaagttggttttcgccttttaccatttgagttcctggaatcaaacttaggttgtcaggcttgtaccctcatccactgagctatctgcttgggccctcccacctccaaagattttagaattctctcaatctggaaatggcacatctgttgttccagtgttcagaaggtggaggcagaaggatcaggaatttaggattatcttcagcttgagagtgagtgtaaggccaacctggatttacctaacagcaaagtggtgctaccagctgggaaccaagtgtttaacccatgcgcctgtggaggatagttcacgctgaactgtaacacagctgtaaaggaggttataaagatgagaagatgaaagccgcccaggaccctcccctgaagaactccatcatcaggagcttatgtagtacaagtatgtgatgcagagaaagtcccagaaagccccatgtccattgtaggattgacaggaggaagggggagtctgaccatgccaaatgctaggccagaacactggccgtctgacgtgcttaccgagcccgagcccggtagtgggcttgagaagagcagctccagcaggctggattgaaggatgaatggagctgagaagagcattgtctgtctagctgtgcttctcaaacttaggaactgtgtgaatcacattgtcacaatgcagactctgctctgtgggtcaagatcctgccttctcagggagctcccaggcagagccaggaccactggtctacagagtgcactttgaacagcataggtgtaggttaacagctcttgttttagttagtgcatgaaggctttgagaattgcgctctcttcagtttctgatttgtagctctaggatggtgtgtccaggagtttccttactaattaatccttgggtgaagctgacgtgaatggttcccataccttgagaatttggagattattaagttttggagaattttttaaactgtgaggaagatcatcaaaactagttaatgaatatggaaactttctagagcacattctgagacaagtgagacatcagtgtgtaaataactcagtggtagagcactcgcctacccagggttcagttccgtgtgtgtgtgtgtgtgtgtgtgtgtgtgtgtgtgtgtgtgcgtgcgcgcacgcgcgctcgatgtgtgtccatgtgtatgtcccacgtccccctacgtccccctcctcccctttgtgagtcagcaacacgcaggaggaatgttgttgagaagatgtgggacggctccaaagcacagtcttgggtttgatcagagggcatgtgttccttagagtaagagagactatggagagtgttggctgagggcatctggggtgcacagatccacagaagagatggagctatatggatctccctttgctagcttctgttctctcaaggaaagggagggagagaagggattggaagtttgagaggtggaaaagtcatgagatcttttttcagagtagagaatgaccttgtgagtggagtcactgtttcagtgtttgcaattatgttcagaagtaaaaacttagaagcagtctgattgtacttttttttttttttcaaccgtagctagccttgggtaattaggtggttgtggtcacctaaggttagacttgatccaaggagagggtacaagggagcagttaggaggttgaagacaggagagctggagacacaattgatgaggtcagcagcctggatgcactcaaggtagagtagtgaaagcaagccgaacggttggaggggcagtcggtgctggagagagatggctgaaatatggccctgcatgaggtggagtttccggagaggtcaggaaacgggatgttggatatgccctccagctggatgatatagttgccaagaatgttatcaaaagttgggagtggaggggtacttttctgataggacagacttttggagggtgatggaaaattctagtccatagataatagcaaccctgaagaagggttgctagcaagggcttttagaaaacaaatagaaagtgatgtcttgaagtgccgttaccgcgaagtgcctgttctgtgagagaaatgtctgtggtatagcctcagaaaggaggctgggaaattccaagagtgttaccacaaatcaaattgatggcgaggatatgtgtaggtttgggggtaaaaggaggactcctgagcaggacagactggtgtgcaattgttctgcactagccactgcgatgctgcactggcgtcatgttgctgctcatcccacctgtgttcattcagtggtcactgtgtgcatcactgttgtgagtgcttattctcctctgtcactcttcccacacttgaggacttcctactgtttgtgcttcagtctctgggaattgtccagcacttggaaggctattctcctggaagcaccgtaatttctggggcctttactttgaccagcacatagtctttaagattatcagtgtgttggctccttggacaggctgctgcctggtttcatgaaatttactagaaaacagccatacccattttataggttcctattatttggctgctttcaggcaacaactacaagctgaggagttgtgtcagggaccttacctgggctttggagagtaaaatgctactgtctgtgcctctctggaaaatgcttaccaactgctgatatagacaaaagaggcagaaagaagcatctcaaataaataggtgccttctctgggtggtgggtgatgagtcattatagtctttctttttgtgtcttgccacaaatttaatttggaaatgaaatagcctgaaaagtactaaaaatagtatttggaacactctttttttttgtttttgtttttgttttttttgtttgtttttccagacagggtttctctgtatagccctagctgtcctggaactcactttgtagaccaggctggccttgaactcagaaatttgcctgcctctgcctcccaggaggcagaggattaaaggcatgtgccaccatgcccggcttaaaatagtatttggaacactcttaatggtgggttctgttgttttccttacatcagtgctgcttttgatacaaagacggggcatcgtgtggcagttaagaagctgtcgagaccgtttcagtccatcattcacgccaaaaggacctaccgagagttgcgtctgctgaagcacatgaaacacgaaaatgtgagtaattccttttcctgcacacactgaaggctttgtatgcaatcctgccggtggatgcatgtcacactgtcagagttgggttcatgccgcatgagggctgcagctttggtgccatggggctgtcagatcatcgcgaggatgaccgagtgcctcttcccagagttgtacttttactacaggatctcaagaagcatttaattttctatttttatttagttagtttctgtgtatgtttgcctgctggggtttatgtgaatcatgagatgcagtacccttggagaccagaagatgtcagatctttggaactggactcacagatgcttgtgagccccactgtgggtgctgagaaccaaacctggaggctctgcaagagtaacccccactctttgcttagatattagtgtttggtgtgttttgtttgttttgtttttttctagacacagggtttttctctgtatagccctggctgtcctgcaactcactttgtagaccaggctggcatcgaactcatagagacccacctgcctctgaacttcaagtgtttgaattaaaggtgtgagccaccacaactggctgtgatttgtatttttaacatgtatgtttgtttgtttgtttgtttgtttgtttgtttaagacagggtcccagtatgtagccctgattgggttggaattacggagccactctccagccctgtattgctttgtatttttgaacaaagcaggcacggggggaatgagaaaagatcagaatacttacacttaatgtagaaattatctcacctttcagtctatcaatattatgcagtgaagaacaaagacttgggactgaagagatgtctcagtgcctatgcgcatttgctgctcttgtagaggacccaagattggttcccagcacctacattgggtgattcacacctgcctgtaactctggcttcatgggttcagtgccttcttcctcttcatccagggatacacacacacacacacacacacacacacacgcactcacgcacacacatgcaggcacataggggcaggggagagaaagacagacacacacagagaaagagacacaaaataaatattacataaggcaggaatcccaattcttttttctgtctgatacactactggctatgttaacaaattctaaaaagatagacggttttttcatggtattatgtgacgtgataagcaggtgttgtggcacacatctgtatgaacttgggaggtggcagcaggaagatcaggagtccaagttagcctgggccatatgaaatgctatctgcaaacacccaaaccccagaaagaaatgatgttagcaaatataagacagaaacacagtctgggtagaaaatcaggacactgagcacatgggtgtggctgcacttggagttagttctaactaaaacactggagtggtactgtaagaagaccactactttcccactgtttgatttttatgtgttcttgcaggtgattggtctgttggatgtgttcacacccgcaaggtcactggaggaattcaatgacgtgtgagtgaatcttctgtgtttgcaggctcagcaagaggatggggatgagcagcccatggaactgctcagcagtatccaacctcagaagattattctccacctattctggtttcttgggggagggatacataaagtgaatattatgtatggtgcattaggacacagtgtggcccattcagagccaatgatgagtccttacaaaagttacacagagagggagtatagggaattttggttataattgtttttccataaatgcaagtccacataggtgtttccttctttgatccctcctgatgccaggtgatactgaggctacatactgatacttaatgacatcttccagtctgatgccttctagaaagcagagcctggaagtcccaggaaccacaagtagaggccaggagaaataaaacagggacaaaggggatggtaatgcatggatgtgttagtgagagcacctggctgggaactgccagggtgtaggagccctacagaatgcacctcggatggggctgttcttctgattgcaactaaggtttgctccattgttcatgaatgctttgcatgctgacacacatgtgatgcaagacagcaggtgtcttgtgcaaatccagccttctcaccaccatagctttcctagtatgattaacacccgtattaattatcatcttgacagaagccagaatcacctgatgggcctctggnnnnnnnnnnnnnnnnnnnntgactattaattgacaagggaagagccatctaaactgtggttgtgactgttccctaggcagggcatctgcagttgtgtaagacagaaaaggcagcagagcagtagcatctagttcatcttgcttgctggtgcagtgtgatgactgtgtacagctgtttcccttaaaatgcttatgtcagcttgtttatcaaaagaagaggaaaagacactgagccccaccccacctaagtaagagacacactgcgctgcagaaggggaaacatcttaagcacagctgtacgtttggtcttgttaggattctcgaattcctaagtgcaaaggatgtttattgtaaaagctaaactgtaggtcatcactgctcttccctaacttcttgtattactaagccacctttctctacgacatgaccaaagaaactagcttatgtaaagagaaaaatgggttccttacctcctggttttaaatgtttcacatcatagtcagatgagcccatggcttctaggcttctggtagaggtgccaggtagtggtagagagtgttggtataacagaaaccactcatctcatggctaagaagcaaaagaaaggacggaccaggatttcacagtctgcagtcacacccctgatgacttaagccttgccatgttgtgggaatttggaattttggtttcctcaagaaatgctgtgcttcacagaagtagtgtatgactgtttttgttttagtcccgggtatggggatatggtgctgccgtgcagcagctgactgtgatttgccttgtcctctagcacagtttttttccagctatagatagtttctgcaattgtgtaatgtttggaattctggaaactttttacaaagtatgtaagtgctagggcctcaatgctaggttgatggtgagtggttgtttaggagggctggttgcagttgctagtggcagtgctcaagaaaaaccagaagaaagaaattagattcagggatctctctctctccctcccaccttccctctctctatctagtgatgggggtgagcccaggggataaagggtgggaaaaagaacccacaaagtagcaaagaccggctacattacaaagaccggctacattattgcccagaggtttggctgcttttgtagcacccttggaaaggaagccattgacatggggttgtgtggggttattgctcaccatccacactataccaacctcactcctgatgctcccagtgcaaaacctgcttctctccattctttctttggaatgtatgcccacaccatttgtcttttccaacagaacaagcagacagatacatttgctctcttgtgtcatgtctatagaaaagggaaaaacaagtgaatgccaaagatggagcaggagaggagaggtggcagcgggagggaaggcagcttggcccctgtacaggagctcaaccacattagctcacctgcaaatgcaagtttaggaagcaagtgaaaggaagactggcagtgagtaagaacagtgtccgcctgtcctgcagtcctgtctcagcagcagtaacagaggctccacccacacaggctgagcagactacagagccctgctgcagccggtgcttggaaaagagaatgtggtggagtctaaatgagaaacaaatgctgctgcagtcttttgtgaattactttgaaaaacattggagttaggtctgagtgttaacctaagttttagtgagggtagactctaacagaaaaaaaaaaaagatttgtggactccaaagtattgggttttgctttgattgagcattctggaatcaaaagtggacctatttttgctacattaaaagggcactaatgaaggctgatgtctatttgaatggttaaattttattgtctaggtttaacccacccactaccagcatttaccccagtaaataaagttgtattcatttattacaactttaaagttagtcttttcaacaagagcagaggcttctgtttttacctctagctggtttttaacaactttttaaaagatttatttttttattgtgtatatctgtctgtacacatatgtatgtatgtatgtatgtatctggcatgtacatacctgatgtctgtgtaggtcaggaaagtatgtcatatcttctgctagagttataggtggttgtgagccacagtgtggagtcctgtgcaagagtagccagtgctcctaacccctgagccctccccagtcctagctcttgtttgagcaaagcagctctcaagtgctgtctggtaggtactgtgccctaagtgctgagtacctgcaagtcagttaacatgctttccatgagaacagtggagagcctgtttcagtagggagtgtttcattgctgactgtttgtgatgttgataccagtgaaaaggttagcacccttccagaacagagcttatctctgtgttctccacatactatacgtcttcacacaggtaacaagaatagtgagtgtagtgttgccgattgagcctcgaaaccatttgtgttcactaagaaaaaattgtcgtgcaaacagcatactaaggattagagactaaggctgccagatgcatagcaggctccaggtctgcatctgcacttcccatgctagtgagcaaggtgtgccactggctttcctgtgctttcccgagcctgtgcgtttatgtttcagttactgcttttcctttcatcagatggctcacatttttgcttcatctgaaagaccacgcgtgtctttaagaaaggagcaatggactggcagtggactgtttttgcttgcaagtcatggaggtggcttgggaagtgagcacatggaattctgactgctgtataacagcagttgcaggacaggttgcacattacagagacacaaatgggagatcatttgagcacttctcctgttgttcttagttcttgcctgtactggtcagtgtacaggtatcattgtgtatcctgaatatttacaaatgcagaaagtttcaaaagactatattacttttttttttttttttttttttttgggtttttctgagacagggtttctctgtgtagccctggctgtcctggaactcactctgtagaccaggctggcctcaaactcagaaatctacctgcctctgcctcccaagtgctggcattaaaggcgtgcaccaccactgcctcacagtctcccaaacattcttaaccaagctgtcttagctgagtaggcagggggtacttttaggactttttggaaatactttcttcaactttcaggaaagccagcttatatcagagtaagtggaaatgggacttccttcccaacttacaacttttcctccttgatttttttttcccttccttttttccttttctttctttgtttccttcactcatttatttgagacaggatctctctgtatccctggctgacctgggattcccagagatctgccagcctctgcatctctgcttcattcactctttatatttgttagtttatctttgtgatggaatctcctgcatcccaggatggcttcaaaatgactgtgtaaccaaaaatagccttgaactccagatcctcatgcattttcctacctagtttatgcagtgccgggaatagagccctgggctgcatgccgctgagcaagcactctacctccaccagcttagccatgctcattcctctgctcagtcctgaagagacaggaggagtctcgaagtctgctgtgatctagcggatgcactgcggggcacttagcagctctcattttaataaagctggagagcagttggtcaccaagctggccttgctcctgtgcagagtaagcttgggcactgtggttcagttaactagaactgagggcatcgagtcagcgaatacattctgccaaacacggtcctcatccttgaggaagacagcaaacatgttctctaatcattgagtttaaatggccacatagtgtgcagtgtggtaggtttgggagacccagcatggtctggctctgtgcactctgaccttgtgtaacccactttccacttgtgtctctctgtctttgtattctttctaatacagacaaccagccacatcccagcaaggcctctgcctgctctcctcacagcctggcctctccacacttgctgattggttcccctcagtcccatacaaggttctctggatcagaacctttattcctctcttgtgccctagctgggctgtgatctccaggcactatctgtgccttgctctgcctggtactttgcaaatattgtcaccatatatttctgtctgttttctcccttgccttgtaacctctgttagagtagggtgctttcctttattcctaattgttagtgtttggagcagtagcaggcctacctgcagatattatttgtagaagaaatgagtgcaagaactaacaagttctaggacagccagggttacacagagagagagaccttgtctttaaaacacagaacagtcaatcaaaaagcatgtcccactcaagtggctagaactgtaaaacatgcagatggtctgtgctatcagctgggttgttagcagcatctcaaacttacagaggacttgagtgtcagtcttgtcaactgacacaacactgtgatgtagacttagcatctcaggttgtcagatgagggaacagatcgaaacctttattgaataagaatgtgaacaaaactgcttccttcttggtactctggctccatttcctgttacatatccaaggccatacctgcaccactgtgttctattgtatttaaagcccagtgtgcaactgagagccaataaggaagtagccagtaggtcagaggtcactggggaaagtaaggggctggaaggattctctctcactgtgaatgagggagaagtgtgatcattggttaattgtcagctcctgccgctgttttaagccctgtttaaatctggaagacatgctctgccttttcttaattacttttggatagagcccatagtggtggagatgccaagctataacaagaggtttttgttttgttttgaaccttctttgtattctgattttaaaaagcctgggatggtgggaatcttaacagttggttgtcacccaagtgtggctctggagcagggcagtttggagctctgaaaatcgtcaatcctgagtcctacttagtgctggttaagagacaggttatttgtctcacttaagtttagaggatgccacatcccaagtgagaagcaaactggaatccagtcgggaacgtcgtcgttttggccttgagcttacaatataatctcacttaatcttttaaagatgaggtattggatagctttcccactgcagtgcactccagccttccttaaattattttaagaatttactatttagtccagtgataatagcaagcatgtcttctcaaatgccattaagtacactcaccaggatcagatactgaagagacagacaagtggctctctagtggtgcccttttcagattatccattctgcttttatggtactggggtagaacatgtgaggtcatctgcgttgtgcttctgtatcctgctgatttgagaagtggcttgcctcccatagacagtaactgtggtgcttgctcctgtcctatgatgtatgacttgcttttgaactcctcctatatatgagctgaaatttgatactttggtaatagactgatcttggatcttgtgggaacagcatggaattattagctgaaagaactccaccataaatactgctttcggtcaactagtagcccaggaggggagtggtgtctatttctgtgcaagtgactaattgtacgtacacgatggtttgaccgtctcatcctgctcttacaaatgtctgtgataaaatggatcaggagtgcaggatccaccacttatgtctcctagctcatcagagacagttgtgtgtgataggaagggggctgggagtgagttacataggggctgtggagtctaaccatttgctgggcctgtgtgtttgtgtgatggttgcagatgcgtgtgcactgtggtatggaggtcagaggacaactttaggaattgagctcaggctttcatggtgagtgttaccacccacagagttcatcttagtagccctgctctgcattcctacatttatcagattatatgccactttgaagctaaaaatgcacagtcctgaagcaggtgttgggttggctgcctctaagcccagcactcaggagggaggcaaaagaatgtcaagggcagctcaggtaaatagtgagaccctgtctcactagctccaggcatgcgggacctcagttgtaagagttgctgcctcacatgcacaagacactggttcctcagcaccaccaaaaaacaaatgactgggataaggaaagacagtcttacttcattcaattttgaggaactgttagggaaattgtccaactatggtgacatctgtaaaatgttaaacttgtatgagtttatgtatgcatgccacagcatgcacgtggaggccagagaacaccctacaggagccatttctctccttccatagtgtgggtcctagcatgggcctcaggccattaggcttggcagctgcctttgattatgttctttgggggcttggaacaccactcaaatcaaaactactttgataaaaacacttcaaagagtctagtttactctttgttttgttttttgttttgggggtttctctttgtatccctggctgtcctggaaccgctctgtagaccaggctggcctcaaactcacaagagatctgcctgcctctgcctcctgagagctgggtttaaaggagtgcaccaccactgcatggctactctttatttttctaaagaaggttttgtgtgtatgatagagtatgtgtctgtatgcacatgagtgtagtgcccacagaggccagaaaagagcattaggtcttctggagcaggcagctctgagctgcccaacatggtttctgggaactgaactcaagtcccctcaacagcaggaagcactttcactgataagccatttctccagcctcttaatttactcttaaattatgtgtgaagttcaccttttccttaagacaaaatttaggaaaatggctaaaatctcatttttaaagtcaaaactaggccaagtccctctaatcttcatatagcagtcagtcctcctgagcctcgtgaggagaggacccctgcctgccctcacttacacatgcagccctggtgctctgctatgctctgtcccatgctgctgctgcagtagtagtgagagtttgtgtggcttgagtttgagagcctgttgtcctgagtgtactcataccctcatctcactccataaagcaggacggacactcagcatcacacctgcgggagctctggactgccttgctcctccttcctttaagggagagcaggatagtactcataagccttttgctagtcatttttgaaaggattccactttgaaaatcttaaaacagcctggggtttaatgaggtaaacataggatgatgggattgcagatacgtgatcctttattatgtgagtacagttaatcatactgcaaaaatgagacaattgaagggcagggggtgtggcttagaggcctgaagcatcaggtttgatctcaagcactgttgtcttgctgtgaaaaaacaacttagagaggagagcatttaatttggggcttggttacagctttagaggtaggatgctttcatggggtgcaggggctgggcctggttggggttttgaaacctcacagtttatcccaacgaccccctccaatcttagttatggttaccattgctgtgatgacatgccatgacccaaaagtaagttgggaaggaaaggatttcacttataatttcatatataaagcactgagggcagcgacttggaagccatggaggaatgctgctgcttactggcttgctcttcatggtttgtttagcctgctttcttacagaacccagaactaccactccaggggagcatgacccctgtgggctgggctctccccgatcaatcactaattaagaaaatgccttacatctagatcatgtggaggcattttctcaactgaggctccctcctctctgatgactcttgcttgtgtcaaattgacacaaaagtagctaatacacctactactccttctcaaacagttccataactgaggaccaaacaaatctatgaaccatgggggccattctcattcagaccaccacagtggtgcatagtccatcatactagcactcaggaagtagaggctggaatcagaaagccaaggtcatctttgactaagtttgaggtgacctgggccacataagacttgccttagaaaagagaagacagagagaaagaaggcacttacagtgcacgtgctttctgatagcgtccatccaggtgtctcttcacctccgtgctttctttacagatcaggaaaaggacatagcaagtaggagtggtataaatgtggagaggatagtgcatgtaggaaggcaaggctggtgtggtacttcttaggcagtctttcctgcatcggtatataacatacatacacacacacacacacacaccccttgtgtttccaggtacctggtgacccatctcatgggggcggacctgaacaacatcgtgaagtgccagaagctgaccgacgaccacgttcagtttctcatctaccagatcctccgagggctgaaggtacaggcagtagctttgtcatttggggaagtgagttatctctcccgtgtagtaagaacttagaaaagacagtttttcttatgaaaaacttttaaaagagttacagaatcaaccaaccctgctgctcttgtatttcccaggccagtttactagaaagcaaatattgtccttccctttgatcctttagtctgaatatccaagagacttttagccacattgaaaagttagtagcatcctgatacaacctggtatccagtcagtgtgatactgaggctttaaaatattcttcggggctatgagctgcttttatattccttctcaggacttgagaggtagaaaaaagaaggaccactgtgtgcagcctgagtgccagccaccaaggctgtctggggcggggggacctcttcagaaccacctttgatgtttagcacattggagcccttactgaagtcatcctctagaaagaaaataggctgacaactccagtaggtggagtgggaattagagtttgtgtaatggcccgctgtgagcgcgcacagtgcttgactgaggggagagcactgcaagcactctagaggatatgacaccaaaaagctgaagatggctttcattcaacctactttcttctcttttgcagtatatacattcggctgacataattcacagggtatgtattatacctgacgtggtaattattttggtagtgtgggtggggctagaagagtgacatctagttcagatctcagccttgtaactgaaatagtgattttctgcaaccttgttctcagtgtagacctggtaaaggaacacttgccatttgcctgctcaaggcttggagtctgcctttctctctgagagctcttccacatgtgtgcatctttaggacctgtagggagcagactctgtgcattgttgataagctctctctgcttgctttccaggacctaaagcccagcaacctagctgtgaacgaagactgtgagctcaaggtaagaaagaagagatggactgtttgcttcccttaagtgttccccagaatcgtgaccaaccacacttaagccacgacttgctatctaaaaagtcatttgtccttaggaatatcagactgtgagacttgaactaggctgaacaagctgtttaagtaactttggaagtagatgtcggtatcttgttttcatttttaaaagataattaaattagaaatgcaacacattaattgtaataaagggatattatagtctaaatgtcagttaagccttcctggaacactgataattagataggttcctaaaaggaaaaattgcagatctcagaatgatctaaataaaacctaagtaaattaaaattaagtctttaaaaagtaagtagaggctgccccctgcccagactgacgagtcagccctgctgtcccgagcgccatgttgggttcttctagcgttgccgccatgaagaaggtggttcagcagctccggctggaggccgggctgaaccgcgtgaaggtttccctggcagctgcaggcttgaagcagttctgtctgcagaatgctcaacatgaccctctgctgactggagggtcttcaagtacaaatcccttcagaccccagaaagtctgctcctttttgtagtcatctatcttgaggtttctcaaaccacttttcatgaaccagtgactattcaagagagctaagtttgaagtctgtacaaaagcttctctttaacacgtgccataatacactatcttctgctcgtcagtccttaacatctacctctctgaattccatgggtttctgtctcacaaggtttaactattttatatacactggctgtagcatacaataaagcagcatacaaaaaaaaaaaaaaaaagtaagtagctgcccaaggagctaaagaggtcagcaaccctataagaggaacaacaatatgtactaaccagtaccccccagagcttgtgtcgctagctgcatatgtagcagaggatggcctagtcagccatcagtgggaggagaggcccctggtctttcgaagattctatgccccagtacaggggaatgccagggccaggaagcgggagtgggtgggttgtggagcagggcagggggaggatatagggaactttcgggatagcatttgaaatgtaaatgaagaaaatatctaataaaaaagaaaaagaaaaaaaggaagtagcactatgcttttttatgattttatttatttatttatttatttatttatttatttatttatttatttatttatttattttggatttgggtttttcaaggcagcagttctctgtgtatccctgactgtcctagaactcactctgtagaccaggctggcctcagaaatccacctgcctctgcctcccaagtgctgggattaaaggcgtgcgccaccactgcccagcaatgaattttttgaaatgtctgcagggggctagagagatggctcatttcccagcagctacatggctgctcacagccatctgcatctagagcatctgatgcccactcttcgtctctgtggacactgcacagacttggtgcacagatatccatgcaggcaaaacacccatgtacatgaaatggaaaaggaaaagaaatgtacttctttgtagagtgttgcggccgccagcagctcgcaacatgaacggttcgactgagaaggctactcgagctgtaagagaggaatctagacggggcgaaagaagaaacggagccaagataaattcattctgatcaaagctcaaattttattgttgggacactagttataaaagaagggggaggggacccgatttccgccaaataatctctggtccagtaaaaaggtgcacgtgtgtggctccgcaggttctagcagtgggcgtgacagaacagatgagcgggaagctccacccctgagcaagcaggtttcaggctgggggaggagagactacagtagagttgtaatgtccatgtaaccacagtgatgacatagtaacctccatagtttcaaaaggtttgagtgtcccctcctagtgacccatgactctcacccttcattcaatgcaggcagccactgacccaattctgactctggattaatcttgtttcgtataaatggaactgtcgagggtcatgcacattactgaattgtgtgctcatctgtattgtgtgctccagcattcccagttgttcagcagtttccttttcataagcacaccaaagtttgtacgctgctgtcctattagtgagcacttgtggttcggaatataaacctattgtgaacattcctgtgcacacccgtgtgggcatatgtttttgtccttgagtaaatgggtgggggggcgttgctttgcttgaagctttatttttaaagtttcttggagtgttttatcatgtcatgcattctaagtgaaaactggggcgccctctttctgaaagtgacttttcttctttcctggttgtgaggtagcagaacttgctgctcccatgcctgacttctgctcttgcccttagattctggattttgggctggctcggcacactgatgatgagatgacaggctacgtggctaccaggtggtaccgagccccagagatcatgctgaattggatgcactacaaccagacaggtactgactgcttcagtcgcctccccagatggggaaggggtgctccctaacatggctttcaggtgacttagcagctggggccttacttcttacgtcttccgtgtcattctttctgtgacactacctgaggggagtggtctcttaatcctaacacctatgtttcctgggaggattcaccatttaccagtaacaaagttttgcccctttgtgagttgcttatttcttttatcttaattatattctgagttgcacgacctgtggagtcttttcttgagtgacaattttaataagtttgtttctatataaaaaagattgtcaaaccttgggtgtcttaaatcctgacttgaatctctcactcatagttagagtcatttgtgtccatgaatatgaatagaaaccatgtcggtgcttgtatcctctttactgttccagtggatatttggtccgtgggctgcatcatggctgagctgttgaccggaagaacgttgtttcctggtacagaccgtatcctttaacacgttttggccctgtttctcatgtgtgtgctgtggtagatgtgtgcttccctaactcattggtggggaagactcagttctttgcagttccagcgtggcttttgaggtctgtcctcttgttgagttgctcaccttgccaagaaaaggctttggggttgagaaaacaagcttagaactcacctgtcatatttttgcagcaagtccctttattaatgagtttagtctattcctgaaaatccttggtgagtgtacacggccacctgtattcagaggtatctggttctcacatttgcttatgtactaaacagactgtgggtccctctgctgacacgcccgctgagtcctgtcctatttgctgcttaacaaccaacaaaagaagcaggaagagagaggccctgctgtgtgctcttgttctctacaccttgttgtccctgtttagagccagccccactttagtcccatacttagcaccatctgggttttgggcactaagcactcgttcctatctgttgggcacttgtcccatggcttaggaataatatcatttaatgtgattgtgagaacgcccaccagctctgcttaaggagggtgttaggtgaaaatgttaaaacggatgcttaaaatccatcttcaggaggagttttgtaaaactctagtagcctgcaactggttttggttgggcttttagaaataccatagcgacacatgcttcaccttctaactgcagggtgagctcttgcctaacacattgagactgtaagctcagttgctgtccacttaggctgcccttctccagggactgccatgccactgtgtctgtcgtgacagttttctgctagacaatcttttatggagtggaatcctctgctccccggataatgctgtctgctcctgtgcgtgctgcttggtgcagctcactctgttattctccactccaggatgtcatcacctgaccatctctattcccttgagattttggcttgcttacagtccgagctcagagggttaggcagggtttatgatgcaccttgtgctgtactctgggaccatcctgaagctgatctctcttctcttccttttcccctggtgtctcttcagctgtcctttggctagtcccagagacacatgccttcataggcagacagactaacagaactatccttagggaagtgtctcagttcattgcttttgtagtccatgtatgcacagttagatgctaaggccttggaatttcgattttagattttagctttttttacttttgaactatgtggctttgatcaagttttctaatatccacatctctctatttccttaactgtatacagctcagtgattgtgactttactgagtccagagccatcaggaagtgctagcttcaccagtggctgtatcagtagcttgtcatggccacagacagatagatacctgagagaaatacttattttgggctcatgggttcagaagtctcggtccatgatgagatagagcatcagggtagcaggagcgtgtggcagaggaggctgctcacttcatggtggccaggaagcagagagggaacgagagaaggttggggagaggaaagcatccaagaacaaagtaccttctaggacacattcccagtggcctgcttcctctcccagaccccacctcttaatgttcccagcataaaaaaatagcagcgccagctggggtcagacgcgcagtaggagacatttgaggtccatactgttaatactccatccctaccttctgaaggccatatacttagcttgtagtataaaacacactcagtccatgtccaagaatccagatcctcattagtctcccgatactcaaggcaaactctcagctgtagcccctgttacagtcaacagattatatgcttctccttttcagtggcataaacattctcatccaaaggtaaggaagggccagaccaaagcaaggtgagatggagcattaaagtcccatagtttgacatccatcctccaaggcttgggtggcatgagctgagttccaaagagcttgggcagcccagctcctgtcaccctgctggatggatccatatgccttctctcttggctcactgcctgtaactgtccacagcccacattctggggactcactgggacatccccctcacagcttcatggatcacactgtcaggccactcacagtgattccaaccctggtgtacactgccctgcttatgccaccccataatccttgggttctgcgtgcctcgaaaaactagcatcgtgctgccaggctgagcagtagctgggtctttttggaccgtggcttcagagacctcagagtagctaagcactatgaccaggtcctaaccagccctcagtgggcagggggctctgaggtacctgttctctagggtgttttggacgagtttatactttgcatctgggcctacagtagttaggggtctctccaatatccagcatatttggtatctttcctattttttcagtacagatttttctgtttgttgttattggtggtagacatttgttttgttttgttttgtttgagacaggctttcttcgtagcccacgctcacctggaactattgtgtatttcatgatagccatagcctcccagtgctcctcttgccttggtctcctgagctaccgtgccttttttttatgctgtgttgggtctggatcccagggccttatgcatgctagaaaaccactttaccagctgagtcacatcgctaagcagttctgacaggtgttttgagtaaaagtaggagtttacctgtgtgcgtttagttttaactgggtgaactggaaatcattagtctagtgggcctatccatttttcttaaggtcccaaggagttctaaagttctcttcactactctgtcctgtggtttctagaactcttttcaacgcctctaaagaacatacggaccccactccagccagcctagaaggcctgaggctgtagcctgtgtggtttgtaaatggaacactgatgagacattttgcagactgctctttcgtggagttcaattttctccatgggtttctgtttacctcacttttagtcattgtgcctttgaactagtgatcttagcttctaagagctgcctaataagactttttgaggcatcatagatctgttaggtgtgtgctgtcctgtgtatggctcatagttgaggagcccgtgtggttaatgtaacttgatgattgattgacttaacctctacaattttaaagtttataacctatcagtatcaattaggttcatggtgttggacagtcgttgccactgatgactgtgctgtgacttagaaaacccttccatccagcttaataagagtggttggtgttctagtggttgtgtaaagaacaaagctcttctctagaagcctggtcggctataagtatcaagtgaattcagctgatagagattaatagcaaaagagggagcagggagccccagactgtctctccgggtggaacccttacttactttgattttgaaatgtgtggttagctaggtatggagtcactgatgccagcacgtcagcttcagctcaaggaccgtaagctgtgtggccttttctttgctgtatccaatatagacaatacattttcataccagagatcgcagacttgacttgttattttcctgtgtaatcaagtataaatttccttcacgcataaaagacctttcccccattgtagtggatgtggtactcctaagacgtgacctatggtcaggagaggcaactcagcagttaaagagcatagctgctcttccagtctccaggctggtgttcagattctagcacctgcaagatagttcatctgtaactccagtctcggggacccagtgtcttcttttggtctctctgcaagatagttcatctgtaactccagtctcggggacccagtgtcttcttttggtctctctgcaagatagttcatctgtaactccagtctcggggacccagtgtcttcttttggtctctgtgggcaccaggcacgcacatagtacagataagcacacaggcaaaacgctcgtacacataaaaataaatgattttttacagatgtgaacagagggtggagggcttctggattacactgctgctgctgcactgatctgcgtactgtcctgggtatattagaacagtctcagagcagttcgtccttcttcaaacatgctacggaacatcacagatagacagtaccgtgctctagtgaaccctgtgtctgctctgcccagagggtgaagtaaaatgtgggtggttgagcaaacgcactggagtgcacagcatatctagctacccattgctctccattgttaagtttccggtcttttcctcatttttagttttttctttccttaaactcagggagggcttatgtatgccaggcagatactgtaccattgagctgcatctctagaagttggtctcagttttgaaaagaagttggaccgggcgtggtggcgcacgcctttaatcccagcactcgggaggcagaggcaggcggatttctgagttccaggacagcctgggctacacagagaaaccctgtctcgaaaaccagaaagaaagaaagggaaaaaaaaagaagagaaaagaagttgcactgctgatactaaagccagtgccttagggttggaaagatggctcagataatttctgaattaaaatttggtattatcggggctggtgagatggctcagtgggtaagagcacccgactgctcttccaaaggtccggagttcaaatcccagcaaccacatggggctcacaaccatccgtaannnnnnnnnnnnnnnnnnnntggctgtgagccaccatgtcgttgctgggatttgaactctggaccttcggaagagcagtcgggtgctcttacccactgagccatctcaccagcccccttgaaatacattttaaactgatgataaacttacttctttgtggggaaggaaaagctatcccagttgtgaaggatagctcactgtggaaatagcaggctgtactaagtcttgctgtgcactgtcacatagctgggtggcagctttgccttagctcctaaggagggttttcttccataatgtgtttattaccttccaattcccaggtttgctgtagcagctccagccgcagccctcctcgctgtgcacgatgttcattcatcctttttactacttttttttttttttaaataaactgcatagaatgtttttctgggttttgaggataggtcagaacagtgagtcaagtgtttggatcagtcggtgtttgccaggctggctgcactgggcaaggctggagagatgctgctgccaccctcaaaaccagggtagtcagtctgaaccaaccagagtggtggggtgactgggacagaagtcttcctccggtggaaaagcagaatggaatgaggagtgagaggtgcaggtaagttacttcagagagaagtccaacatggagtaaaaccccaggtcattatggagaggagacggagactcaggagtccaggtcacctcagccacatagtaagtttgaggccatctcaaaaaagcttgtccagaaagacttcttgttagaacagcccttggaagggacagtgggaaaggaaaaggcttaatacaggaagagtggaggcttcccttacaactgcataaagaggcatagaagtgcctgagacctttgccttgagttgaagctttgagcctattcaagaatagtagtttgaggcaagcagataaaagttgagtgacaggtgtcagaaaggcgtggatgtgagggtgaggagctggttgtgatttagtctgagaatgctcacccctgcagacaagggagaaaggtatggatgagccctgcctgctgatagatgcatgttcttcaggcagcttggaggtgaagctaagtcagttaggaaacaacccagacttcacttttcccaaagggaatatgaaacttgcctctttagaaagtccagctgggccgggcgtggtggcgcacacctttaatcccagcactccggaggcagaggcaggtggatttctgagttcaaggccagcctggtctacagagtgagtgccaggacagccagggctacacagagaaaccctgtctcgaaaacaaacaaacaaaaaaaaaaaagaaagaaagaaagaaagtccagctggttaataaactactttggagtcgtacatggtaaaatcacctcttggagggctggaagagtctaatttttttctattaacatacatcctcttgaagtggctaatcagatattcctggggagtagaaatgtgaatggagctagatttatataaactgagtagcttcttcctgtctgcaaggaagatgctcaactgtcaccattagcatgtcggcagtgttacggcctgagtgagtcagtgccagtctcagtccacccactgtccgcacctggagcatctcctcttttccattttcagtagcaggggttttgttttgttttgttttttcttttaccattctaacttcagaaatatcttgtgtgagtggacttccttctgggttaactcggttttctgtaggatgccatttttgggcactggctcatcttatcttaaaaattattgactgttgcaggcctgtgaaaactggtgtgtaaatacacgaatgcacggccttgttgcattccaggaaaactccatgtataagacaggcaccaggctgtatcttcctgtcacctttctagaattttcttctgttttagcaaaaaaaaaaaatgttcagaggcaaaatggccatcttgttgcataagcagttcctgtgactaggcaactgtggcttgcagacactgttctcttgactgactcatgcttattttgcctctctatatgcaagctaaatcttctctatctgttctttaaatattgtatgtgccttttatgtatcagataatctaaaataagggatggggttcagccatacattgtagtcccagcacttggatagatgaggcacaaggactctgagttaagaggctgctgggggattttaggtgacacaggaaggacggctaatgatcctgcagaacctgacgggctcacacagtctccctatctcaccatcagctgaggtatggagcagctgttcagatgctcaaaaggggctgactgaaggcagtgagagtaaatggcctctgatcctccggtgaacacatgctcatttgttctgaggttttggatggcagaatgactattccgggccctttgcctttctgcttttcaagtctttagtgagtagactttggttactttacatccgttatggttgcagcctggtgtctcccatagtggggtagcaccctctgccagctggctgtccctcacatgttctgtctcctagaggggagaggggaaggtctccagagggcacactcaagtgaacgaatggtgtctgggaggagagcaggcctcccaactgtcagattacaagttccttaggtcaggccttagggggatagtcacaaatagatgcatagagtgtgctccgcctctgcttgccagcacactctgcttagctacctcctagtgccttggtggaaggggaggtggaggtggaggctgggctcatggactgagtggcgtggcctcttgtctaagacccaaccacagtgactttacttcctgctgcatggtggtgacaaatgtgtgtgtgtgtggcggttttttgaacctttctacaggaggagcaagtcatgctgaaagtggccaccctacagaagccttccacccagaatcttccaccatgttggccttgtttgggggagggggggactcatttccattattgagattttttttgtttgttgtgttttattttgctcattattgttttgttttgcttttcacttttattttgtcccgacattttcctttatagtccaccgttagatattgatcagttgaagctcattttaagactcgttggaaccccaggggctgagcttctgaagaaaatctcctcagagtctgtgagttgacgctttgattgaattactaccctcgggggcctctgccacttgccttccgtcactctgcactctgactttggaatgcatgtgtgacgtgtgctgtgtgtgatgtgtgcacacatgtgagcctgcatgagcccgcttgcatgcatgagtgtgttttattctaaactatccttatctgggtgtggacttaagatcatgggaacccctttggggcaattgtatgctaataaaactgagagttgagattccagttcattccaagagattaatgggaaatttgtgtgtgtgtcctcctgagccctgacttctctctgaagttgcccacgtgcttaagagccctctcactttctgctgagcatcctaatctctgacactgtgtgctagtctgaccttccctctcagtggtgggtgatgtgtgccttgtccctagaggggctcctcctgggcggggtctttccatgggctcctctcccaccctcagaccacacagaacagcttcctcccctcatgacagtctgcagatggctctgaactcctccaggaaccttggtcaatacagtgactagcatgaggggccacttggaacttgtgctttctccatggaggccataagaaggtgactctgttttactttagccatggttggttggttttttgttgttgttgttggttttttgttttttgttgttgttgtttttgttttttggtttttttttgttttttttgttttttttttttgtttttttgagacagggtttctctatgtagccctggttgtcctggaactcactttgtagaccaggctggcctcgaactcagaaatccccctgcctctgcctcccaagtgctgggattgaaggcttgtgccaccattgcccagccttgttgttgttgtttttgttgttgttggaggattttttttttgtttttgtttttgttttttaagctgttgtcactttctggggccagaaactttgaggaagctaggaaagcccctccttcctctcatttccgcttagggaaataaatggaggagctaagccccagctgtgcacgcctaggttcccctcctaccacttccaatagaagagccttctgctcagctaagaaggaagttaagtagctgtaggcaaccagcaacacacgagtcacctcccctgacaaaatcaggaccccgaatctgcagtgtagctatacataaaggaccctggagcttttgaatgggcctattttattttatttcctttactcctttaagataagaaagcaagccaggcatggtggcgtacgcctttaatcccagcacttgggaggcagaggcaggcggatttctgagttcgaggacagcctgggctatacaaagaaagcctgtctcgtcaaaaaggaaaaagagagagagagagagagagagagagagagagagagagagagcaagcaagcaagctggatacatggcctaataatgagatgtcttttatcttaacatgaagtgggcacatcagatatttgaacagttctagtgcagcaatggacagaatcaggtaccaagacaaacatcctctcagtgataactcagttgtgtacagtagtgagaaaagagcttccctgcataatcgtcagaaatgggtaatggcagtctaaatgttggaaaagtatgggcaaggttaagttagtgttgatgacaccacccagtacttttgaaatctccaaagcaccagctgtgatggtgcaggtctctaaccccagcacttaaaaggcagaggcagaaagcctgggcttaatttgtaagacacctttttaaataaacaaacaactattgtagatgtagctcagtgacgtcaacatggccatgggtctaaccccagaccccctgggggtggggagcatacagtacctacatccgggtgagataaagctgactgagtaaaagtagtcagaaaaatttactaaagaattgtagtcaacagaacactgaataactcattccttctggaaagaacagaacagggaagccagtgtagacaaggacacggggtctgaatacagagaatgcaggacagggagaacaggacagaaagctggcagaggcccgaggacagctcactgcttagtgtgctggcacctgggttaaccagccaaggaaacaaaggcatggctcctgccctcttcttcagagatacatcttcttgactcccagatgacaaatggctgatcctgtacgtgctgcccgcaaggagagcatgacagttgagcgtgtgagctcacctgaatcctgcgtgtctagttcaccctgtttgtcccctctctcagtatgcagagcattgttgagtgtggagttttcagagggaagtccaaagtctgtacagagtgagtcagcccatctctgcactcaggtagaagaagggcaaatgcatagcagtagtcaccttccagcagggttcgtgctgatgtgcaaggaaaggacgccattggcttgtctattaaagatgagattccagctgaaggatgacttgatacttaggtgaggagaaaggaagctcactaaatcatgttaaggtttagtttaaaatactatcatcaccttgagagggagcgtgggataaactggcagtgggtttccatttcagaagctgtggcctgtacctggtgaattggtggcctggctgagggaagttagtagtcctgtcgtttgagtaaggacactgagatggcttagcagcagagacctgagttctctcctagggcccacacagtgggcagagaattctacaacttggagatcaatcctctgatctccattcattagtggtacgtgtgacctgcccctccctaccacacaaatgaacgtgaaaatggaataacggaaacttcatgtaactttgccccgtcagataaacacagtgttttaaactttttgttcattgaagttagtgtcttccctcactacaggtgtgattgtggcatgttctgaagctgtcaaccagactgtagcttcggttttgccttcgccatcactcctaaagtacccttcttcaccaacctatatatttgtggcatgcattttaagtatatcactgccaacgtctttgagacttggtgtagctcagcacccacactccaagtttctcagcctgtaggggtgtgtctcgtagagcctgtgccatcaacactgaacctcctccccagatagatctgttagatgtgttaggtttccagagtttcatcaccattatctccatcttctacttttgccactgcagcaaacaggttttagccattgggacttgaaaatggttctctggctggcatcctggatcaaggcacagtctgcttccagagaacctaaactatttaacattaaagttgatacttaagcaaaagtttgttttcatgtgtgtgtggccactcaccggctacatgcctaatagctcctgccattctccacagaatgttacaacacgcagccttaggcgctggcctggtgtggttgggagttgctttgcttgggatggcttttgacttaaacaactggagttgatttttacaccgtgtcttaacaatgcccttgactaggcatcttaagatattaaccagcttcagcagataatgcgtctgacggggacaccccctgcttatctcattaacaggatgccaagccatgaggtgagaacaaacagcatgcacagggaagtctacctcggaggccaccttctcgtggtagtgtctgtgtatagccagcagtttctaatgtcaccgaatgcttgcatgtgccccaagaaccgttaaagcagtactggctgtgtgctagcggagtgttggcatttaggatgcagtctcctgagcctgcgaggcagcgatgcagtgtagggcagtgttccctagtgtttggctttctgatcttgtgcttgaggtaacaagtgtcgttgcagttgtatgtagttagggtgtgctacagccgtgtcatgggtgcatggaacagagttcattagtgtgctttgctctccacccattttacaaccaagagaagactgcatgcaagcacgcactataaaattccttgtgctaataggtgtgctgggttttttttaaacaagacaagtaattcatagtaagtatgaacacctggggaatcgagctcttgaccaggtcataactaacctaactccagtttatgatcagacgtgacagacaaacccttgtagagcattgtgtgcatttcagctcttgtctgtattgaaaaatggcttttcttacctctattcctttttccattctacgtggttaagtaggaagggattgcagccatgtctgtgtctggttcctacaacttcaaattgcagtgagttcgtctgcttcagtaccaactcttcttcatgacttacctgattaggaaaatggtcctggaaaagactgcttggtctcaattctggttttaagcttctgaccctttgaccagaaagctagtaaagagtagctgattgattatcactctcatccacaggaaacagaactctggggagaccgcaagaataaagtcagtggtcacaaatagagggggtcagtggctagaagaagagtaagcctgaattgagcatcccagacagtggtccatacgggcctcagcctagctcattccctgagatcactaacactactgaacatagtcattctgaaagtctgtgtttttacaggcaagaaactacattcagtctctggcccagatgccgaagatgaacttcgcaaatgtatttattggtgccaatcccctgggtgagttgatcgtactttgattttgtggtataaattagaaatttgaagttttggttttgactaaaaagagtaccttttttttttaagatttatttattattatacataagttcactgtagctgacttcaaacacaccaaaagagggcgtcagatctcactacagatggttgtgagccaccatgtggttgctgggatttgaactccggacctttggaagagcagcccttacccgctgagccatctcaccagcccaaaagagtactatctttaagtaacttttgggtcttaataaatatagctgttactgtctgtctgtattgtcacataaggaaatatcatacagtgataggcttgtatgcttatatgcttgcagaatatggtggagaggctaagggaagtgaggaatggggaacagggaattatggggacttgggggagaaggaaggaggtgtgaaccttacagctgctagtggtaggtggagcccagctgaggacagaaaacaggcacagacacatggttaatgcccagcagtgggtcctgatgtcctctacactcacagactcgtccccctttcctcccctctctgcccttcagggtgtaagcagctgcctttgcagcattgatttggtggctggctccttgccttcctgcctccattacctccaggatcacctggcagaggaagtgacagtggtagctcagattgtgtcagcacaggacagtgtgctaaggttctaattcctctttctggtgtagtaggcagtagtagatacagagccatcagaccaccaccgtctcctgccatgagaagggaacaagcaggtggtggctgctgtcccctgcctctcccattcctgcagatgttactgtaaagtcactgcacttaagtcttcgtgggtcatgtccctttctgagggttctagaagccatgtgccagagttacttatcctttgaagggctgatgtctgtggcagtgatttcaaaagctgggagcggaagctttcacgaactctgtccatagccacaatactgaggagtggctgtggctgtggcaatgattcctgtagcaggagaggtgtgtgcattcttggaggagggggtccagcctatgctacaccattcaggcctgaggtgtacatggtactgacaggttgggttaggtttgtggcttccctgtcaggctcactgggctctctgtaacttaccttgagctattgcatcagataagggtctggggtctctgtgatctctaatctttccatgttgattccacccctgaatcctcaccagcagatgtgcggtacacagtgtctgagtcttctctgatggagctggtagagatccccatttagacactgagaagagctgccttacaggagtgaatccaggctgctggagactaaaaggaggctctggcccatctggtgctcttcacagcctgctcacatccaaacgtgcctggcagcccattgccaagtgctggtcagaaggaacatgctgttaccgattgctagcctagccgtccccaacaggctgcacaccagcgatataaatattaacagccctgttgtcggtcacaggcttcgcatcactgctagcctcaagacacagctgagaacttcacattgccctttgatcttagagtgtctatttatgtctgcctccatacttgaaaagtcttgttcttacttctgaccttgttcctcatctaagtgctttgatcctgaggacgtggacctctttttaccccagggtagcaggcacccactcattcatgttcagtataaagtcagcggatttgtagaacgtgaggatttgtatccaggaagtccaccagtgcttcagtgttgaagacagagtcatgtggcctgttgtgccaccatgctcactgtctgcagtgctaggtttagatccaaggccttatgcacactttgcaaactttactggctatatcccagccctcctccagcactctaaaactggagagccagcgtatgcatgtttgctgtttcctctgtaccctcaaagcctgcgtttctgtggataactggtgttcaggctacagggtacataatcactcagaggagcagaggtatagcatctcttcaggaagttctcctcgacacccatggagccttccacgctgaagaaatcatctggagctgtagagatggccaacggggcccttggtctgagtccctgcaccaacaggatgcctcacaactgtctttaattacacttacagaggatccagcgccctctgctggcttttagattttcagccagcaggcatgcactgtagtggagacatacttaaaacttaaatctagctgggcgtggtggcgcacgcctttagtcccagcactcaggaggcagaggcaggcggatttctgagttcgaggccagcctggtctacagagtgagttccaagacagccagggctacacagggaaacactgtctcgaaaaacaaacagaaaaaaaaaccttaaatctaaaaacttgtggagtttatttctgttttacttttgggagagaaaaaacctggaagccattattgaaagtaactgataatcaccaggagacaaaccatctccccatattattcacttggggagaaacggggaagagctcaagatgccaaccaccttagctcagcataaatggagctcctggctgtggtgccccaggtcacagcatcacctgtggcatggtctcacccagtatgcctaatttcactcttaccaacaattgaggtggtaaatgtaaagactagagagaaatgggagagagtgcacacagcataaggagaggggaaggaagcctccatggtggtgtgccacacctgcagtgtccacaaatgaaaaccaaggtggatggagaaggagagctggggggtaggagggggtgtttgtttattattctgggtttcaaacccagaacctcagtaatgtttttaaaatgtgccataggcattcaatgcgtacatggagggaaggggttacatgcagaagcagacaccttaaaggatgctttgtgtggatgtgaaaggtgcttggaacttgcacagtggtggcactgatgtcatgtgttttcctcttttctggtgtgacagctgtcgacctactggagaagatgctcgttttggactcagataagaggatcacagcagcccaagctcttgcgcatgcctactttgctcagtaccacgaccctgatgatgagcctgttgctgacccttatgaccagtcctttgaaagcagggaccttctcatagatgagtggaagagtgagtccagggcaggctagcgtgggctttgagcttgctttcattttattcatgttttgtttgttttctgagccagggtttttctctgtgtagccactcagaggaactcactttgtagatcaggctagccttaaactcagagatccatctgtctgtgccttccgagtgctgagattaaaagcatgtgctaccaagtcccgtttatgtaatattttttaacagtgctggagattggacctaggactcacacatatttccaacatacctatgatcccagcacttgggaatcagattaaaagtttaaggttaaaaaaaaaaacagactgaagccgggcattggtgacgcacgcctttaattccagcactggggaggcagaggcaggtagatttatgagttcgagaccagcctggtctacagagtgagttccaggatagccagggctacatagagaaaccctgtctcaaaacaaacaaacaaacaaaaaaaaaccaggctgtaaagttattcacagctgggtaggtagtttgaggctatcctgggctacatgagaacctgtctgaataaaaccctcgtggatggttgccagcagctttctgagctcactgccagggtctctgatgcgtatgttccctgatgggctgcagacacagagtgcagagccttcaaactgacagagctttgaggtgcttggcggttttacgtttacagcatcttttcaggataaagagggtctggcgtatttcagcacagaactaggacaggagttttttatagcttacttttggcctagttagggactgccaggaatggagccacatctccacccccagtcatactccttcataaagcacaaggtcagttctgcagttaggactgcctcgttgtgtgcagagtgcagtgctgctccagggagcactcagaaggagcaccgtgcatgatggagtggggagacagttctgtctgtgtccttgaactggagctgctctgctgcagggcagggcaggagcaaggcaggtgatgtagttcatcagaccactgccaggagggaagggctgagtgtctgcctgccggagttgtacgcctcacccttccttccttctttccttgccctaggcctgacctatgatgaagtcatcagctttgtgccaccaccccttgaccaagaagaaatggagtcctgagcacctggtttctgttctgtctatctcacttcactgtgaggggaagaccttctcatgggaactctccaaataccattcaagtgcctcttgttgaaagattccttcatggtggaagggggtgcatgtatgtgttagtgtttgtgtgtgtgtgtgtgtctgtctgttcgtctgtccacctatctttgtggaagtcactgtgatggtagtgactttatgagttgtgaatggtccttggcagtctgcctgctttctcagagtctgggcaggccgatgggaactgtcatctccttagggatgtgtgtgttcagtgcaaagtaagaaatatgaaaatatccctgttcttagttaccttgccactttggcttctcctgtggccctgcctttaccatatcagtgacagagagaggctgcttcaggtctgaggctatccctcagccatgcataaagtccaagagaaccaactggctcctggtctctagcctgtgaccggcttgcttaatgtcctcagaacctgacaggtatgttcaaaactgtcagtctgtttgtgccttaaaagggtgagaagggcgcgtagatagttacagagtctcagctgctgacgttctgagccaggcaagtgcacggggctgttggatggccagtggggagctggaaaaaacaaggcagcctttaggaaggccatggtgcatgtgtgtgcatgcgtgtatgtgcagccgccctccctcacttcaggagcaagctgtttgctgtgcttacccttcacctcagtgcagaggtctccagtgccgagcacaggcacctgccatcagtagttcctgtgtcatcttcacatctagcagagcacggatgtgtttgcatgctgtgctcttggagcttgtcctgtcttctggaagccctggacaaggcgtgtgaaggcttcccagaagttcctgtccacattgcctccgcccaccgacgccatgggcacactgctccctcctcctcctccagctactttgtgttgaacacaattgattctccaggtgctcatggtgcaggaaaacaggacagacagagagcacctgaacccttgccatctgatgtcaccaattcaggaaaacgagtcctctcctaggactatccccggttctggaaatcatgttctcctcactcatggtgacaagctaagaaagctgaacaaagggagagacgagagcgcctgaagccaggagctcctttactatctttctcaaaagggttgttagacacaaaccaagtcatcaaggccccgctcctctcctcggaagggtcccccaccccccggcagcttgacactgaatccagtgtcaatttggggagaaagcagttttgtcttggaattttgtatgttgtaggaatccttagagagtgtggttccttctgatggggagaaagggcaaattattttaatattttgtattttcacctttataaacatgaatcctcaggggtgaagaactgtttgcataattttctgaattttgagcactttgtgctatataaggacccatatttaagctttgtgtgcagtaagaaagtgtaaagccaattccagtgttggacgtgacaggtcttgtgtttaggtcaaggtgtctcctctcagtgcagggacatgcctgctctgtggggcaggcgaggaccctgaatcatttggagcccagaaggaggcagactggccaggtctcaccacctcagtgtgcagttcaactccatgccatcccatcaagatgggttagtagcagtgtctgtttttgaatgccaagtgtgatttccaacaattctgctctggttatttcattgaagacatctttgcacatgtgaccatgctgtgttaggggctgtgttccagggactggactcgaagctagaactggcagaagagttctggcatccacagcgcaatgctgccaccacccagtttcttcatcagaagacaagggaacgagaaaactgctgttcgtttgtatttgtgaacttggctgtaatctggtatgccataggatgtcagataataccactggttaaaataaagcctagttttcaaattcagttggtttctcaggtttattctgttcctcttcttggttgtgggacttttgttgtcagctgtgacctagcacatgtctgacagaccctttctaaagctgcttaggtggacctgaggggaaggcaggtctttgcagtgagtgagttactgtgcagagagaaccgcatggggagagtggcctagtgtgcgtccacacgcactgttcttgtacagtctgaaatgaatgtttttcacatcttcaagtaattggtttgatcagagaatatccacagagtttgttacgtatcttctgtggctactttcctgataccatgacaattgaaatccgaggggcgaagactgcagggctatccaggtagctgcttaatgtttagcaaaagttgctttctgactaaatactctaaaactttatacaccatgtatttttatctttaagttgccaaagagaaggctaggttgtgtgcctgtgagtgcaggatgggaggacatctgtttgactctgctgtcttcatgaccctaaaattgttcttcagaactagtgagctgtatcatgcatgagaaggctgcagggcctcacagcaggttctcaggctttgatgacacggtctcccagctaacctgaggacactcacagagctgagctttttgtcctgaagagacacaagtgtagacgccattcttttcctgagcccccacaaaggtgacagaaaaggttttcagctgtcgtggaggtgtaggtagctctagagtacaggagggaagaggaaagggtagggcccttgttagctactgttaccccagaatggtcaaccaaagtgtgttcttcatttccagctatgatcccgggaacaaagtgatcctgggtttccattttcaaatggaacatttagtgtccttcagtatccttatttgaattttgcaacatcacagagaacttttgtagaagccaaaggataggcttgggagatggttgggtcaacaaaggggcttgccttgaaagccagaaacacatggttcaatccccaaacccttgaacagatacttaggtacggcaacatgcaatcctaaaggtgggggtatagcaacagatagactctcaggctcaatggctagccggcatagtctacttcaggacacagcctcctcagaaggtggggcctggagaaatggctcagcagttaagcacactggctgttcttgcagaaggcccaggttcacaactttctgtaacttcagtttcaggcgatttgatgcccacttctggctcctgtgggcaccagggacatagtccagagacatgcatacaaaatacattaaataagaaaaagaatgtaaagggtggatggtgactaaggaataacgcctctgacctccatatgcatgcacacacagacagaaagatatacctcccttactgtggactaaggtttaacttgccactttgtaataactctgcttgaggttttagttttcagtatcagcttccaccaggtcaaccattatgtgcatgacaggagacagttgcaatcagacctacttggtctgctttgctataggctagcatgcagtccaggtgcctgcagtcaagtggatcacttctctactgtcaggaaactagggggctcaggtaataatgcaaagaagaggggtggtcctttataatccaagcgtgttttaaaatggaaacacctactttacacatccggaagtccttacaagtgcacaggtcggggaggggacgatggttgggtaccacgttctctatgatagaaaaacctggagagaacctaagaggccgtctgcaacagagccccacacagacacacgtggggtcatgtgaggtgcatggcgtgaaataaggcactgatagcctagagtatatctccccacccccaccccgtcactgacaaatggtaatggttgaagattcccttttacctagaatgcttgggaccaggatcattatgaatttcagagttatcaccatttggatgaccctaaatcaggaaccctgagatctaaatcatgctgagtgacaaatccattgggacaccccaggcttccaattggggagtggcacactctgcctggctgtggccaagagaaccctagagtgacacacactgaagcctctgcagcgcctctgacttttgtctacaactggtttttaatcaaccaggaagatctttaaaatccacctggtctggggacctatccctcatagccctttgtgggacagcctacatctagctccctagctgcaggagccttaccccggaggggagggcgaagtggcttctttcccacaaccagtgttctgagggatctgaagcaagagtttccaacttagccactgatgacatctcagccagaatatcgttagtcatagaaccctcctttgcaggccaccaagtagtccccacccatgcttccgcccactagatgccagcagcaaccacgcttccttccctgatttgtaacagccacagaggtctctagatactaccagttggcagtagcatccccagtgtaaaataaagtcatgcaggagtcccgtgcctctgttcttgagaatacatggaaggtcaacatcttgtagcctgctgtaacttggagaggtggcttggtataccagaaagaaaggttcccaactggacctagtggtgcatgccagcacttgggagacaggggaaggcagtttagagttcaaggccagcctcagtctacagagtgaattccacgacagccagagttatttagtgagaccttgccttgaatgaatgaatgaatgaatgaatgaatgaatgaatgaacgaacgaatgaatgagtgatggatcatgaatgaatgaatgaatgaatggtccctttaaaaactttcatatttcttgaagtcagacttttcagaaggatgtcctcaatgtgcttcgtacctgtcatcccaggtaatccatgtgctcaggaagaagagatttactgcaaattggaaaccctgtctcaaacatcctccctcctacacctggagagatggctgagttaagagtgttcactgctgattcagtttctagcacccacattgtgctgacaacggcctgtgactccagctccaggggatccaacaccactggtctctgatgtccaagagcatcggtacacatgtgcacataaccacacacaggttcacatatgtacacatacttataaaaccctctaaaagtcttttttttttttttacttcaaatctctccctcacttttataggggagaagtcaattgtgagcaatgactaccacccctagagcagagcctcccagtacccattgctggaggccatttccgggctgaatgcacctatggacatcttcctgacgcatgcttacaggcagtagggtttatgagggaagtccaaggcctttgtgtcctgggtgttccctggacctgctgagctgcctcttccactcccagctacagtgttggtggcacccagatccatttcctctgagccgttgctcaggcatgatggagtctctgtgaaagacttgtcacccgatgactatctgatagtggctgtggcagccctgtgtggggaatgtccccacctacagatgcaggacagagtgactgctcataagccctgctcccagtgaccactgccctccaagcttctgtgctcaatccctgggtttctgtgactcgctggagattaccaagatggaggactcccataggactcttcctaaccttttaaggtttatttttattagccgggtgtggtggcacatgcctttaatcctagcacttgggacacggacagcagtagaatctctgtgattttcagtccagtctgatctatagagcatgttctaagacagccagagctgcaccaagaaaccctgtctcaaaaaaaaacaaaaacaaaaaacaaaaacaaaaaacaaaaagaaagaaggtccagcagttaagagcactgactgctcttccaggggtcctgagttcaattcccagcaaccatatggtggttcacaaccatctgtaatgggatctgattccttcttctggcgtgtgggtatatatacagacagggtactcatataaataaagtacatgaataaataaacctgatttttaaaaagatgtactttttattaagctgcatatagtgatgcatgccttcaatcccatcacttgagaggcagaggcaggcagatctctgagttcaaggccagcctggtctacagagtgagttccaggaacagctagagctacacagagaacccctgtctcaaaaatacttgcgtgtgtgtgtgtgtgtgtgtgtgtgtgtgtgtgtgtgtgtgtgtgtgtgtgtgagtgtgtgcgtgtgtgtatgtatgcatgcacatatgtgtggatccccagagaagtcagaagcaagtgttgaaaccctggagttggagttacagacagttctgagctgcctgatgtaggtgctgggaatcaaacttgggtcctctagaagaaccagtagtgctcttaaccactgagccacctctccaattttagaataatatatattttgttgttgttgttgttgttgttttggtttttgttttgttttgttttttgagataggatttctctataaaccctgtagccctggctgacctggaactcattctgtagaccaagctggcctcgaactcagaaattacatttttaaaggtcttttattttattttattgttgaaaatagtcattataattttacactatacaaccgtattaagaggaaataagatacaatggttaagagttgatccttgggagctggagagatggctcagtggttaagagcattggctgctcttccagaggtcctgggttcaaataccagcacacacatggtggttcacaactgtgtttaactccagttccagagaattccagttgcaacaccttcatacagacatacatgcaggtaaaacaccagtgcacatgaaaataagtactgacacacacacatgagtttggcctctaaaaagaaagttctgaacaggtatgacagtactcctgtaatcccagcattcgtgaaatggagaaggagagagacagatctctgttttagccaagcttagtctacatagcaagtttcaggctacccagggctaggtagctacataatgagatgagacattgtaccaaaaaagaataagaaatgaataaataaactaattaattaaaacaaagcctgggagtagggagatgactctttcagttaaatacttgccatgcaaggacaaagaccaggattcaatccccagctcccacataaagccatgcgtggtgacttgagctcttaagtgtagttctgggggccagccactcactggtaggtctccatagctcccagccagcccagccgaatcaagttacaggtcccactgagagatccagtctcaaaaaagcaaggcacgtggctgaattggtaagatcactggagaacatggcttcgatccccagaacccacatgatgcttcccaacactctctaacgccagtttcaagggctccaaccatgcccctccctcttcagacctctgcaggcaccaggcattctagtgatgcccagacagacacatgggcataaaatacatccatacacataaaataaatgaatccaaaaaggagagaaaaggacagaggcaggtggctcacacctttaatcccagcactagggaggcagaggcaggtgaatttctgagttcgaggccagcctggtctacagagtgagttccaggacagccagggctacacagagaaaccctgtcttgaaaaatccacagagacagacagacagacagacagacagccagccatgtatgtcaactgtgagaagtggggggacaggtcggttacctgtgcagtcttaggtaagaactccatgctgtggatggggaaagctgggagagagacagttccatgctgccaccctcagtggtctgagacttccccaatctcaactcaggtaaaactggatctttgaccttattgtagatggtaaggctggtatgaagcaacagtcggggtcagagttgacttaatggcttgaacgtgtgtgtgtgtgtgtgtgtctagatatgtgtgtgtatatctgggtatgtctctgtgtctgtgtatatctgagtgtgtatatgtgtgtgtctattcatatgtctgtgtgtgtatgtctgggtatgtctctgtgtctgtctgtgtttattcatgagtctgtgtgtgtatgctatataaggctatgtgtgtttgtgtgtctatgtgtctctatgtgtatctgtgtgtgtctatgtgtgtgtgtctaggtatgtctctgtgtgtctctctattcgtgtgtttatgtatgtttgcctgtatgtgtctatgtgtctgtgtgtctgtgtgtatctgtgtgtatgtctgtgtgtgtgtctatgtgtctgtagtgtctgtgttactgcacatgcatatatgggcacatggaaaccagaggctgtcctcagcctatcttcttcttcttcttcttcttcttcttcttcttcttcttcttcttcttcttcttcttcttcttcttcttnnnnnnnnnnnnnnnnnnnntagaggcgtgcaccaccaatgccttggcctcagtgtatcttcttaaaatgctctctacctcacatttttgacacagaatctgcagtgaacatggccatgtcagctactggctggcctacaagccccatgatcctcttgtgtgtaccttcccaatgctagggtgataggagcaggcctttatgcccagcattttctataagtcctggaatctgaatttatgtacttatcttgttcagcaagaaaaattgaaacacatcctggttcctaaacgacatttttaacatacttaagaacagctctggggctggagagatgactcagtggttaagagcaccgactgctcttccaaaggtccgaagttcaaatcccagcaaccacatggtggctcacaaccatccataatgagatctgatgccctcttctggtgcatctgaagacagctacagtgtacttagatataataataaataaatcttaaaaaaaaaaaaaaaaagaacagctctgagccgggcggtggtggcgcacacctttaaccccagcacttgggaggcagaggcaggcagatttctgagttcgaggccagcctggttaacagagtgagttccaggacagccagggctatacagagaaaccctgtcttgaaaaaaaaacaaacaaacaaacaaacaaaaaaacagagagagagagagagagagagagagagagagagagagagagagaacagctctgagccaggaggtggtggtgcacacctttaatcccagcacttaggaggcagaggcagggggaatctctgagttcgaggccagcctggttaacagagtgagttccaggacagccagggctatacagagaaaccctgtcttgaaaaaaaaaacaaacaaacaaacaaacaaaaaaacagagagagagagagagagagagagaacagctctgagccaggaggtggtggtgcacacctttaatcccagcacttaggaggcagaggcagggggaatctctgagttcgaggccagcctggtctacagagcaaattccgggacagctagggcttcactgagaaaccctgtctcaaaaacaaaccgaaacaaataaacaaaaccctataaggaccatcaaagtggctcagcaggtgcttgcctccaaggctaaggacctgaatttgattcctgggacccacagggtgaaaggagagaattgtccttctgcacacaggtgccctgacttgtgtgcttccggaaccacggaataaataaccaaatgtaataaaagatgtagatggaatggtaaatgcattgtgctacaataccagtaaatggcgtcagaatgactgagcagctgctcccgccctgggagctatggtcatttccacacagaagcaaaatgtaaatggagaaggaaatgaaacccagaaaccgcacaaggcaaagctaatgagtttgtggagggcaaaacagcaggattcagggagtctggttgcagccaggagccacaccttccgtcctacccctgtgtaactgtcttggagtgtcctagagtacagacagactgacagcatcatctgtagcaacaggaaggtgatttcaacctctggggctatcaactccggagcagaaaacaactctgtgttcacatagagccaagaaaacaaatgagctgcagccaggaggggcatgacggcaccggctggaatcctagcatttgggaggctaatgaagaaggatcaggtgttcagggccaacctgggcaacatagagagcctcggtctgaaatacacacaagagaatggaatggaccagggtagatgaaatggctcagtggataagagggcttgccaccaagcctgacaacctgagtttgatctccagaagaacccacatggtggatggagagaactaactcccaaaagtttatcctctgaccctgccccccaacacttatactgtggcatatacagacctcccccacacacacaaataaaaatgtaaaagtgaaaatctaaataataacttaaatattttttgtcttctttaccccatattatctgtgacccagggactattagcagtgtctggaaatgttttaaattatcacctgcgaggtattcctagcacagaaggaaacggtaggaactggggactcagttaagcatcctgtagtgcaaggacaatcccttctaccaaggggtcatctgagccaatacacagtgatgtccaggctgaagagctaatagttcaacatggcagctctcacgattgagaaaaaagggatagagggggcggcaagatggctcaatgtgtaaaggtgcttgctgccaagcctgaggacctgagttctgtccttgggacttacaggttgacttcaaggtcccctgtaatgtagcatgtcatagtttgcagttgttccctctgtaagacagacactacttgaaaacaagcactctgacaccagtccccacaccctcgggtcttggcaggtgcccagccaactctgagtgaacagctgaaagcttctcaatttctaactagtcagggagggcagagacaaacaggccatttccaccctcacaggggctggagagatggctcagcagttaagaactgctcttccaaagttcctgagttcaaatcccagcaaccatatgatgactcacaaccatccgtaatgagatctgactctgtctggccctacccccaacatctgaagacagctacagtttagttatttataataataaataaatctttgggccagagcgagcaggggtcctaaattcaactcccagcatctacatgagggcttacaaccatctctatagctacagtgtactcatatacataaaaataaaataaataaatgttttttaaaaactcatctcctcctcctcctcaaggatcatttctttttttgtgtgtgtgtgggtgggggggggtgagacagggtttctctgtgtagccctggctgtcctggcaatcactctgtagaccaggctggccttgaactcagaaatcctcctgcctctgcctcccaagtgctggaattaaaggtgtgtgccaccacgcctggcccggatcatttctaagttggggcttagggtaccctaaatcctccaggaatgagaggagggagaaactgtacgtgcaggctctagaggcccatagtgagccagatttggggagccagcggtgtcctggccttagcaaagcaaagcaaggacattccagacaggagcaaacacccaggcctggtaacaacccaaggaatgtgggaaaggaagagactccacaatgagagtaaatgatggtggggacttgccctgtggcgcctgagagatgcgggttgccatcaccaggcaggccactaatcactccacgctgctcctcacacccaagttaggctgccag

SEQ ID NO: 800 - DNA, 3452 bp, Mus musculus
cggggcgctgaagcgcgagcgggtgtcttgcggcgtcggcgtgcgctccctccccggggagcggctgcaggaggaccgcggcgggagcagcctcgagccgtgcagccggctccggcaccttgccgacgctcgtaggagccgccgcggctgacaggggcggcgggtcgcagcctccacacctgcgcgggtggcgggcgcggggtccggtctgccgcgggcgggcgcagaggagagcgtgcggctgcaggcaggagcccccgctcggccacctcctcgccccgctgctgccgctggaagatgtcgcaggagaggcccacgttctaccggcaggagctgaacaagaccatctgggaggtgcccgaacgataccagaacctgtccccggtgggctcgggcgcctatggctcggtgtgtgctgcttttgatacaaagacggggcatcgtgtggcagttaagaagctgtcgagaccgtttcagtccatcattcacgccaaaaggacctaccgagagttgcgtctgctgaagcacatgaaacacgaaaatgtgattggtctgttggatgtgttcacacccgcaaggtcactggaggaattcaatgacgtgtacctggtgacccatctcatgggggcggacctgaacaacatcgtgaagtgccagaagctgaccgacgaccacgttcagtttctcatctaccagatcctccgagggctgaagtatatacattcggctgacataattcacagggacctaaagcccagcaacctagctgtgaacgaagactgtgagctcaagattctggattttgggctggctcggcacactgatgatgagatgacaggctacgtggctaccaggtggtaccgagccccagagatcatgctgaattggatgcactacaaccagacagtggatatttggtccgtgggctgcatcatggctgagctgttgaccggaagaacgttgtttcctggtacagaccatattgatcagttgaagctcattttaagactcgttggaaccccaggggctgagcttctgaagaaaatctcctcagagtctgcaagaaactacattcagtctctggcccagatgccgaagatgaacttcgcaaatgtatttattggtgccaatcccctggctgtcgacctactggagaagatgctcgttttggactcagataagaggatcacagcagcccaagctcttgcgcatgcctactttgctcagtaccacgaccctgatgatgagcctgttgctgacccttatgaccagtcctttgaaagcagggaccttctcatagatgagtggaagagcctgacctatgatgaagtcatcagctttgtgccaccaccccttgaccaagaagaaatggagtcctgagcacctggtttctgttctgtctatctcacttcactgtgaggggaagaccttctcatgggaactctccaaataccattcaagtgcctcttgttgaaagattccttcatggtggaagggggtgcatgtatgtgttagtgtttgtgtgtgtgtgtgtgtctgtctgttcgtctgtccacctatctttgtggaagtcactgtgatggtagtgactttatgagttgtgaatggtccttggcagtctgcctgctttctcagagtctgggcaggccgatgggaactgtcatctccttagggatgtgtgtgttcagtgcaaagtaagaaatatgaaaatatccctgttcttagttaccttgccactttggcttctcctgtggccctgcctttaccatatcagtgacagagagaggctgcttcaggtctgaggctatccctcagccatgcataaagtccaagagaaccaactggctcctggtctctagcctgtgaccggcttgcttaatgtcctcagaacctgacaggtatgttcaaaactgtcagtctgtttgtgccttaaaagggtgagaagggcgcgtagatagttacagagtctcagctgctgacgttctgagccaggcaagtgcacggggctgttggatggccagtggggagctggaaaaaacaaggcagcctttaggaaggccatggtgcatgtgtgtgcatgcgtgtatgtgcagccgccctccctcacttcaggagcaagctgtttgctgtgcttacccttcacctcagtgcagaggtctccagtgccgagcacaggcacctgccatcagtagttcctgtgtcatcttcacatctagcagagcacggatgtgtttgcatgctgtgctcttggagcttgtcctgtcttctggaagccctggacaaggcgtgtgaaggcttcccagaagttcctgtccacattgcctccgcccaccgacgccatgggcacactgctccctcctcctcctccagctactttgtgttgaacacaattgattctccaggtgctcatggtgcaggaaaacaggacagacagagagcacctgaacccttgccatctgatgtcaccaattcaggaaaacgagtcctctcctaggactatccccggttctggaaatcatgttctcctcactcatggtgacaagctaagaaagctgaacaaagggagagacgagagcgcctgaagccaggagctcctttactatctttctcaaaagggttgttagacacaaaccaagtcatcaaggccccgctcctctcctcggaagggtcccccaccccccggcagcttgacactgaatccagtgtcaatttggggagaaagcagttttgtcttggaattttgtatgttgtaggaatccttagagagtgtggttccttctgatggggagaaagggcaaattattttaatattttgtattttcacctttataaacatgaatcctcaggggtgaagaactgtttgcataattttctgaattttgagcactttgtgctatataaggacccatatttaagctttgtgtgcagtaagaaagtgtaaagccaattccagtgttggacgtgacaggtcttgtgtttaggtcaaggtgtctcctctcagtgcagggacatgcctgctctgtggggcaggcgaggaccctgaatcatttggagcccagaaggaggcagactggccaggtctcaccacctcagtgtgcagttcaactccatgccatcccatcaagatgggttagtagcagtgtctgtttttgaatgccaagtgtgatttccaacaattctgctctggttatttcattgaagacatctttgcacatgtgaccatgctgtgttaggggctgtgttccagggactggactcgaagctagaactggcagaagagttctggcatccacagcgcaatgctgccaccacccagtttcttcatcagaagacaagggaacgagaaaactgctgttcgtttgtatttgtgaacttggctgtaatctggtatgccataggatgtcagataataccactggttaaaataaagcctagttttcaaattcagttgg

SEQ ID NO: 801 - protein, 414 aa, Mus musculus
EPPRLTGAAGRSLHTCAGGGRGVRSAAGGRRGERAAAGRSPRSATSSPRCCRWKMSQERPTFYRQELNKTIWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLAQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 802 - DNA, 30558 bp, Homo sapiens
acatactgctagacaaagaataataaacacctctgttcatactgtcctgcttgtgagttaaaacactggcaatagagctaaagcttctggagacccttctctcacatctgcccatcactttcagtcattggtttcaaatactctttctttttttttttgagatggagtctcactctgttgcctaggctggaatgcagtggcgcaatctcggctcactgcaacctccacctcctgaggctggtctagaactccagacctcaagtgatctgcccgccttggcctaccaaaatgttgggattacaggtgtggccactgcaccctgccaaatattctccctctctctctttttttttttttttggagacagagtctcgctctgtcgcccaggctggagtgcaatggcgcaatctctgctcactgcaacctccacctcccgtgttcaagcgattctccctgcctcagcctcccgagtagctgggattacaggtgcacgtcatcacgcccggctaatttttgtatttttagtagagacaggattttgccatgttggccagcctggatgttctctcatttttaaaaagcagtttcactttagacaccaaaagcaagtgtccaataaatgctgaagaagaaaaatattttattaggttatttgccctttcctctctaacttgaaaatacattttctcaggaaaaggtagaatcctcagatttgtccataaaccaagggtcccttaagaaattttctttgtgttacagtgaaaatgactattttgacaacttggaagataaggagctaggctaagtcttattctagtctatcctgtctgtcaccaggaagatttcctaccttcccaaaggttagtgctccacttcacccctatgtggatttatgtctttgaaaattactgctcatggcaggtaggtcctgcaattggtccttttatttatcttcaactttctggcctgtggaggttttttaggagtgcctggagcacttagaactgactagaatatccctcttttactttccctagaaatatcctgttatgcttagtttttttgtttttttttttctttacctgttcattctgactgacttgcttctgttaaagatgacttcgtctaaagagtaatcttaggcttaagttgttcttttcttcatttgttttagaaagattcaggagatttatgatttaaattttgacgttgtgatcattacaattaaaacacattttaaactaatagtaaaaatattttctacctaagagaaacagggctaaacctattacaaaggatggctcactgtggaaataactgattgtcatgatgtggtgagttttgctttactccgctaatgtggctacgtgacgctccttctggtcttaactgcctggacaaatcatagtggccttatagtagctggtactgttggaagactggcctgtatttcagtggatttgccagcttttgaagaacccatggtgatttcttctgaggtttgcatgttttaacttccttcatgcaaatgcttttagttactaagatttttattttatgttgtgtgtttttccatggagtatggtcattctgtgttttgagggcaaggcagtggggtaaagctgagttgaaaagcataatatggctcatcttttcttttcttttttttttttttttcattttttgctgcttttattttacgaaaaagctaattcaaatctacattaaactaagttgaatacaaagcctttgtgaagaaggcctggtagtctcatttacaaaaatggccagtgtcgtctttggccttaaaatttcaggacgggcacttcagatggcttcacatttgcatgtttcagtgctagagcatgggaatagactttggcatccactgtaagatgtttttcagctacgagagcatcgagtccctgcagcaggtcattcttgggtaacgaaatgacttccacaaattctccatcccctggctttggcttgggccttacattttctgcgtcatctccgttaatgattactgtcacgatgtgtgtggtacagtttgacaaacctgggtccatatagaccactggagaacattcagcagcgtcccctttgtagccagtttcttcctcaagctcccaaagagcagctgctcctggggtttcaccatcttctatgagttccctgcagggaactctatgcagtagccacccattggtggtcaggactgtttcaccagaacgatacactcgtagtgaagcgttctctgcagcacagggatgaccgctacatcatcaccagtctgttctttcctggttgtatgtttcactgagtcccaagttccagttttaccaataggagccatgtatgttgttttttcaagtttgacccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctattgaaaaaaatccaagaagacttcatggcagagttcttgtttgaataggacttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcaggcctgatattgtttcatgccagcagaggtgggagagagagggtttctcagctcattgatgtaatgagccactgtgactaatggaaattgcgtattcttcaggtaggttggggtgaagttcaggtagttgagaaattcacagctcagagagcctgtcttccttagagagagtataaaaattgactctcagccaggcacggtggctcacgcctgtaatcccagccctttgggaggccgaggcaggcggatcatgaggacaggagattgagaccattctggctaacatggtgaaaccccgtctctactaaaaatacaaaaaattagccgggtgtggtggcaggcgcctgtagtcccagctactctggaggctgaggcaggagaatggcgtgaacctgggaggtggaacttgcagtgagccgagatcgcgccactgcaccccagcctgggcgacagagcgagagactccgtctcaaaaaaaaaaaaaaaaaaaaaacaactgactctcattgttaagtagtcagaaagaagtctcttaaacaagagtaccaatatcaaaagcttcattttagagattacttttgatgcatatattgtaaagccacttgtttgagatttgaagtagtcaagatttttcccatatatgatttactttatcttgtggtggctacccagttaaatatattcctgaagagtgttaatgtgaggaaactaaattttttgaattgagtcattttagatgagcaagaattttttttactgatttctattgtaatataattaatctgattattttagagcaagacagtatccatcccacccccattcctactctgtcccatgaacatatgctataagattttttacttgtcaacatcttgaactgagaagccagtattaaaatcttaacctttataacacaatgatttttgccatttgcagatgacaaaattccctgttattcttaatttagaaataatgtgagtggacttgtttctagtttgtttttgcttgctaaagaacacaagttgtttgggtttagggtggggtttggcgcaccttttctgaaagggccaggtagttaatattttaggcttgggaaccatatggtaactgtgcttgttgtaattggaaacacctatagactgtacataaatgaatgggcatggctgtgttctaataaaactttatatataaaacaggcagagcctggggtttggtgactccagcctagaattttcttccatttaagctgatttcatgtctgaaagaaagtaaaagacaggatgtcaaattactgcattaagttattcctataacgtaggcacctgtggcttatagagactgttgtttttaagtgctgctatgttgcctttatatgtataaccataagcaaaaatttctttcatcctgctctaccttttcctcaaatattttgactacctgtcatgtaccagatgttaggctggggataaatggtgaagaggcagagtggcccctgtcctcgtagagctgtagaccagtacagggggcagacagtaagcaaataaagtaattctaggctgtgataagcactatgatgttatcaagcatggtgctgagagagaattggggggtggggtgttatgtatatagagtgttgaggggaggcctcccttaggaggtgaagttgaagctgagacctgaagccaagaggatttagtcatgtgaaaaacctgatgggtcagaagacagtcatcctccccttctccctccctggaatgtcagtcagtataaacgtggataaactgttcacattttcagaggaaatattaaaagctattttataatatttttccccctctttttaacttcctttttaggtaagattaaaagcaatgagaacaaacaaatttttgtcttctggttaacacatgcacatacattctgagtatacattgaagtgttagctaccaggataaaagttatggcattgtggcctattatttagagcctttgggatgtgtgaagtttgttaagcattgttcatttgcattttataaggttgaaaccgcctgtatttgcgttctcatggcgctcctaaaggaacatgcggtgggagagcgccctctgctggcgactctccctcatagtgcctgctatagccagtgtgagaggcgaggcttccctttccagagggtgtgctccagtggtcaggctttggggtctcacaggccttccactgtcatatcacaagctctttaggtcacgcttgggagaatattcataaatagacttgtacatccctagctcctgtcttctgctgcttttttccttatctgtggccctctaattatcagtgcactttgctgaactggttactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttggctaggtttggggtgtttcatttttgttctcggtgtgttctgtttgtttgtttttgttttgtttgtcattgtttgtttttcatttttattttgtcccaacattttcctttatggtccaccattagatattgatcagttgaagctcattttaagactcgttggaaccccaggggctgagcttttgaagaaaatctcctcagagtctgtgagttgatgctttgtaattatctgccctgttgggagcctctgccacttgccttctaccaatctgtactttgacctgggtgtgtttgtaagcacacatgccctttgtgtgctgacttcccggatgagtgaggtataagacagtgtgagtgtgtgtgtgcgtgcacgcatgtgtgcctgcttgcatgcacaaatgtgttttattctctatctgggtacacactaagatcacgggagcctccattagacaatagtatcccagtaaagcaatgagatttgagattctaattcattccaagagattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttctacccagtccctagaccccactcagaagaaacagcttcactcctgatacctcagatacacaggaatgtggttataaattttcctcctattgccttgtaattataagttagataacctgagacagagtttggaactagtgctttcttgcttctaagcagggacttagacagaagccatgggaatgtgagtctggcttacttttgctatgatttcctgctcttggtcattttcttgggccagaggcatgagagaagccatgaaagcccagcttttctttttccctcgatctgctgccaggcagttgaacaaaagaaaaaaagagctatggagccaagctccagttatgccttcctggattctcctcccaacatttatgactgaaggggccctttgcctagttgggaagatggctgggtagcttgaggcaagcataagcaggtgagttggaaccgttcatcatcttcctgacaaaataaagaataccgtcatctggtatgtatccggtacatttcttgaaaggatcccaaagcccagtgtatttctgaacctccactctgaatttgtttcatttacttatttaagataaagaagcaaaagcccagaagggcagtgacttttccatgtcatgcactgaatcacgtggcagagctgagtatagatcccagatgttctgataacatgatccaaactataatcccatgtgattacacactattttgaaagtcattgtcagtgttaccacaatgtcaacctaaagaggtatttttttcccctttatgatatgtagaagctgaattagagtgaatcaaagatatcagatgatgcttagaaagagcagtactttttttttaatgtttttgcttagaaacactgtcttacagtaagaggacctaagggcagagggaggagctcaattaataaatagtgctaatgagaccaagcaaattcatttccttcctgagagtgtctcctagcagccctttcttagtcttctcttccatcccaaccatctgccctatagatacgtgctattagtcatttggaattggattaggaattcaaaccaaagtctaggtaaaatagtcaatagtatttatctgtcattaatccatcacttatttttaagaaagaaacaatgagtgcacagcctaataatggaggtctctctgtgaaatgaggcacattatacatttcaacagctctactgaaattgagtaccagaatacagaacttaactcaaataatattatattgagtataagaataagaaaggttttttttttttggtttgtttcctacataattggggtgagtggataaaagtagtttaaacatcctaaggggtagacaagattaatttgatgttcgtgacacggcccaagtacctgtttatcttaaaagcgcatgatgtatgggaacagaatggaaaaataaggccaggtgagtaaaattgttcagagattttaaaaattaaaaaaagaaaaaagacattagtgaaggagtgcagtaaatagccaacagctgttttcattctcctgaaaagtagtgaagtagtgatggcaataattatgaagaaattgaatgccgagtaagagaatgcagtaatggatttagaacctattagaatgagccataggaaaaggtataaatgggttgtgatggaggccaaggacagagaattcatttggttaatgtcccagtatctataataatcagtgaaagaacaagaaaatcatattaagaaagcaaaagcagactgggcacagtggctcacatttgtcatcacagcactttgggaggctgaggcaggaggatcactcgaggccaggagtttgaggctgcagggagtggtgatcatgcactgcactccagcctgggcaacagagcaagaccttgtctttaaaaataaataaactaattaattaaattagataaaaaagcgaagacctgactcattcacattttcctccagaaatagaatctttctaacttcttgacagaaaggggatataataacctctttgactaaaggagacaaagacagaaaatgtgcaggccaggtatcattcacagaaagaaaggggaagtggaggatttttacattttaagacccaactggtattctgctattgctggtttactttgtggcccctttttgttatttcccttggcatgaaaagtatcatttgttatgtgatttgttaaaggtaactctaaattctgttatctgtactcctaacaaaataaagaattccatcatctggtatggatctgttaacgtttcttaaaaggaccgcaaatcaaagtgtatttcctatccccttttggaatttactggcctctgtctttgggcttagggagcgtaaaaggcagcgtggagcacatggctctagctccctccctgtggccagccttaaacagattactgctaagtcatctgaccactagggagttcagttcagaggacgagctaaagtagaaaaattatttgggaaagccatgaagtaaaattgcttggccatggtgcttattaaagatgacacttcacctgaatgagggaattagtagttaacaagaacaggactagaaaaggggtttattgaattacattgaatatttttaaaatctcatcacttctgctcttagtaggaacatgataaacagttctgacattttagaagagggtgagttgtattaacattgatggaacagttaaaagagagaagttgtagtacagcttacatatgtgcctatacatatagaaaatctcatagttctgcccttatcagatgcttgcagagtattctgcagacttccctccagctgtttgttaaatgaggttagtctgttcgctagttgaagagacttgtggaggaaatcatgtggcatgctttaacactctcagcagcctgtgacttctgttttgcctttgccattagcctctaaccttctcctcttctcctctttcttcatttaccattttgtgtttgtggcaagtattttaaatgtaccactaactaatgtctttgaaatgtggcattgcttattaacccagatgcccacgtgtgtcttaattcggagggatggtgccttggagaacctgtgccgcaaaagtttagtctcttccttgaatggatatgttggatattttattttgttcaaagttgagtcaaaatttttggaatcatctatatttctcccacaaacaggttttggccatcagtacttgaaaacagttctatggctggcatcctggatcaaggggcagtctgtttccagggaacctaaaatatttaacagtaaagatgatgctaaaaccaaagaaaagtaatttttcttatctgcatggccagtcactggctacgtgcctagttactcatgtcattcacagaagtgtactgtagcatgcagctgtgggctctcgggtagggggaatggagggtaggtttttttgtctgtttgggggtggctttttgacctttttaaaaacttgagttgaaaattattttttgcactgtatgtttaacaatgcccttgactaggcatctaagatattaaccagcttcagcagattatgcgtctgacaggaacaccccccgcttatctcattaacaggatgccaagccatgaggtgagaacaaagagactgtacagggatgtcgcactgagaagccacattctcattttattgccaccgtataaccaacagttcttaacatcactggatgcttgcatgtgccttgaggcctgcctatgtgctattgcaagatgttgacttttgggataaaatgtcatccagtcctgtgagattgggaatataattagtaagcttgtaaatggaaaattgttatttttatatttggttgtgtgaatttagtgcttgtgaggcggtttctttctaggtgctctgcctgtagctagggtgtgctactatcgtgacctttatcagaagggtagttaactgaagtccattagcatgctttccaattcatccatttttttaatgaccaaaagaggattctttatttaaaaacaaaactgaaatatccaatactaatatgtactatatttaaaagaaaatacacaaataatatagaataaatacaaacactttggtacagttaggtaccttctttattaattattaactacttagtctaactcttgttttattatcagagatgattggggcacttctttctttgtaagatacccttaatattttggggaaccaggttggcatcacagagggcccttcccagcagctttgtttctacttcagctatattcaggtcgtcttttgatttatctttattaaagggatgactgttctctgaatgagatagttctctcttacctgttttcccttcctctttttatttacatgttcaagtagaaagggattacagccatttatgtattcaattcctaaaactttcttttcaaatcagaaagattctcaattgcttttcaaagcagacctttcctcctgactccacatgcaataattaagaagcggaaggctgggtgtggtggcgtgcacctgcaacctcagcactttggaaggctgagatgggaggatcagttgagcccaggagtttgagaccatcctgggcaacacagcaatactgcagctctacaaaaaaatttaaaaattagggcatgatagcacatgcctgtagtcccagctacttgggaagctgaggcaggagggttgcttgagtcaggagttagaggccatagtgagctgtgattgtgccagtgacctccagcctaggcaacagagcagagactgtgtctctaaaaaaatttttttaataaataaagaaggtgaacttgcccaagcaaccagatttttttttttttaagacaggatcttaactctgtcaccccagctggagtgcagtggcacgatcttagctcactggaacctccacctcctgggctcaagcttcctgggctccatctccctgctcaagcgatcctgttacctcagtctcccaagtagctgggaccacaggcatgcgtcaccacacctggctaattttttgtatttttggagacaagttttcaccgtgttacccaggctggtctcaaagtcctgggctcaagcgatctgcccaccttggcctcccaaagtgctgggattacaggcgtgagtcaccgtgcctgggcaaccagaactttttataaacttgtgtgtgtatgtgtaaacataaatatacatacatacttttactgttggactgtattaaaacaggagttttaaagaggtggttaagatagacagcagactttgcttctgaaggtgatagtgggatagcagataatgtttcttgaactgtcacttggaaccaagtactgtgttaagaaagtactaggtttgttatctctaatcttcactccaaccctgtgaggtaggactgttatattaagtttatattaacttttttgttaccaccgttactttgttagcaaggtttaatattgatatcctttgatgtactaagagcacctactgaagtcagcactgtcaaaagactgctggtccaagactttctttgggaataccaacccctctaccaatttagctgtttgagaaggctgtctcagggctacttcttacatatcttggcctcagtttttaaacttctcatcctgtgatcagaaagctaatgaaagagaatttgattgatgagcattctcgttcacttgaaatgcaactgtgagagatagcaggaataaagaaggtgatgatcataactagggaagttaggatggcagtaagggagaagttctatcaaagacagttagaaacactgaagttagtggactttgtcagttaacactcgttccttagcaggaccaagattctttctttgagagcagtaacattattgaacaaagtcattctgaaaacccttgttttttcaggcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttgaatcttggaaggtgataaatacggcttttattatctatttgtgttgtcagatttttttttaatcacatgagatgattgtatgtttaaatgatcacagaacttgggattgggggaatgggcaggtacagtggagaaatgagagaaagtaatgggaatgttgagagaaaagattggtgaggcaggaagaagcagatacagaagaaagctgtaacttgctcacaactgctgtggatttatggtgtctctgagtggaggacagaaaccactgaagtgcaggtgggtgtttagaggagccacccaggagctccctgcagggtgctctgctctaacggtagctgccgttgctacagatcctgtcgtcttccacactcatgaacttttcccctctcctcttctttctctgccctcagaggcataaccatcctctcctgtttgtggagcttatttgctacctaaacttaaaggaatggcttcctatgccttcaagatccttggcagagggaagtgatggtggcagctgaagatatgtgttgccttggctaaaaaaggagttgctttattattattatttatttatttatttatttatttatttattttggtagtgtcagggtctcgctcttttacccaggctagagtacagtggcacaatcatagctcactgcaagcttgaactcctgggctccagtgatcctcctgcctcagccttccaaatagctaggactacaggcatgcatccccaagcctggctaattttttaaagaattctttgtagagacagggtctcaccatcttactaatcgtggactcctggactcatgcagtctgcccacttcaacttccaaaagtgctgggattcagacgtgagacactgtgcctggcggactatattctttgaaggggaggagtgatgtgtgcttcagatggcccctgaaagctgctttgcctgaggctcattccctgactcttgaagaggacagtggacagtgctgtttaatggtggacacagaaggatcagaccaggacctccctacaatagggaagggagctatgctatggtaacgagtataatctgccttctcacttttcttaagattgtattgtgtggtgtgttttaaaatctcactgcatttctttgcatctgtttgggtcatctgtcttcttaagggtcttggcagctatgcttcaggtttagttttatctttttgagggctgacagccatgctgacctctttagaagctggggtgaaggctaggtgattttacctttttaagtacttcatccatagtgattatggagaggaattttagtgtcgctgtgataattcttataatagcagagatactcacgctctttgaagttttgggcagttgtggatgagttcgtgtcagccttggagacagagagtatgtcatatctcagctgggtcgctctcctgccctaggatgaatccacagtctcatcaggggtgggtacgattctactgagactggcttaggtttgcatctgccctggcatgctctcattggctttgtgtgatttatttgagctgtattatctagttcaagggtctgtgagaagctctctttgagccttaagtactacaggatgttgggaaaagatgttgtgttctttctttccttttttttttgagacagagtctcgctctgtcgtccaggttggagtgcagtggtgcgatctcggctcattgcaagctccacctcccggctttaagtgattcttctgcctcagcctcctgagtagctgggaatacaagtgtgtgccaccacacctggctaattttttgtatctttagtaaagacggggtttcaccgtgttagccaggatggtctcgatctcctgacctcgtgacctgcccgcctcggcctcccaaagtgctgggattacaggcatgagccactgcacccagcccgtcgtgttctttcttgtcgtcattctgttctgaagttgtttcattttataagccttaagttttgaacagggcagtactcactgacaccctcttaacagactcagaaagatgtgttaattcattttttagggggagaggggagatatttgtgttccagcagcttatttaggtcacatacctcctgataggtcttcccattctttgaaatcatgacattgaaacctccaaaagaactagataccactttgctaatgagttgaaaggaggctttggtccatctggtgctcagcactgtacttctcagcatttaaacgtgccttacagcccattgccaaacagtgatgtcatataatgaggctccccttgctgggcagatggagcacagtgttactatcacaagctcgtgcccagcatattaactgagcaggaacatgccagaaatataaatattaacagctctgttttgtcagccactgactttgtttcactgctattcccaaaacatgaattaaaacttaaattaccccttgatgttagtgtatgtatttatctgtcaagattttttttttttaagagatggcatctcactctgtcacccaggttagagtacagtggcacagtcacggttcatgataacctcgaactcttgtgtttaagtgatccttcctcttccctatcccaagtagctgagacaacaggcacataatgccatgcccagctaataagatctttgaggaaatttgttcttgcccctgaccttattggttataagaacatggtcctttttaccctaagggtaacagagacttgtcgtataatctgtgttcaattataaaatcaacagctgataaggtttctttttctaagaagagaagaccatcagaagaatatatatatatataatccaggcattcacctagtactgtaaagtgtaaacttatgaacttgaattgacacatgaatatttactttgtttctgtatccccttgaagcccatatttctccagtggattactctggaattcaagctgtaggacgggtgttttacagcctccaatatacacagcagtagatctctataggaagctgtcctcttcactactcacccccacaccctccacatttaaggagtaatttgcaaagtctcaaaagcctttttcaccacagtgataactggttatatggcagtatttattctcccaagtgccaccatgctgaaacacaaaaatactcatttgaaatatagagttagacaaattaccattttgtaaccccttatgaaataattgcttttgggaaggaaacccagtgaatgcagaaagccataagtgaaaagaatggatatttacttggtaccaaaatatcccgcagattacttgctttggtcaaaggggaaacatcttaacccagtgatcaattttagctcattagtagtgggacagatggccttaatgcactgtcacgtgcacagcatcacctgtatttttgctgaaaatgtttaacctgattcttaccaaaatttttgacctaacttccggtttttgggaagtacaggggatagtggaaagcagggtatagacacatgacagcaaaagaagcaaaatcagacacatcccgagaaacggtcattctcaggacaatcagagggtctctttagatcaaaatcaggaaagaacagggcttagactaagagagactaaagaaaaccagtcagttgcagtgcatggcccctaattgaatcctggtttcaacaaactagttctaaaagacaacgttggaataattggagaaatcttaacatgaactggattttagatgatatttagaaattatttgtcagagataataacagtattatgattatataggaagatgtcttcgtgttgaaatatttggggagggtaaagtgtcatgtctataattttattttaaaacagttcagaaaaaaatacatataaatacagaaatataaaaatgttaattgttgaatatgctaggcatatgagtgttcactttatcatagtttttacttttctgtttctgtatatttgaaatttttcatagtgaaatttttaaaaataaaattccctttgattttaataccatgtctcaccctcatcaccatgtaaaacccccagtttattcactgtttgaagatctgttgatgaatatttgatgttagtaaataaacagcttagggggacaaaaaaaaaacagccctgcctacctattgtaggttacttcagctgtaggctttgttttatacagtttgactacactggtagcagtttgacattgacggtccacaaaagcctgttcaaacagaatcccagtcatttaaaaaaattcttctttagtaacatattctttaaaaatacaaaatacaggaggagggtgagggttgagagataacctatcgggtacaatgttcactatttggttaatgggcacgctagaagcccagtccccatcagtccgtggtgagacccatgtaacaaatgtgcacatgtacccccaaatcaaaaataaaataaaaaaattttaaaacatagaaaatacagatacacacacacacacacacacatacacacataaaggagaagagggctaatatatcctagagtaggtattttggaggagagttctttgtttggatatgaagggtcaaaactatgtttgctcaataaggcatacttttttgtaacatgttaaaaactcttttccttcctgtctctggtactgatagctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagtaagtcctaagggtaggattaacatcttgaaccactaaccaaaagcggtgggaaaaataaaaactgaatggtcataaccaacttgctaaagcttgtagatgaggtctctaatgcagaatgaatatgttctctggtggaaactgttgtagacagtgatactctctggacctttgagatacttatgtctggtctgattttatgcacagcccctcacataggagttttgcatggagagttgaggttttcagagtcattgcatttacaacatctctctgagcttttacagttttacaattagtagaactggggcaaagagaatttatgtcttatcagttaacttagaactagttagggacatagccaggaatggaacccatgtatcctgtgtccagtcccatattctttccacaaaacacaagttcagaactctagttaaatcccaagagccaagaccatctgttgctgtagcttgtgagagtgctctttcattcttgagcacctccatagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaaatggttgggaaagaaaaaaaaaagaagtagtagattttgtagcatgtgatgtaagtaatgtaaaacttaaattccagtatccataaataaagttttatgagaacagagccgcactcatctgtttatgtattgtctgtggctgcttttgtgctacagtgacagaggcaaatagttgcagcagagactataggacctccaaaatgtcaaccatttaccatctggccctttagagaagtctgctgacccttggcccagggctacagttttctcatctataaagtgaagttcaggtttttttcatctttgacatttgagactatctataagccatatatttttattataaaactgccagagagaaggtttggtttgtatatataggtgtacattgtttgtaagcttttaggcgaatgtattttatgactctgttttgtcttagctggctacggtccttgaaaatattcttcagaatgactgaattgcatcacgggatgaaagagccacggggtctcacagctgagttctcagggactttgctgatgtgcttcctttcttggtgtccttggaatgacacccagcaggtgtcccagggtggattgtggggctcagcctgtgaggatattgagagctgggtttttgtccaggccctggctggcagctgggaatgaaggcagtgatcgaaggcagaccaagcatagtctcctttccatccccagtgacttcgtaaggaggtgagagaaaagggccccggttgttacatggggtcctttagctcctgttaagaatcagacagttggccgggcgtggtggctcacgcctgtaatctcagcactttgggaggctgaggcgggcagatcacgaggtcaggagatcgagaccatcctggctaacacggtgaaaccccgtctctactaaaaatacaaaaaattagctgggcgtggtggtgcatgcctgtaatcccagctattcaggaggctgaggcgggagaatggtatgaaccagggaggcggaacttgcagtgagccaagatcatgccactgcactccagcctgggtgacagagtgagactccgtctcaaaaaaaaaaaaagaatcagaccgttgtagggagtattttgccttcacataccagacatgagacatgagagcagccttcctcctaggcttctgagaagagggcctgcttagcccaaagagagctgacaccacaaaaagctcccctgaagtgaatccacttaaaacggggaccaaaatttcatatgtggtggacactgggggataggggaaacctgaatggaactttaatcatgaaaatggaacaaaatgacaaaagcatgttcataattttaaagatatattaattctgacaaggaaattaagttgtttttgaagtgaaactgattttgtatcttacaataattttctcatttgatttttgcaacgtgatcatagaaggaagttttgcaaaaatatttgagggcttcatcagttttcagaaggcctcttgatattttgatattcacattcttttttataagtatctatcggtgatcacctcctcaactttccttttattgttaactggtctgagtctgtcacccacacttttcagagcttttgcttaaggtttgagcagttttctagcattatttatcaacttcatcaaatccaccaccatttgcaagatttgtgattattgcaattaagttgcattctatttgtgtcatttgtcatatgcttacagtataaccatagagactaacagaagaccagaatacagtgggcaggataaatacattggcttcaggtacttaagaagcaaagagggactaactttttataaatagctcattagtgaatgttttcacattgggatgactttcacttctctatataatttggtagctgcaaggacttggttaatgaatatgcaaataataaagacccccttttatttataatgcagatatgttttaataatgtacatgccctttgaacttagcatttacacttctcagaagtcttcagcctgagcaacatagctggggactcttgactctacattagccaggtgtggtggtgcatgccttgtagtcccagctgcttgggaggctgaggtgggaggatctcttgagcccaggagttcaaggctgcagtgagtcatggttgtgccactgcattccagcctgggtgacatagtgagaccctgtctcataaaaaaaaaaaaaaaaaaaaaaaaaggtcttaagtgcacaaagtagaatgtttttcagtgtcacattctttgtacagcaaaatactggaagtaacccacatatctatgaataaggacttgattgaataagatggtcatctgtgcagtggaataccatccagctaggcatggatagatgtgcaacatacattgtgaaggagaaaaagtcagtggcaaactgtagtatcctagcccccttttttgttgataggtaatgcctggctaggaaatgaatatacattgaactgttagcaaccatctctaggcagtgggattgtgccctttaatttttatgctatttctgtaatgtgtacctttttttacactgagagttttgttttgtgatcagaagaaaccttttctttctttgttttgttttttaatgagaaaggtgtttaaaagtctatgtgacctggggaaccattctcaaatttcagttttgccagggctagagcccagcctttcaaggcaggagaacagttgctggaaagaaattgcacccagctgttaggcctctggcaagcaaagccgcaccagtactttgtagcggcattctccacccagctgggagggtttggttgtttcttcttcagtagaagggtgtattttaaggatcttaagcaggatttttcaattttggcactattggcatctcagaccagataattatttgttgtggaagctgtcctgtgcagtgtagggtgttaggcagcatccctggcctctacccactaatgccagtagcactcatgctcccttcccccagttgggatagccagagatgtctccagatgttgttgccaaatggcttctggggaacaaaatcatccctggttgaaaaccatgaatctaacacttcatccctcctaatcttgcagaacaccaaagcctcttttcttgaaaaaagagttaacacccactggcctgttgtaacttaaagaagtagtttggtggccgggcacggtggctcatgcctgtaatcccagcactttgggaggccgaggtgggcggatcacctgaggtcaggagttcaaaaccagcctggccaacatggcaaaaccctgtctctactaaaaatacaaaaaattagccgggcttggtggtgggcacctgtaatcccagctacttgggaggctgaggcaggagaatcgcttgaacctgggaggcggaggttgcagtgagccaagatgacaccgcagcactccagcctgggcaacaagagtggaactctgtttaaaaaaaaaaaaaaaaagtagcttggcatcttggaggaaaagtacaaattggaaaggcctttttagactcaaatacatatttttaggggaaatatgtttggtactgaataaaggtcatttcatttcttaaaaaaaaacagtaggttgagtaaattaagttatcctttgttcagaagttctttgccattatccacaggcagaaaatctggtaattaaactgggggtatgactacaagattttcttagaccagtaaggaaataacaaatctcaatgtgcctggtgtgttatcgacactcaagatactggttagtctgcatctcacgagttgacagggggcatcgaggctgtcttgttagggggagtttgcagccttctgcatctgggaacagtgtgtgtctctaaagccaactggggagagagcttctgaggacaaatggtcctgaggcagtttctggaaaacccattattgaagccataggctgtggtctaagtacgcatagccagtgggataatgttatattgcagagttatttgagtagttcaatttaaggaaggtgctttgtttagaagttattataagttaaataaggaagtaaccttcagtttgcaactaaaaatagaaactgtgccaccaccatttgagtgtcagttgcagcagaaaagaagaaggtgtaaaaccacagacccagcctagattcttaacaaaaaccagtggttctaaactcttgtcagatctattaccctttgcataactaatattttataatacctcttttataatgctgaggtgaaattcatagataattcacacaatttcaaagaaaatataatgatccaatataaatgacaaaggaaaaatacgaatacatttccatatataagtgctggctgggcatggtggctcgcacctgtaatcccggcactttgggaggctgaggcgggcagaacacttgaggtcaggagtttaggatgagcctggccaacatggagaaacccgtctctacagaaaatttttaaaacgttaactggggcggggcgcagtggcttacacctgtaatcacagcactttgggaggctgaggcaagtggatcactcgccatcctggccaacatggtgaaaccccatctctactaaaaatacgaaattagtacaagatagaaaaattagtcagctgtggtggcacccacctgggtcccagctactcaggaggctgaggcgggaaaattgcttgaacctgggaggtggatcttgcagtaagctgagatcatgccactgcactccagcctgggcaacagagggagactccgtctcaaaaaaaaaaaaaaaaatgaaaaaataaaaagttatctgggcatggtggcacacacctgtagtcccagctactgaggaggctgaggcaggaagattgcttaagccatggaggttgaggctgcagtgagccatgatcattccactgcactccagcctgggtgacagagtgagaccctgtctaaaaaaaaataaaaagtaaattctcaggcatagctacataaaagaaataatgaagtagttagatgcttgtacctatacatagaatcaccttgaatatgacagctccaaatgcgtactgatacagttgtgttgtcttgacaactcagataccatggctgactgctgtcagtcatgatttttctgaaagtggtaagcaactcttggtaaaaatttcaaacaaacaattagaatctttttttttttttggacagggtctcagtctgttgcccagcctggagaacttttttatttactcagttgtgatcctgggaaatgtaagtatattaatatgcagaaaagtatttgtttgatatgtaaaaccaagttacagtctaggctcagataatcataaatagttttttccaccttcatgaatgtccagcaggatgtttgtaatgtgaagcaattcttgttaagaatcccactctgcacagtggcccgtgcatgctcatatcagtaatactcctgatcagtatgataaccaaaaatggccccagagatttcagtgcacccgctgagaactgctgacagatcaaatgactctgggacacctggagtcctaagaagtgaaacctccacaatgcaggacagacctggctccctatggtcttccttccttccttcacctccttccccctactttccttacctccctactaaaaagtagttcttttaatgaactgctactgtatgttaggcaatttacattcttgcatattctatacaagtaatgtctctttctcagtcacgttacaactgaggctagattcaacagactatcctgatatcaacgttgaaagactcctggttccaaagagttttatagcattggtgttagacaatcctcttttggtttttttaaagaaaatttaaaaaaattaattcagcataatttccataaggactccctggctgctgctggccaaattggggaggagtccctggcagccacagccaggcactggtgccttatcttgttcagcacacactgggtctctctccctagttccaggccccttgccctcgcttctctactcatctgggatagaaatgcacctccaggcctctgaagagaaactaccttttccctctttcagccaaaagggctcaagccagcactcgctttgtatgtcctagaagatgagcatgcttccctctggctctctatagcagtgctctaatgggacaaagtcactgtgtgctcttgctttctctcctggtctttgtgcgtgatagtccctctctctagaaccctcttcctcctcctcattcctctgagctaatgtattcgttcttctgttcagccttgacatcactccctcagtaaatttctgaccattcccaagcctggattagctgtgtcttctgcatgcaccctgtaatctggaatgatcattggtggcactgattacactgctttatcattgcttgctgtttgtaccacctgctcaaaaaagaaaaacatataaaggttaaggatacaggctctggaacctttgatgtgattaagtaatttgctcaagattgtaccaataatagagagtggggctgtgaggactaaatgagttaagacatgaaaaaccctgagtatacagtaaatgctaaatactggcttaaggctgcatgtcatcgaagacagatcatgtcttgttcactgtggtgtccctgtcacctagcttggtacctggcacacagtaggcattcagtccttattgaccgagtccataaatgactgtcagcttttaatcccttgcagatcaccttgtcttttgcttcctgtttttacaatcaatagtctttagaagcaaagatcatttaaagaaaaaccaaatatgtaggggttatctgccttgcctaagaaatggtgctgtgtggaatttccttgtttaagaagagatacgtgttagaagaattggcttctgattctctttgctgtgtcttgctgtgtaattcaagttggctgcacagcaatttaatgaattagaacaagaaccaaaagattattgaaagtggctgatggccataatctagataattcctactgtgtccccatccatctgccactttaaaatgaaaatagcaaggcaaaagaaagataattggaaggcattatggtgtcttgcaccctcattcagccattctacaaatatctattaggtaccttccatctgtcaggcactgggaatatgggaaagaataaaagtcaaattcctgtccccatggagttgttcgttgttttcatgggaaaaggcagtggtaaacaatgactgtaccatctcgctggcacccctagaacagaacatctaagcacctgttgctggaggccatttctgggccggtgcacctttgatccactcaactgacagacaacaggatttctcgtggcgtccagggctgcatgtcctcttgggttacctcgacctgatcagctggctccactgtgtgtttccagtgtgaggtgtgaggtcaccatccgctgccattacacaaagacccatttcccctgggccattgctcaagtatgacagagctgattgtcctgtatggaaactcagccactcacagctctgcccagtgagacaggcaatgactatctgatcatggttgctgacacagtgcttgtggtggggagtgtccctatctggaggcaaacagccgagtggctgctgtgccctcaacaagccccaccctgcttcacggtgaggaaacagcccccacccaaccagtcctctccccagcctccagttgagtcaggtgcccccctccaagtgtttatgtaatttgtgctgatcttaccagggtcaaagcacttaccacattactttgtctaactattattctttcatgacacaaaacatatttattgttgaaaatgtttaaatgtagtaggtaacatctattatcccactacctggaaataatagctgttgacagattggcataactccaagaaatttttttaaatctggaaaacatcgcttttaaaactcattattattcagtgatctgtgtcaataaatggcattgaaacagctagatagacactttcctccttcagccacaatcatttccagacaggtcaaagatttaaatggagaaaggctttcaaagcatgtccccaaacctagaaaccatgcaggaaaaggcaaatgaatttgcccgtgcaaaaactgtagagctttcatacattggcgtccatttggcaggattcagtaagggcagaagctgtacatagctgcggttctaggtaattctagaactttctagaagctttctcgtatgtcaacaaggaacagagtacagacttttcactcaacatcatttgtaatagcaggaaaaaatgggaacaaacctcaaacaccatcaataggggaataggaaataaactgcagtatgtattcatgcaatgaaatattaaatggcagtgaagacaaatgaactagaatgattcccccaccaccaccccagacccctgattttgcctctgtcccaggaacaataggcaatgtctggagacctttttagttgtcacacttggaggtgagggtggtgagcatctagtgggtagaggccagggatgctgctgaacattttgcgacgcacaggacggcccccacaacgaggaattacccagcagaaacatgtcagcagtgccgaggctgagaaacagagacgactcaacatcttggcagatctcaccaacaaccttaagtgaaaaaggaggctgcaaaacgatctatctggcatcgtttacagatgcatacgtatatagtaaaactaaaagcagacgagaataataaacaccaacttgtagaggggtcacctctagggagggagagagggcatggaatcagagaggggcatgaaagggcttcagctgccaagagccagacagcttaggttctaatcccggttccaccactgacactgtgtaacctccgcaggttgcttgatcaatcggggcctcagttatcacaactgtaaaatgggatgatattgataatagtgccttcttcacaggattgtggtgagggttaaatacgttaaccaatgtagagcacttagaacagtgtgtggctcatagtaagaactatatgtttttgtcaccgttttcatcatgatgatgagtatctatgatgttctatttttaaaatatcagaagtgaatatggcatgtgtgtgaaacatctcagcgttctgccttgacaaggaccttcactcctcctcccacccccaccagccaagtgaatttcaccctcagcacttagtctatatttgttaaggctggccatccggaacatactctccaaatctgagacaactcatccaagcagtgtgtttccttttcctcttcccccaccaccaccgccaccccccaccatgatgctggaaacttttctttattgatacagatgatgagcaatgcggtgataagtgtgtatcccccggctgttttcgcgttttcactaaattgatggctatgggattaccggattaacaaggtgcacattttgacactttggcagcattgccaaatggttctaaaagcttgccccagttgacactcccacctgccgacgacagtgttgtcactgtttcctgttgccgcc

SEQ ID NO: 803 - DNA, 2716 bp, Homo sapiens
taagatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaattt

SEQ ID NO: 804 - protein, 133 aa, Homo sapiens
DINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 805 - DNA, 25543 bp, Mus musculus
  misc_feature (1)...(25543): n = A,T,C or G
cggccccgcctgcagcgcatgccataccactactatgaacccaaggggccggacgagtgtgtcacctacatccagaacgagcacagccgtaagggcaatcaccaccgcttcatcaccgagaagagggtcttctcgtcctgggcccaactctacggtatcaccttctcccacccctcctggacctagttatcctgtccaccgatctcggacagatacaaacgaagtggcactggcccagccatttaaccatggccaccttccagccagttcaggctggctggagtatttcccagccaatcaaatcagggccttgatgagggtttttttttcctccagccaatcggggctggggttatctcttggccaatcagggatttggaattctgtatggtttaatcgggtgtcagggggtctttctcgtctagtcagggtctgagcatagtctatcagggtataggggtctttctgagtcaatctgaagcttaggacatgtcttttcccataaggctttgcttcagagccccaggaatgggcccccaaatcactccctccttagctgggacaatgaggtcctgtcctaaggatctgaggacttggtgttgccccacagttgccagaatcagagctactgtagggggaaggggctgccaggaggccaggccaaaggatttgtggagttctaggagtggtagggaagcctaggaggtaagaggcggtgtccagttcccggtttcttcctgagtgaccttaaacagaccctcttgtctttctggtatgctgtgatgacatcatagctccgtatgtggagaccctcactctccgttatacttaagtgtaaattcctcagctaccattcctcgctgggggactcagctccctggggatggggagcctggggtacccttccctgcctccttctagaaactttagggtatttttgtgcaagtgccccccatggttgggggatcctgacagaaatggggcaaacatgaagctgtttctctagcccctcaatccagctgccgttagcctggctctagaaaggccaggcatctcttcctaccctccagcaggagagcattccctgctgcccgaaggagcctttgggactgaggaaggggtatcccagccacaccagggcttcgtgaagtttttgtctggagatgctgagggctttggggagaagtatcctcccccaagtttgggatgagactagagatggggactgggttctgtcccttgcttaagcactttattaagggcaggactgggtgggggtgtgggtaacccccattcttccacagcctgcaagggaagggcttccagaaaggctgtggactgggggttgggggagactagccagcagtgagccctgcgcagcaaggtaatgggggttgggcagtgacagccctagatctggttttgtaatgatttatacagaaataaacacgcctaagcccaactcagtgttctgtgtctttagtctgaactctttgcttgtgcccctctcccacttgggagtatcctaaggaccatgctgcagcctttgggttcggagcttgcaagagggggtgccagatttctgttttagctgcctggagagtcttgggtccagactggatagatgtgatgttgagcaagggcttttgtctctgagaccacagtgggcagatgcctgctctcaaacagcctgagttctggggagggaaggataccagagttctagggggaattctgacaagttgaaagaagttgacgccttgcatctgccactaaagaggaaggggaaggcatgtagggaaagagccagtctgggaccaaaagtcaacacttgggacccagggcctgaggacaggaaaacacccttctaggtagagtgagtttggcaggttgtataaatagctgctggcctcttagcacaagggctgtttagttagacaggcaggaggtgaagggtccctgactccagagaggaaattacagcctgctacagcagataagatacccttgggagcagagcctaacaaagggtgactgtgtaacagaggcaggctgctgggggaagggggtgggggttaggtcagaaagagagctgtcctgggctctgtgccaggtaagatggtgggccaccagggcaggaaggcaagagagatatttatttgttccttgtctcgtgtggctcatcagatgcatgccacagattcatatgaggttgcctcagtgagacagtgtcagctgggaccggttactcagggtcggcagccagaagtaccctcccgagggtggcaaagctgtggccctcaatgaggcagcaacaggctgctagacaggaggtcagaatgtggtgggaccaggagcctggcaaccattgtgatgcagttattgaggaggtgacaggaaacttccagtgacatactagtggtgtcgcgagcccctgtgggcacacttccacctccatgtaaaggctgctgggaaactggatcctgtgtctgcatagaatttcttccacgagcctctgctcacccacaggtgggtgttctgcctgttccacccgtccacctggggcgtaaccgtcctgtcccttttcaggtgctgacctatggaggatccagctgtgagctgcagtgtggctggcctagggtcatctatccctcccccactctcaccccagtggggtttgcttccaagccctgggattctttctgtattcaaaatatttaattttttttcactatgcgtctgtgtgtgggcatgtacataggtgtgcaggtagccaaggaagccagacgtgtcggcttctcccagagctggggttattaactgttatgagccatgcagttgtgattggaactaaacccggttccttgggaacagcagtgtgtacttttaactgctgagccatctccccagccctcaaaagatttttcagtattttaaactactttcacttttatttgcttgtgttttagaattttctggttataaaatgactgaaactgagggctggagaggtggctcagtggttagggagtgcttgttgctcttcaagaggacttgggttcaattcccagcacccacctcaggacatctgatgccctctttggcctttacagatacttgcacacacatgatacacacacatacataaatgaaaaataaaagccagcagggtggtgcatgcctttaatcccagcatttaggaggcagaggcaggtaggtctttgtgaactttgttagttccaggacagccagggctacatagacacaccttgggtgggggggaggaagaaaaaagaaaaagacgttcaggggaggggtgggagtgaggggggctgctggggatacggaattggtggttataagcacttgttcttacagaggacccgagttcaagtccaaatacccacgcggtagctcacaactggggctgccacttggtgcttaagagtcacctgagattccatttccagagactccaaagccttctcgtgacttctgtgggcactacactacacatacatacatgcaggcaaaatacacatgaagtaagtaaatctaattacacaaaaaaaaactttttaattaaagcacagagccggtgagatgacccagtcggtactggttgcttcctgtcaaggctgaccatctaaattagatccctggaattcacacagtggaagaagaggaccggcccttgcaagttgtcctttgatctccacgagtgtgctatagcacatgtgagcccacacattcatgtgcccccacacacacaatgaatgtgaaagagaaaaaaaaatagaagagagcctgtggatacagcccagttgatatagagcttacttcgcagaaagaagtttctggctccatccttagcaccaagaaaactgggcatggtggagtgtgcctgtaatcccagcaacccagcaggcagaaggatccaaagagatgtgtgagattaggtctcaaagggaaaaggggagaggaagaggaaggagaggggacaggaagggggaacacgtctggtctgcccagctccacgggggacacggcaggagaggcaccctgagccaaggcacgtccatgttagggtgcctcttctttatcttttaattttttttagatttttgtgtatatgagtgttttgctggcatggatacctgtgtgccatgtgtgtgcctggtgctgtcggaaatcagctcccctggaaatggagttaacagttgtgagctaccatgtgggtgctgagaatcgaattagagtcctctttaagatcaagtcagctttttcagatagagcgtctctgtgtagccctggctgtcctgaaaccctctatatacaccaggctggtctgaaattgatacccctaggatgaccttgaatttctttttttttcttttttttttaaagatttctatattatatgtaagtacactgtagctgtctttagactacccaaaagagggcatcagatctcattacagatggttgtgagccaccatgtggttgctgggatttgaacctgggaccttcagaagagcagtcagtgctcttaaccactgagccatctctccagccccagctcactcttcctttgacctcatccttccctcttggctttgttactgtttcttctccttgagctgagggcttgcctcagttctaattctccagcctttttctttttccaaccgctgagccatctctccaaccccagacctggaatttctgatccccttctgtatccctctagtaccaggatcataggttcaagctgccttatccagtacacatggcgtgagcccagggcttcctacactgggcaccactctcaccaagttccatcacctctatccagcctgcattcagaatcatttttattcaggtgagattggacctgggcaggtgtgcatcatgtctctcacaggtgcctgctaccccagcaagtgaggtttcccttctcacccagagctgctctgagtgagtagcagctcccatgcacccttctgtgctatggccccagtcagtccccgccactgggcttaagaaccttcctgtgtaaatcctgttcctgaatgggtttctgatgtaggagctgataaaatcaatctgctttccccgaaagttgtgcaatgcacacaccagcctaagtattgggagtagcctttcaggccagcacaggacagatggcccagtccatctgcccccacagtggcaggaccttggtatgcaggctgctactggtgttcaggcaccacccaaactggttgtctgtggctcccaagcatttacaaaagtttccagtttcaccctattttgctgttcggagccatgctttggaggccttatgtgagccgatccctctgtcctgctatgctttgagcaccagcaccctgtaccacttctcctgtagagagctccctaattaggcacatggctttccacacggggagtctcaggtggcctctgggtcctgctctgtgcttaggggttccctgggcacagctggagtctgctgttggcatcatcgtgctccaccgggtactcagaaatgagagtcctcattcttagcaaaccccaatctggatacacaaagctttctgagtgttctttctccacgttcaaccatggagagttcaaggctggcttatcatctacctagccaccagatagtcaggatccaggaggagctcaaagagtcatttccaataggggagatgtctcagggtagggggtctcagagcctgaggatggtgaccctggaacaacaaagtttacaccctggtccccctccctccttacttccctggtctggtctccttgattaaacgctgagattaaacacaccaacttgtctgagcatcagctgacccagctaaagaacccttgtctgtggagagtcgtgcgggcatagagtggtggcagacacactgtgtgcaggtttagtcccagggagtgcctggtggggacgctcactcctaagctttccatgagagttcctgctttcttctctctcctcctccttcccccggctccctccctcctcccttctctctgccatctcgccagagtgctggctcccagcatgccatgcgtgcgcgctgacagccttataaatagtcgcctttgcaggcggctgagaggacaggcagggcactcactggccccagcgcccaccacaccctcccccaggtcagtgtgtgtctgctccattgtctgcccgcgtggaagcctctaagaggtgtggggagacatcacctgtgggaaggtggggttgctggtatcaggctacccttgggttctgtgtgtcttgaatgtttgtatccatggttatgagctgtgtgtgtttgcatgtgtatcctatcagctatcagctctgggtgcatgtaccctgtggcaatgtgtgtgcatgtgtgctcaagtgtgtgtgtgtgtgtgtgtcctggtactctcagcttcccagaccctctttgtcccagctggtattcctggggccttcagttccacccatgcccttggcaattctgtgctgaggccctaagggacaagggaaggacagaggcctatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcatagagattggggaagtgtgtcccctggggcctctgctccttgagccacctagaagacagtcatattaggagcactggggccctgacccagggaaccttataaggcctggctgcgtagtcctgtaaccttactcttgtctgggacccctggctttccggaggcctcctcacgacccaagttattttagaccaaagaagcaggtgtctgtgggacagagggactcaggttaccaggaggggtggggcatgtagaggggagtgatctcctaggacatgctggtggctgtccaggccctgggacactcctcccccccctgggcagctgccgaaggacttggcagccccatgcctcctcctgcacactctgtaggcttagaggctgcagctcaggccatgggtctcaaggttcttgtgtgtttgggggtgccaggcttgagcttgaccccagccagagtctggagctagtctgtgtccctcccccaagcccaattccctccccagatggcaggcagggtggaatgagagtcccaggccagtgctatcctctgccaggcccaatcagggacaggaacaagatccatggtgctaatgagtgtcctgacaccttaagctgggtaccttgcaacttgaagttcagagacagcacctgtcaatgtgggaccctagggtgcaatctaggaaggcatcctgaaagaggtgacatttgagctggggcctccagtagcatttggaggaagacatccccccaagcatttggtgtgtgacgctgcaaaggcctggcaggagggaggcattaaagtggatgagaaaggaggggacagattgtccagacctggccaggtaggttgaggggttcagttttggtttagggagccaagaggaccacacatagaagcctatgagcaggagggtcacacgattgttgcttgccaggggaaatactattgccctgtctgcccgtgcatgtgtttgtgtgtgtgtgtgtgtgtgtgtgtgtgtgtgtgtgatttagaggctctgtggaggtgggctaaggtctcggttggagagaagacggttgggatacaagtgtgatgggcagaggtgaggtgggttgtgggagcatgcatgatataggactgaccgcacagtgggggtgggggaggtcccttgggcctgaacccagggtgagaggaccgaagcgtgcacctgagacacagaccagaacggcatgggtggtcttgggatggcgggacaggtagggggtgaggacatagttttgaagaggctggagggtgggtggctatgaagaaagaatgggcaagctgggggcggtgagtgaagtaaattccccccggggggggggtgagtggtagagccacgtgtgaggtggacttgggcctgcttcaggcaggagtcaggaaccagcttacattcagaattggaaaggggctacagggctagagaggcagctgcgagcactgctgcttctcccaaggacctgtgttctgttcctaagatccacaaggtggccgcagcaaccacctgttaactccagttccgtgggactccacacccctttctggcctctttgtcagtcaggtggtacacttacatgcacgcaggcacaccgccatacgcgtaaaattaaagacaacaaagagaaaccacgcagggccagtacctgcacacctgcaggcccaggtagtgaggctgaggctgtaggacggctgttaatctgatgccagcctgggctacggagaaggagctctgtctcaaacaacaaaacaaaccttgctggattgagcaccaggagtgtctctgccacctgtcctgtctgtccccaggcaaggaggagacgcctgcctgccagcatcctgtcccctggggagtgttgtcaaagcgaggcagacactcccctcacacactagggactcacctgagagattccctggagttagttgttcacgccctctttgacctctaccaggtgtctgcagcagaccaaagcacacactagaggggtgacagaggcaggagaagccagcaggaaggtgactttcccaaggtcattctgcctcctgggtatctctctacactcttagtttggaaattacaagccggagcctgacacttattgctgtgggtggggcttggtggagctgagtcagggtgggaggagaacccctcaaccctgcctgggccttgtcttgcagagtgctgacctagctcccagatctcagcaggatggaaggtatgtggtcccctcctggccttagggtcctgggtgttaaggaatgggctctcagagattgagagggttggaggaggccccaggcttcctccccctgcctgttaggatgtgctcggatcctaatcttagaagcaacaaggcttgcctgaggtttctggaaccccagagctcacctatgctggtatttatagccaagcctccccttttctggggaaggagggtactggggaggggctataccggacagcaattccagctaactgccgagcagtgtgggatggggtgggggtggagggttgattggagcagtgggcaggctcatgtctggcccttgctgggactcagtgtctctgtcagctagtggggtggaccctaaagtcttgtcttcctggcttctatgctctaggatgtgggcagagtgcctggaatgggtgggccctggcttctggcagcgccatgccctggcactgggcctctgcctgggtggctctttaaagacagacgctgctaccactgctaccgcctcaacttggtggtcaaggatctaccccttagctgccacactcagccttaggcacactcagccctggcagtgcctcagggccttagaccctcagggccttcaagcccacctcctcctggaaaggctgcatcccaatggggtccccgcccagcaccctaatgggagggagctcaggagaaagcccgggataatagtttgggctcagatgttcccttggctaagcccctccctccctccctaggccttggtttccctctccctttttcatagcctcaggtatggggcccagggcctcactccccctagctaggtctgccacatagcttctccacagcaggccaccagggctgtgggtcctaaggaggcagtttgggaagtttgcttaactccctgtctgagtaagagttccatttgcccacagcagccctcctccctggcaaccatctctatggcaacacgttgtggttgccacagtactgctgggtcagagcagccatggcagggccaaagccagagagaggggaggtgacagcgggaacaggataggatcatgggctgctgtgtgtctagtgaaccccaagaagagggaggcagaaagactggaggtgactgacacctggggtctctcgtctggccctcccccactcaaggcgcccatctctgtcccttaacctctgaatccttggctgagttcttagcctctgggctttgtctgggcctgtccagaacacccactgtctgtcccagctcactcagcccaagtctgggtcacacgtgggctctgcctgcttgtctagccagtgactgattcatgcttcccgttcattcttcccacagagaagctgaagaaggccaagatcatctttgtggtgggtgagttgtaggcaggcgggcaggcggagggtaagcagggtctgagggtctgagcaggcactgcaggatttggagggttttgttttgttgtgttgtttgtttgtgtgtgtgtgtgtgtgtgtatgtgtgtgtgttttgagacagggtctttctacatagttctggctgtcctgaaactcactgtgtagaccaggctggcctcaaactcacagagctctgcctcccaagtgcagggatgaaaggcttgcttgcgaggtttcttctctcattgaggaccgtggtggtgtctgcctggggctgtgttgttttgcagggtggggtgaagtttctgaatgcatgggtgcttacaggcggacctggctcaggaaagggcacccagtgcgagaagattgtacagaaatatggctacacccacctgtctactggggacctgcttcgggcagaagtcagctctggatcggagaggggcaagaagctgtcggctatcatggagaagggagagctagtgccactggtgaatgagcgggcctgcgggggggggggattggtggagggtctgagcctgagccccaggggtcagccattctccaccccctagtgtcctggactttctgtctctaccacactcctttatggctggccctaactccccagccttgatctcagaccccctagattaatactggagtggccccttcagttacttgatttatttatttgttgggaggggtatgcatgttctgtgggatcaacatggccgtcagagggcaatgtgaagggattggtgtgcatcctggcagtggaactctggttacaaggcttaaaggcaaatgccacctttgagccattctgctgacccgtttgtccccttctttaccttactttaccccttcattttatgccatgcttagagtcaccagctcattgtacctcagtctgtcccctccctgtcccctgccctggtgaggatagggacagcaaaggcctgtagaagctttgtgtccaggcccaggacatttccgggctggaaaggggtttgctgaagcccaagcctggagagaggggcttgctgggacttcacacgctcccggaaagagggcaagcttgggtgggctaacacaggtcgtgctcccgaggggcccccggggagagaaggctcaagggtcccctgtgctggacaacaggacacggtgctggacatgctccgagatgctatgttagccaaagtggattcttccaatggcttcctgatcgacggctacccgagggaggtgaaacagggagaagaatttgaacagaaggtaagacccttgactggtcatcggcctagagggaggggtgatggaggcggagactacagtgtgcaggtgggaaggccgcacaggacctaccataaccaccccaaagaaaggcgggaggaggaggatttgagagactttatcctgtggggcttgtcaccccacatgtacacaggcagacatttgcgcacatgatccatacctatacaagcaataggcaatgtaggatgcacacatgcacatgtgcacatgtgtgtgcacctggatgaagctcacactacacaggtgctgaggagaaaggggtagtaggtgttgaggaggggagggtgaagggctgactggcaccctggtgggctggggcagagtacctccagcctcactcctgcccacctctgcgcagctcagtcagaataggagagatggcatgtcacaacctctaagtgaatgaaagacctcaagaaaatgtttgtcttgctctgagtctcagcatgccaatcattgaaatgggagttggtctagcttcctttaggcgcaactctgaggcacatcttggttttcctcagctgcatgaagtcatttgccaccctcagggccacatccagcaaaccaaagtgcctcctgtcctgtattagggagtttccccacctccctacagtcagggcttggaggcagcctctgggagtccgagtagttgaagttctcagatgttggcactagggggagccagaactgcactgacagagaaggggctggcctggaagtgacttgtcctactgctgacacaaatccccagagcttccttggggtgggcagtcttcagggcccactcctctagttagatgcctatttccatactgagaaactgagctccagccaggggtgcgttgctcagagacaagcctcactacctccacccaaagtgtggatccagagtctgttgtgtttggccctggggactcagaggaccttggcagctgatggccgatggacagatggcagcagccttggtctggcctttgccactctaaactggtaaaccgtctacggtcagcagatactgtcacactgaatctgcaaccacccaggagacagacaccagactcagagggcccagtagcttgccctaggttacacggttggacagaggcaggagaggagctgtgagtgacaagcttatgtgatgttagctgcgtagaggctggggctgactcagctgtggactaaagaacagaggtcccaaagctgttagacctcctggcccaggcccaaggctaggaagacccagaatcctcctgcctgccctcacaagcccagcctagactaggccaggcttagggatctatcgatgacccctactctgaggggtcgtgtagccagaaaaggggaaggaagccgttgcctgcttcaatgcaaggcccagcctgggcagggccagtgtgtagggccctggtggccaaaccgaggtctggaacactcaggccctaatcctttatacctcttcaagccatctttgtgacgagtggcttatgacagtgacagtcatttagatgtccttaaagtcctcaccttgtccctctgattcctttcaatcaagtcttattcagcccttagctcccatcctggctgagggaagaggaggtcgctaagtaaatacctagaggctgtcaaggggagactaagggaccaggaatagtggaggtcacatctgcgaagaccatctggaaggagtgagggtctagctgagactcccacagtctcagttgtgagaaagggtaatgggacctgtgctggcctggcgtgggatggagacagatacaagcatagatcaatatggtggaaggaaggaaggagggttgagggtggggatcaggagagcagctgggggggggggggaggacaagggcacaacacataggtgctctagatctggtaaggattttgggcttcctcttgaaaattctaggagcccgtggaagaggtttgacctgagtgacagaggagttactctaggaaggcgcgttctgggtgggtctcatgtaggtagggcttgggagatggaggcagggatgatggagtcccaatgatccgatttccaccctacgcagattggacagcccacactgctgctgtatgtggacgcaggcgccgagaccatgacccaacgactcctgaagcgaggggagaccagtggccgcgtggatgacaacgaggagaccatcaagaagcggctggagacttattacaatgccacagaacctgtcatctccttctatgacaagcgtggcattgtgcgcaaggtggggagcgcctctcttttctagctgcagctcacggtgggatcttaggccatccctctccctctgcctcagtttctccctcagtttactgagttggggctgtgtggatcctgccatggcgtgcgtctctgccctcatcatccctctccccacaggtcaatgccgaaggcacggtggacactgtcttctctgaggtctgcacctatcttgactccctgaagtaactggatcccttggccagctcccagcccgccccacccttgctccctgaccccaggcagcctggctcaagcccagcacctccaccctgccgggctgtgcacagacacaggaagccatgttatcctgtcccatggacactaaagaaattgccaaggagggttaggattgctcctttcctttgcttccagttatggtgattcatgctgccacagccggaggccccagcgtggccggcccattcttccctgtgcctcagcccagctgtcttgtctccctctggctctgctgggatcctaggcccttccttagccaggctgtgtcaaagcctaggggtccctgggttggcaggctgctctggggggtctggtgttcaccctgtttctcatagcctcgttgtgtggctttggccctaagccattgtctctctggagtgagttttctttttttctttctttctttttcttttttttctttctctgtttctttctttttttttttttttaagacagcatctcgtgtgacttaagctggcctcaaccctgttatgtaactaagggcaaccttaatccttctgcctccacttgtcttcctgtgtgctgagattacaggtgtgtgtgtggacctccaccactcctggttttgggggcactgggaatcaagcccatggccctgtatacgaggccagcacgctacagagtgagctgcatcccgggctgggcaggttttctgtgcctgactggggtctggcatgggcaaagggcaaagggccatgggctcaccagctggggccacgtggtcactgggtgccaaggagctgtgcaatgggcatacagctaggtgggaagctggggtcaggggtggccttcctgaagaaggctcccttggtatagacctgccaggccttgccatcctttggctggttttaaagcttgtcctgtcacgctatgtcccaacccttatcctcggcgttaagacaagagcatgcagattaaggagtgtgagctgccatagacaaggatgtgggatcaaggaccaggcctgggacccggagaggacacccagggatgccaagaagagctggcatctctcttctgctctttattctttggtctcattacacaggaagcctctgttggtactcacttgtcctggggccccgtctccatccctagtgacttcccctgtaagcccagatagcctgtaagccagcagccatggctgtcccagggacacctgcccctgggggtgacggtgctcactcctttctgtttactaccagtggggccacctttccttctgcattgcctatttaagctgtcctttaaaataaataaatgtatttcagttataagaagtgagtgtattgaaacacagggaggttcagaggaagagggcaggcatcaccaggcacagccttctgcctgatcaggtttgcctctgtcccccagggtgacttcaggaaagcaaaaggctctggagccccgcaccagtctgtgacagctctgctccaatgctgtgtgcatgtgcatatacacacagacacgcatgagcgcacataggcatgtgcacacatgcacacgcacactgcagccccgctgaacatggatctcttaaggccggcctaggagcagacagaggatgcacagaagaggggaaagctggagaaaacggcctgaaaaatccccattatcttaatgtgctaattacagctcaattaattcaagtgggtcccagtttatgaagacctggctgattaaactagaaaattctccagaatcagatcacagagtccattagtatctgaggggacctcattccgggacccccaaacatacccagagctcagtaaccctaaatcccgtatagaatgctgcaggagaaaaccgcaggcactcgcctgtgggcctgcatagggatagggatgtagagacaggaggaccagaagttcaaagttaccctcaatgagagagagagagagattaattgctggcctggtagcttatacctctatggaaaggcagggggatcttacaggtcggtgggggccagcctgggtcataatgtaagaactgatgtaaaaggaaagaaaaaaggaaggccagctggcctcccttttatatgtccagttctaggccagccaaagtaaccccagcattttggatacagaaatggaaggatcatggaaaattcaaaccagccaggtaaacctggatctctaagcagctagacaacagagtgaaagtcactctcaaactccactccctgttaaaataagaaagaaagaaagaaagaaagaaagaaagaaagaaagaaagaaagaaagaaagaaagaaaaaaaaaagacagaaacaagaacaaacaaaacaaaacaacaaacccaagctagaacctgcacacaccttccagtatgttctgcatggcctctcgatgacaggtaatccataagacagtatagatagtatacgtgctattatactgtaaggagcagaacgtcatctccatatagatatcagggcgggggaaatcctttttttgtttgttttgagacaaagtcttgtgttatgtagccctggccggcctggaacttgctatgtagaacagaatggcctcgaactcacaagagatcctcccgtgtttgcctctggaatcctgggattaaagatcggtgccaccaccccctgccaaaaggccactcatttgagatgaggcttgctgtgttgtcaaggctggtcttgagcttctagctccaactcccttttcctcccaaactctgaaattccaggcaggtgccaacacacacacacacacacacacacacacacacacacacacaactacaggatttgagccaccaaagacacttcaatcctaaaggatgacttgaagtgacttggaggaattaggacattttccagaatgctcatagccattgtgaccatagcaggatccctcactgttaccccaccagtacaccgtacttgtgtggtttccctcttcttcccaaatttcctcaaggcaggttcgctgaagccaggggtgatgcaggaccacactctgcatttgaccttgcgggacctcacgctcacattctgcaggcacgctgcccctgagttccggctggctggggccagacctctccgcattgaggactgctctgcctctcatcttacttggtcctataataggacaactatcctgatgaagttcctccttccaagtcatcctctggcttctcctggagtccaagctgctttctgcactgctgttcctgcatacccacagctagctagggaggatgtaagtgctcaagtttgagccttaagaacaaggagttcttgtaggtagggcccgtgggagggtttacagccaggcaagaaggtctgacctgcagtttttccagcataccggaatcctgaaggagcttggggaaagccggttggctaggcattgcgctgcacacttgtaaacccagcccttgggaggctgagacaggaagacatcacgaatgcaagatcagccagggctacaagaaggaacaccagacctagtgcctggagagatggctcaatggctaagagaacctttatagaggaccaaagttctgtttcagggacccatgtgggaaggaggggatgagggctcacaattgcctctaactccagctccaggggaccccaaacccttctggattccaagagtacccacattcatgtacatgaacacacacatataaaaatagtatttttttttttttttaaatcagggctagggctggggctacagttcagtggactgaatgtttgtgtagcacacaaattctgggtttgatccccagtgctgtgtaaactcgacatggtggcacatgcaagtcattgtagcatttgagcttagaagcaggaggaggagaaatataaggacctaggagcctataggaagtttgagggtagcctgggctacatgagagcttgtctcaaaaaaaaaaaaaaaaaaactaattaaaaaacaaagcaggtcaggtgcagtgatggcttccaggcagctggccgccaggtcacactgccgtcagctcaggaaaaccagctctgctcttcagcggctgaagcagaggtcagaggaaggcagtagcctgctggtgcggagcagggtcttctctggcgtcactggggtgtggtgggcatcagaaggtcaccgatgctgtcattgtcttctggtctctagggacattccaggcagctgtttgttgcagtgtggggggaatgttctctgtagcttgtaagattgatgctgctatgcccagagagtgtcagagaaagcatgctgcaggcaggcattgcagggggcggggtggcctcagatgcctcccctggactgcacccccatgccttggcctcagggccccctgagtgcctgggccggaggcactgaagtgggagaggaaggaagtggggagcagaggaggccaaggctgtcgcctcccagacccgagaggggcctcgagtaaacaggaaggcctggcggctccacggtgggggtgtttggagggctgggggccaggagcccttctgaacatgtgcagactgtgaacacagggcttccttgctggggaagtgggcccagagaggttgtaaagcttcacctagattgcagagcagtaacactttcatctgcctccccgctacccccaagtcaaagtcatctatctctcaggccttagattctcttagtccctggagacctgccaggagcccaaaaatcctggatggttctaatgtacatatgaaaaaatatatatttattcaaactgcttagagttaagaaggaagaatctactttcttctttttttcctctctttctctctctctctttctttctttctttctttctttctttctttttctttctttctttctttcttcctttctttctttctttcttttttcttttgtttgtttttccaagatgggatttctctgtacagtagctctggctgtcctggaacttgttctgtagcccagattggccttgaaattatagagatccgggactggcgagatggctcagtggttaagagcgccgactgctcttccaaaggtcccgagttcaaatcccagcaaccacatggtggctcacaaccatccataatgaaacctgatgccctcttctggagtgtctgaagacagactttcatataataaataaataaatctttaaaaaaaaaaaaaaagaaaagaaattatagagatccatttgcctctgctacacaagtgggcttttccaccactgcccagcaagaacccactcttgattttgttccgagacaggttctccctgtgtattgcatgctgtcttggaacttaaaattctcccgagtgctgggattacagacgcactgtgatcggatcttggggtacaggttgccacaggaacatggctcctgccattggaaacagaaggtcactttgaaggcatctgttcttctaatgcacgggtgcctgacccctggcaccagctgcattttggggacattgtcccctctctgggaggctgtccttaggctcacatgcctctctgcacccacattctggggcttcagactgtcacttaagagacatggcactgtgcaagcaggtaacaaggcccatcatgtccctctagtgtgtctaacatggctgctattcccaccacccacaccaggcagttcacaaccattcataactccagctccaggagacccaatgcttctggcctcctggggtattacatgcagacacacacacacacacacacacacacacacacacacacacacctacacataatttaaaaataatacaaatttagctgggtgtggtggtacatgcctttaatgctagcacttgggaggcagagacgtggatctctatgagttcaaagccaccttggtcaacagagttctggggcagccagggctacacagagaaactctgtctcaacacccccactctcagctccaccacaaccaccaccccccaaaaaggaaaaagagataagaaagaaaggaaaggaaaagaaacaaacatagccgttgacctaaggaagtgtctgtttgtgatgggaaaggacaccatatcagctagtggcccaaaggcctgctgttcatgtgagagaggtatcttatttttatgtgtaagggtgttttgcctgtgtgtatatctgtgcaccataaatgcctggtgcctgaggagaccagaagagggcataggatcccctggaactagagtgacagatgtctttgagctgccatgtaggtgatggtcctttggaagaacagccactgtttttaaagactgagccatcaagagaggccattgttaaagagacagtcaggggctggagaggtggctcagtggttaagagcactggctgttcttcctaaggtcctgagttcaactcccagcaaccacgtggtggctcacaaacttttgtaactccagttccaggggcatctgacgggtcttgtcacatccttgggtactgtacacacatgatacatatacctacacataggtccacacacatacacataaaattaaatgttaaaagggacagtcagagctgggcgtggtggtgcacgcctttaatcccagcacttgggaggcagaggcaggcggatttctgagttcgaggccagcctggtctacaaagtgagttctaggacagccacggctacacagaggaaccctgtctcaaaaaaaaaaaaaaaaagggatggtcagagggagccttgctttctgagaggagactccaaaggggaggaaaactggtgctccctagacacaaagggatgtgcagaggcctggaagtaagcatggtcaagacacactggagtcagtgtcactggggtggcatgagcaagggggaaagggagatcaaagaagggaagggtcctcgtcggctgcttgagaagtcttggttataggacagagtaaggctaccactggactccacttgaacaggcttcctgcctagagcggagacggggctgtgtcaaaggaagaaggaagcagaatgcggctacatgaccttgatctcccagaggggacagttacagagggctggatgaggcttgctagggcttggatggagtggcagcccaagggagagtgacagactgaggcagactggaaccctgcagtaggtgcaggcagtcagaggcatcctggagccctgagctgtgagagtcctggggggaggggggaggggccagtgcccaccaggcacggaaagctttctgtgtgacagtgtccccaggaacaagtttccagcctcgaactggggaagcatgcagaacagtccctggagagactgagaaggcacgggcctgtccgatgaatgtgatttgggctctgttttgtttttttttttttaaataaagcctcatgaaggctaacctactcagtgtgtagttgaggatggacttgaacgactgatcctcctgtctcaactggctaagagctgggactgcaaatgtgtgcttcctcacatcggcactctgtcaactgagctactccccagatccagtttggcttttttttttttttttttttttttttttttaaagatttatttattaatatatgtaagtacactgtagctgtcttcagacactccagaagagggagtcagatcttgttgcggatggttgtgagccaccatgtggttgctgggatttgaactctggacctttggaagagcagccgggtgctcttacccactgagccatctcaccagcccccccagtttggcttttaaaaaaacattagtgtgtgtgtgtgtgtgtgtgtgtgtgtgtgtgtgtgtgtgtgtgtgtaaaggccatgttacccatatgaggatcagagggcaacttgtaggagttagtgtattctgtccaccgtgtaggttctgaggatcaaactcgggtcatcaggcttggttgcaagcctctttatcccttactccccctaatttggcctttcttttttttctctttttaaaaattgtgccgggcgtggtggtgcactcctttaatcccaacacttgggaagcagagacaggcggatttctgagttcaaggccagcctggtctagagagtgagttccaggatagccagggcgacacagagaaaccctgtctcggaaaaaaaaatcgttttattttgcataattttttgcctgtgtgtgtctggtgcccagggcagccagaaaaggatgtcagatctctagatttggagttacaggtatgtgagccactgggaagcacgccaggacccctgtagtagtagcaagggctcttagctgctgaattatctctccacttctgccttggctttttgggactaggctgactctgacctcatggagaaccacttctgtgtatcagtgctagatgactgcaggcctgtgccacccagttgagggtctgtccttgtaactagttcctagaagagacttggccctcactctccgtctaggaagaagctgatacactttgtttcccagtcaggacccgttggtgggaaccaaaatccagtggtttgtggtcagagcaccaacaagttcacagaggtctgtccctgtcccctccttacctgagcccaagtcccccaggtgacttgtcccttagctatgacatgatgtcatgggttacatgggtcttctgatttggaagtaagagtgaacagcaaaggaaaggcacaaagactgcggagggggccgcgagggaccagggacaaataagatgacatggattgtagcgaggagactaggacagaaggttctagaaacaaggaaacaacgccagatccaaccctgcacctcctttgcctctctccagcccagtgaccttgcacatctgggcctttctcccactgttaaatgaggatggtctgtgaagcggcattggatattgggccccaccatgggctagcttgggctagctggctgccttcccattgagcaggtaaagataccaaggctccagaaagtcaaaggccttgccttaggctccctggctagcacagggcagagtcggatacccagactcctggcctagcactcccctccccatgcccaaacgaacctaaccttgctgttactaacggcccctggctgcaggcctgtattggagactcaccgccgccttggggtccttaggggctgcctgacattccttcagtggccaggggccaaggtagacgtgctttaccctttcctgctgctcaggccttccaggccccaccaggaggaggatggagcccactgtgcgggccagacacaggcctggccaggggccatatctctcttggagtgttgcacaggatccacgggagaacatctacattgggattagggcctctgcaggaaacagatggcaggctcccaagggatcgctttgacaggctgtggtgaggggtgtattcacacaggtgtggtcagggtgcatggagctatctctatcaccctgtgcagatgaccacttggcctgaccggtaaagggaggagcctagttccccggtatagcagtataggatagaccctggctggattatggtcctcaggaaggggagaccaccaatgcagggtcagtcttttggggacaaagccaagggatgtatccttctctcttgacctcgtctgtccctcaggagcaggggagtggaaaaacagacgtacccctggctggagagagcatgctggaagcaaaccacagcttgctcggctctgtcccttgttgcaagatgctagggtcaatgagcttctggggacagaggaaccagcacggaactggtttttatttactacagatgagaaacaagacagtcttctctgtgcctcagtttctccattcccacaaccctcagttccaccttggcttccagggcacctcatgctttcaatatatttgtcttgctgggcatagctatgcacatctgaaatctcagcacttagtctgaggcagggggattacacatggaaaaccttctcaacccttatagaaaaagaaaaatatcccaagaaacacattcccttggctctgaagggacaaagcatcagaggccatcaaggcccctggcctcctgggacatttagtgaaatacaccaggtattgagacaccacccagactgccaattggcagggacatcatctttgctcaaaacttccaggctggtggtcccagacccttcattcccttaggggggtccctgctggtaaacttccccctaccccctgttcttttcttttaaaaaattttaagctacattttatgtctttacttaatgtgtttttgtatgtatatgcatgtgacatacatgtgccatggcctacatgtggcattcagaggacagtttgggggaatcagatctcttctttctccacataggccccagggtcaaacgcaagcacttttactccctagaccatcttgttggcccctctttcttttccttttgggtgtctcgagacagggtcttgctataaagccccgagcaggcctagaccttgttgcatagatcaggctggccttagccttgtggttatcctcctgcttctgacggtgcgaagaggggattgtaggcgtcccattagctgccactccacagttcctgctcttatcagcctggagcctcccgtgtttcctggagagtgcattaggtctcgtttatgatctgaatggcaacggcttgtgctgcacagggttggtttaggaagatcttttaaaagggtccttgggaaccaggcatggtggtacacacctttaatcccagcatttaggaggcagaggcaaagagatctctatgagtctgaggccgagcgtggtctatgaaactagttctaagccagtcaagcctacacagtaaggccctgtttcaaaactaaaaaccagaaacaaaaacaaaaaaggctgggatgtgtccaaacataggctaaggcatggacttagaaagtacttagatcaccctgggacacagggtgtggaaaggttaagacaactggagaggcagaacacagctagaagggcctggaacacaaggactttgtcctggggtcccagaggatcccctgcctgtcatctcgccctgatgttttgtctttgtgtcagctgactcttctatccactcagctcaggtggagtggccggcatggggcccgggttgagatcaggccctgaggtgtccactctgggtgttccctgtcaagctggtctccctccacctgtgtaaaacaaagcctaaggcgcaggcctcttgtcaatggtgacttgagactgataaggtgaacgcccagggtgggccctggtgtggcacttagtcccagggctga

SEQ ID NO: 806 - DNA, 2034 bp, Mus musculus
gccatggcagggccaaagccagagagaggggaggtgacagcgggaacaggataggatcatgggctgctgtgtgtctagtgaaccccaagaagagggaggcagaaagactggagagaagctgaagaaggccaagatcatctttgtggtgggcggacctggctcaggaaagggcacccagtgcgagaagattgtacagaaatatggctacacccacctgtctactggggacctgcttcgggcagaagtcagctctggatcggagaggggcaagaagctgtcggctatcatggagaagggagagctagtgccactggacacggtgctggacatgctccgagatgctatgttagccaaagtggattcttccaatggcttcctgatcgacggctacccgagggaggtgaaacagggagaagaatttgaacagaagattggacagcccacactgctgctgtatgtggacgcaggcgccgagaccatgacccaacgactcctgaagcgaggggagaccagtggccgcgtggatgacaacgaggagaccatcaagaagcggctggagacttattacaatgccacagaacctgtcatctccttctatgacaagcgtggcattgtgcgcaaggtcaatgccgaaggcacggtggacactgtcttctctgaggtctgcacctatcttgactccctgaagtaactggatcccttggccagctcccagcccgccccacccttgctccctgaccccaggcagcctggctcaagcccagcacctccaccctgccgggctgtgcacagacacaggaagccatgttatcctgtcccatggacactaaagaaattgccaaggagggttaggattgctcctttcctttgcttccagttatggtgattcatgctgccacagccggaggccccagcgtggccggcccattcttccctgtgcctcagcccagctgtcttgtctccctctggctctgctgggatcctaggcccttccttagccaggctgtgtcaaagcctaggggtccctgggttggcaggctgctctggggggtctggtgttcaccctgtttctcatagcctcgttgtgtggctttggccctaagccattgtctctctggagtgagttttctttttttctttctttctttttcttttttttctttctctgtttctttctttttttttttttttaagacagcatctcgtgtgacttaagctggcctcaaccctgttatgtaactaagggcaaccttaatccttctgcctccacttgtcttcctgtgtgctgagattacaggtgtgtgtgtggacctccaccactcctggttttgggggcactgggaatcaagcccatggccctgtatacgaggccagcacgctacagagtgagctgcatcccgggctgggcaggttttctgtgcctgactggggtctggcatgggcaaagggcaaagggccatgggctcaccagctggggccacgtggtcactgggtgccaaggagctgtgcaatgggcatacagctaggtgggaagctggggtcaggggtggccttcctgaagaaggctcccttggtatagacctgccaggccttgccatcctttggctggttttaaagcttgtcctgtcacgctatgtcccaacccttatcctcggcgttaagacaagagcatgcagattaaggagtgtgagctgccatagacaaggatgtgggatcaaggaccaggcctgggacccggagaggacacccagggatgccaagaagagctggcatctctcttctgctctttattctttggtctcattacacaggaagcctctgttggtactcacttgtcctggggccccgtctccatccctagtgacttcccctgtaagcccagatagcctgtaagccagcagccatggctgtcccagggacacctgcccctgggggtgacggtgctcactcctttctgtttactaccagtggggccacctttccttctgcattgcctatttaagctgtcctttaaaataaataaatgtatttcag

SEQ ID NO: 807 - protein, 217 aa, Mus musculus
QREQDRIMGCCVSSEPQEEGGRKTGEKLKKAKIIFVVGGPGSGKGTQCEKIVQKYGYTHLSTGDLLRAEVSSGSERGKKLSAIMEKGELVPLDTVLDMLRDAMLAKVDSSNGFLIDGYPREVKQGEEFEQKIGQPTLLLYVDAGAETMTQRLLKRGETSGRVDDNEETIKKRLETYYNATEPVISFYDKRGIVRKVNAEGTVDTVFSEVCTYLDSLK

SEQ ID NO: 808 - DNA, 40136 bp, Homo sapiens
  misc_feature (1)...(40136): n = A,T,C or G
gcctacaagcggtgttgttttattctgacaccacagggacccaaggcagggtttagagcagggtgtgaatggggctcctactgcgtggaggtcaggtcctccagcaggggagccagctttggccctgccagctgccttggtgtgggaaggcccctgcttagggaggagaatgggcagggctctgccgccaccaggctgtgtgacctcaggcagattcctggcctttctggccctcagtgtctccgtctgcaaaagggatacagtcctgagccttaaagttctgggtgcatagaagaactagtgcggggcagagaaggtgtagcctttggcttgctggacccaaaggaccgaagccataataaccctttctggtggcttgcaggtgtgaacccacatccctgcccccagggccacctgcaggacgccgacacctacccctcagcagacgccggagagaaatgagtagcaacaaagtaagtctgccttcatttcttaaccccattgagcctctcacttccctccatggaacgggttcctttggacctgtctcagaccccagccaccacgagtctcttcttccccgcaagaagctgcccatgcctgggaggcccagatttaagccctggtttggccactgatcttctgagtggcttagggcaagctcctgcctgttcccgggcccagggtcagctctgccttcccaggcctgacggtctgtctgtgatggtcaaggactagccgaggtgactgtggagtgctgtgcaggagagaggggtgggcaggtggaggtgagcgggaaatggggcaagggtgcactgatcagagtcaaaggtgatacagcccgagcatgaccctgagaatgtcaggattccccatcattctttcattcattcattctttcctaagcacttactacatgactggccctgcatgccccttccctaggatccactgcagccttggtggagcctgaggtttggaagtgggatggggtggttgtattaatttgagtttaatcaggaaaaagaaactacacagtgattaaacggaaaagtttaatgcaaaaaattattgactataataggacactagagtaacaagggattggaattctgaggaatacaggaatagcagatattaatataaggagcacccctgcccccataaaggctgagatctgggccttgctgaagaaggcccagctatggcccactggatggctccagtacagaactggcctggggaggggaagccgccagcctccaggtgctgcaggtggttgagtgtactgtaggagctggacttcggagaagctgtgatcacagcgggagccagaagcaataagcctgacttgctggcactgctggcctctgggcagtgggtaagatgcccttactggagaggccgtgtgcactgaaggagcctccctagcaagcctaccagaaccaagaagcaaatgcttttcctcctgcagtgtctgtccagcaccctctactcacaaagtttaatatgcagctaactgacaagggaaaatatttaaagggcccagatccatttccacagagcagacaaaaaggataaatttggagctagaggcaatacattggagagttactgttgggggaagacctagaccctctcactcagatgtcccacctgtctctagacatcctcttagcagcagctatagggaatcctgacatattcaatccagtccagcaaaccctcccggagaaccttccatgttccaggccctgccctgggatctaggatacagtggggagcaaggctgacctagtcccagagctcacggtctaattggagggatgggagtttgaatgcagtatgatcagtgttgtgatggggggactgaggtggctgaaggaggccttcctggaggaagtagtgcctgacctggtctgcaacaaaaagcaggagttaaccaggcatggtaggtggcaaggaggtggggcgctgagcctgcccggcagctgggccctcactgacctctcctctctccaggagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaaggtagcgcagctgctttggggagctcctccctactgcccagcatcaccactccctccacctgttctttcctaaaggaaaggtggaccctgagagtcaaggccctgcctccggtgatttcatcttgctgcttgctgtgtgaccttggataagtgcgctgcccctgtctgggcctcagttctctccaagtccccacccttattgctaatatcctaccatctcctgaatcagaatccttttgaaaatgtgtttctgttttcactgctctctgtctctgctggggagcccacacaggcttgggagcagagcactgggacatttgacaacacaaaagcagtaataataccggctgccttttatcaagtgcgtgtgtgtgccaggccctttgatcaccagtaatcctcagacaagccctgtgagggcagcattattatcttccttggtgagatggagtaaccaaggctccgagaggtgaagtcacatgtctaaggccacacagtgagggaaggaagaagatggtattttcctaccccctgctaagatgcagctgcacagagaggccaaagtcattcctggggacttctgttggccttgggtagccatgaaattcagattgtatttctgaggttcaccctgtagtacctctttctccttcctcactgaccctcctatattttcttcagggccttcgcatgcagagtgtagagcccgggctctggacacaccctcactaggaaagggcacattagcaggtgtctggagacaggttaacacctaagtgagtctttctctaccctaagaacccttgaaagcggaataaaaatgggacagcttgagtgtgggtgatgtggaaaggagagacagagcctggcttgcagtgcttccagcatcacaggggaagccaaaaaaactagcactcagaaaagtgggagtgccagtcgaggtacgtgggatgtgttgctggatcttggagtaagggctcagggaaggctgccttggggagggtggtatttgagcttagccttaaagggtgaatgggaattccgtgggcaaaaaatagaccccagagagtatgtggttccaacccattcatttcagccatggaaaaacaagcccagagtggctttcacaccttccttaataacaaggtggttcttgtttctgggtgctgtggaaatgtcatgggtgctttttggaagatgtcttctttggagagctgggaatctgtggtcacatagactttgtgacctgctgttctcccacttgttgactctgccccaactgaatggccttcttttggttttcagtgtaccacctttatttccacattggagcctttgtgctggctgtttctcctgccttgaatatgtttccctaggtggtccttcttcatccttcacatctcagctcagagagacgtctctgttacagccggacagcttcttgcctgctgcccaggaaaagccaatacactgagactgcgggtgttgcagcagagaaagggtttaacaatcgcagggccagccaaatgaggaggcgtgggatagttctcaaatctgcctcccccagaatttggaagccagggtttttaaaggatagtttggcaggcagggggactagagaatggttggggatgaaatcataggggtgttgaaactgtcttcacctgccgagtcagttcctgggtgggggccatgggtcactggtctggttggcatccattgatctaccagattgcaaggtctgaaaaatatctcagacactcaggttttacaataatgatgttatctatgttaaaaacaacgatgatgttatctatattttaaaaagcaaactaagaaacaatgactggttataattcaactatagctacatcttagcagaaaagcaagctaagagataatgactggttatggtttatgcctacagcttgacagaaaggtgtgcggggggtgagacaatcaattcttagtgaccaccttctatcgaactgactatatgcaggcaatcatgcatctacgaagagaaggacaaaggaaaaggaaaataagtaaaacaaatgattttactacacctgtatcctagcagagtccaggcctctgtctcagttgttaccttgtggccttttattaactttacaaagtcagttttagtccccaaacaaggtggagttcagttttgggaagcggctgttatcatctttgcttcagagttaaactataaagtaaattcctctcatagttagcttagcctatggacaggaatgagcaagggtggttagactgtgaggtcagaaacaggatggagtcagttatgttagattcctctcactagattcttttttttgttttgttttgttttttgagatggagtttcgcttttgttgcccaggctggagtgcaatggctcgatctcgggtcaccgcaacatctgcctccggggttcaagcgattctcctgcctcagcctcccgagtaactgggattacaggcatgcgccaccacaccttgctaattttgtatttttcatagagatggggtttctccatgttggtcaggctggtctcgaactcctgagctcaggtgatccgcccacctcagcctcccaaagtgctgggattacaggcgtgagccatcgcacctggacttccaggccaccactcctaaagtgccctggctgcagtcgctctttggtcacttgcccctgtttcccctcccttcccctcccctccctctcccccctctctgtcccctccccctgtcttcttccccctccccctcccccctccccttctccctctcctctcctttcctttcctttttcccctttcctttcctttttcttttccttcttctttcctttccttgtttcttttctttctttcttcttacctttctttatttcgacagagtcttgctctgtcatctaggcttgaatgcagtggcacgatctaggttcactgcaacctctgcctccaggttcgagcaattcttgtgccttagtctcccgagtagctgtgattacaggcacgcgccaccacgcctggctaatttttgtattttttggtagagatgggatttcaccatattggccaggctggtctcgaacttctgacctcaggtgatccgcctgcctcggcctcccaaagtgctgggattacaggcatgagctacaatgcttagccatttgccactattttctttttttttcctggcatgtattatgtgcattcttatctgtctccccacctgtttcttgaaggcagaagcctggtctgttttgctccttgctctgccccaggacttggccattaaccagcttgctatcaatgtgtgctgaatgtggaatgaatgggctcagtttccctgtctttaaaatgggcataacaattcctgggtcctggaggcctggatgtatggagcacagggccagcacagagtggccgtgataatgttgactttccttatccaccagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacaggtaccagcctcctgcctgccccctctggccagcactgtgctccttctcagcatgccccatccagagggcctgttgctcccagcatgcactgctctgaggggtagtcaagtcccgctgtcctctggttgggcctcctaggagagttctcttcatgtccagctgttcacatgggtcctttccagcatgctctgcatggcctggtttgtccaagagggctttctcctggcataccttgctgtgagggcacaagggctcccacccagcatgctctgctctgaggttgcacagtcagtcctagcatctttctgagagaagctccccatagtgtacccaatgtaaagtcttgactgttcccagcatgtcttgccttaagcacacagttgctcctggcatgctctgctccagcgatgcatcactcccagcatgccctgctgtgactaatctccctaggaaagctaggccagtgctgcccaatagaaatctatgtgagccacatatgtcatttattttcatagtaatcgcactttaaaattagtgaatagctgtgtgcggtggcttgtacctgtagtcctagctactcaggaggctgaggcaggaggatgacttgagcccgggaggttgaggctgcagtgagccaggatggtgccactgcactccagcctgggtgacagaatgagattacatcttacatctccttaagaaaaaaagtagtaaaagcaactttaatatatttttaacccaatatgttcaacatatagctcctgtacatattttgttagatttatacctaaatatttaaaaaattttggagctattataaatggcattaacttcttttgttcccaattgttaattgctaatatatagaaatggcatatagaaattgatttctgtggctgggagcggtagcttatgcctgtaatcccagtactttgggaggccgaagtggacggatcacgaggtcaggagtttgagaccagcctggccagcatggtgaaaccccgtctctagtaaagatacaaaaaattagctgggcgtggtggtgcgcacctataatcccggctacttgggaggctgaggcaagagaattgcttgaaccggggaggtggaggtttcagtgagctgacatcctgccattgcactccagcctaggccacaaggcgagactccatctcaagaaaaaaaaaaaaaagaaaaaaaagagaaattgatttttgtgtgttgatcctgtatcctgtaaccttgctaaacttacttattggttctaggagattttttttttttttttttgagagggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcagtgtttgtattgtttgtttgtttgtttgtttgtttgtttgttttgagatggagtcttgccctgtcacccaggctggagtgcagtggcacaatctcagctcactgcaacctccgcctcccaagttcaagcgattctcctgcctcagcctcccgagcagctggaatcacaggcacgtgccaccacgccagctaatttttgtatttttagtagagagggggtttcaccatgttggccaggctggtctcaatctcttgacttcgtgatctgcccgccttggcctcccaaagtgctgggattacaggcatgagccactgcgcccggcctattttttttttttttttttttggagaaggagtctcactctgttgcccaggctagagtgtagtggtgcgatctcggctcactgcaacttccacctcctgggttcaagcaattctcctgcctcagtctcccatgtagctgggactacaggcacgtgccaccatgcctggctaatttttgtatttttagtagagacagggtttcgccacgttggccaggctggtctccaattcctgacctcaggtgatccgcccacctcagcctcccaaagtgccaggattacaggcatgagccactgcacctggctaagttttaattttttgtagagatgaggtctcactatgttccccaggctggtcttgaagtcctgggattacaggtatgaaccaccacgcctggcctcccttcttttttccatactacctaagaaatgcagtgtgtatttacacgtacagcccatctcaatcacacatggctggtggccactgtagtgtgagcacagctcttggttctgggctactccttcaggccttgctctgaactgcagtcactccagcatgaacttatctgattagtctccccttaggagtttgcttctagcatgggcacaactgtttttagcatgctctgcaatcatagtcactcagcctgcccaactgtgacccagctccccaggagacagttcatttctagcatgccctgttcccattcttcccctcaaaggagctccctccacacccctcacctctgcctggacagccctctgccacatgccatgctcccatcagcgaggctggacttggggtaaccaaagtgggagtggggccctgatgagtggatgggaggagttccagggaactccacgtgggtgaccctgggtcacctgctcccatctctccctgcatgtgccctcatcgtgacccctctccatccccagggagaagtctcattcgtggttgagcacaggctggtttaccatggtgatcgcggtggagttgtgtgaccacgtgcatgtctatggcatggtcccccccaactactgcaggtgagccctccttgccagcgccctcccaggacaacacccaggcactggccgcaggatggagctctaggggctggaaaccttggctgaaggtgcctttgagggcctctgcttcattgttttcaaactgttcttcagagatctaggcttcttctccttcctcaggggcctccactccaagctccgccagagtttatttattaataataactattagtagtagcatcatatgaaaagcccactaggggacagctatactttactgaatactgaccaggtaccaagcatggccacatgtagtctctcacttactcctcacagcaaccttacgggataagaactgttattcttcccattaattaaatgagaaaaactgaggagtatgttttatgagtagccaaaggtcctccaaacagtaggaagaggggccaggctccagtgctcacagccctcaccactgctccacactgccgccttcttagggaaaggaaaaagtgccactgcatttaaaaaaaaaaaaaaaaattggtggttacacacctagtctaccctgcacccattttatggatggggaaaccgaggccccaggaggcatggggatttctcctattgaggtcctatggtaagcgaggggctgaaagggcaaggaccctgctagcgctcaccttgccctgatgacgcccgtctgctctgtcccagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcgcctgggtcgagcacagccttctggtccagcgctgcatgcggcctcaggaccacgtcttccggttgggggctcccagtaaagcgatcctcagcttcttcagcagccagtggccagtgaggtgtgtatttttgcatcttgagtggagacctgggggctctggggatggtgggggcgtgcggagccaggcccgtctggcttttcctgtccccacctcaccctgcctgtgtgaccacgggcaagtcacttcgcctctgagagccccaattccttcaagggcaaaaggggaccagacactgccctcaaggagctcaggttccaggaggggaggagccccgtggtacactaggaagaattcccacagaagctgggaaaagagtttgagcagtgaatgcagaaggggtgaggggaaagacatcccaggccacagagccagaggtctctcagctccttaagcgtctggggacctgatggctgggagctgagatttcctgccaaacccagcaggagggagcctggcggggctgcaacgctggcaggagtgtggtgagcggtggttgccaccagcctctctgcaaaagggctgtgtactccaggttggcaggaggcacggggtctgtgactccagagattacaaactgtttgggcagataagatgccctcggaggcgaggcctaacaaagagtgactgtgtaagacatgggcaggcagcctgctgggatctcccagggtccccgagctgctggggacaggaaagagaacccttctgggcactgggccagccaggatggtggtgaccggggctgagaggcatgaatggcaccttgcatctgcctctcaattcacgtagccaataagcagccgcatgccatgcactgtattaggcacagttgatgagggtgagagtgtctggtgggaggagtggcccacagagaagcctcatggtgggatccccagcttcacccagtaggcagtgaggctacagcaggagggagcagtgagagatgagactgcccggggccagatggcacaaggcaaggccataaatgtcagtctgaggggggcaagagccttgatctttcttgcgtagagaagtcaaatgggaccacagcaggatgggcaggaggctgacaggtggcatggcgcagggcccaggggccgccagacacagtaatggtggcagtggggctggggggctggaaagattgggactccgtgtaaagtctacatggggagcagaaagccgtgcgtgggcatggggatatgggaatatggcacccatccaaccccatgcaaaggcttctgggaacctgggtccaggcagaggtttttttttttttttgagacagagtctcactctgtcacccaggctgcagtgcagtggtgcagtctaggctcactgcaacctctccctcatgggttcaagcgattctcctgcctcagcctcctgagtagtcgggattacaggcgcataccaccatgcccagctaatttttgtatttttagtagagacagggtttcaccatgttggtcaggctggtctcgaactcctgacctcatgatccacccaccttggcctcacaaagtgctgggatttcaggtgtgaaggtgtgagccaccgcatctggccttccttgtggtttttttgtttgtttgttttgttttgtttttttgagatggagtctcactctgtcacccaggctggagtgcagtggtgcaatctcggctcattgcaacccctgcctcccctcaggagtgtgaaccagggtgatctcccactcctgacctcaagggttcaagtgattctcgtgcctcagcctcccgagtagctgggactacaggcacttgccaccatgtctggctaatttttgtatttttagtagagacagggtttcagcatgttgcccaggttggtcttgaactcctggcctcaagtgatccacccaccttggcctcccaaagtgctgggattacaggcgtgagccaccacacccagccccagcagaggtttcgaggtagaatttctcccagaatgctgtggctcttctgtctgtccactggggagggggaggtcagtaagaggtgcatcaggagggggtcggttccccagggggatgttcagtggagcatcaggaggtgggactctggtgggcctagtccccaactcctcaatctctcaccccctcagtgggacccagtggagactggcccactcattgctaaagtgagcttcctgaagcccctctcatcacagccctctgccctgaaaccttcactggctccccattcactggccagctccaaacttacagacttgtctggcatttgaggccttcctgcacctccatctgcacctgcacccctctcccgggtgccttagtgaggctggtgcttcctcatctctgtgcagagggccttacccccacccctcccttgggagggggcgcctcccaccagctgcaaacctatgagtggcagccgnnnnnnnnnnnnnnnnnnnnnnnnnnnnnnnnnnnnnnnnnnnnnntctttcctttcctttcctttttagacggtgtcttgctctgtcactcagactggagtgcagtggcatgatctgagcttactgtaacctctgccccctggttcaagcaactaggattacaggcgtgcaccaccacacccagctaatttttatatttttagtagaggtgggccagggtgatctcacactcctgacctcaagtgagctgcccgcctcggcctcccaaagtgctgggattacaagcatgagccactgcgcctggctggaattttttctttaaccaaaatattttcattttaattttgttcctaaatgtcacaagctacaaaatatttttaaaaaattttttaattagtttcatttttatatgtttctgtttttagattttttttatcataaaacaaataatacaaatgatataagatagaaagggagggtattgccgagtcctattagggtataatcttccagatctttcctccatgcaattttttctttttctgagacaaggtcatgctctgtggctcaggctggagtacactggtgtgatcacggtttactgtagccttgatctcctggacttgagcaatcctcccacctcagcctcccaagtagctgggactataggcaggcaccaccatacttggataattaaaacttttttttttttttttgtagagacagggtcttgctatgttgcccaggctggtctcaaactcctgggctcaagtgatcctcctgcctcagcctcccaaagtgctgggattacagatgtgagccacggcgcccaggcttcatgcaattcttttttctttcactattccagtttttctctccctttcttttttttctttccttaggttatacctgggaaataaaattctgaaacgttaatattccagaattggtagaaaatccatagttcacatgcaaataaaacggatacttaaaattgattttttaattttaaaaatttatttattttattttaaaaattgtggtaaaaaacgtgtaacataaaattaatcatcttaacaattttcacactctgttttggataacagagctccaaaactttgtcattttgcagatctgagactctgtacccattaaacagcaattcttccttcctcattctccccagctcctggcaaccaccattctacttttttttctatgagtttgactcctttagatacttcaatgtaaaggaatcatacagtatttgcctttttgtgatgggcttatttcacttacataatgtccccaagatttatccatgttaaagttattttttaatatatataaagtaatagacgcttgttgtatggaaaagcaaaaatgcttgggtggctgggcactgtggcgcgcacctgtaatctcagcactttgggaggccaaggcaggaggattgctggagcccaggaattttaggctgcggtgagctataattttgacatagcactccagcctgggcaacaaagtgagaccctgtctctttaaaaaaaaaaaaaaaaaaaaaaaaaaaagcgtggggggctgggcacagtggctcacgcctgtaatcccagcactttgggaggccgaggcaggcagatcacttgaggtcaggagttcgagaccaacctggccaatatggtgaaaccctgtctctattaaaaatacaaaaattagccgggcgtagtggcacgtgcctgtagtcccagctactggggggtcttgagaatcgcttgagcccaggaggcagaggttgcagtgagccaagattgtggcactgcactccagcctgggcaacagagcaagtatccgtctcaaaaaataaataaataaaataaaataataataataataataaaatgccggctaggcacggtggctcacgcctgtaatcccagcacttttggaggccaaggccagcagatcatctgaggttgggagttcgagaccaacctgaccaaagtggaggaaccccgtctctactaaaaatacaaaattagccgagcgtagtggcgcatgcctgtaatcccagctactcaggaaggctgaggcaggagaattgcttgaacccgggaggcagaggttgcggcgaatggagatcacgccattacgctccagtcttggccacaaaagcgaaactccatctcaaaaaaaaaaaaaaaaaaaagaaaaaagaaaaagaaaagcctggggaagcctttaagtaggaagtggaagtgtcatctccagccaggcggtcataggcacacacctgccttctctgtcctgtttcatttcacccactctaagatgttgtcagtttgattgtaagacaatgtaattttaactttgtagagttacggtgcaaaaaaaaaaaaagtctgagaatatattttacacacacacacacatttgcatgtttagagtcttttttaaatttactacttttatttaaaaaaaaataggggccgggcatggtggctcacacctgtaatcccagcactttgggaggccgaggcgggtggatcacgaggtcaggagtttgagaccagcctggccaacatggtgaaaccccgtctctactaaagatacaaaaagttagccgggtgtggtggtgcatggctgtaatcctagctactcaggaggctgaggcaggagaatcgcttgaacccaggaggcggaggttgcagtgacccgagatcacaccattgcactccagtctgggcgacagagtgagactccatctcaaaaaaaaaaaaaagaaaagaaaatacagacagtgtctcactatgttgcccaggctggtcttgaactcctggcctcaactgatcctcctgtatcggcctcccaaagtactgggattacaggcgtgagccactgctcccagcctccagtcatttttatgcaggtgggatcagaagagtgcagtggggctttttgcctatttctttttttttttttttttttttttttttgagacagagtttcgctcttcttgccttgttgcccagtctggagtgcaatggcgtgatctcggctcaccgcaacctctgcctcctgggttcaagctattcttctgcctcagcctcccaagtaggtgggattacaggggcgcaccaccatgtccagctaatttttatttttagtagagacggggtttcaccatgttgaccaggctggtctcgaactcctgacctcaggtgatctacccgcctcaggctcccaaaatgctgggattacaggtgtgagccaccgcgcccagcctttttgcctatttcttaccaatgctatgggtgtctgaagcctcttgtcccattaaccacaaacaacttggacttcctttctcactcagaccctatgggaaagttgctaactcctcacccaccgtggctgtgccatcatcccagtgagtccctgctggcactttaaaactttcctatgcaaatttgtgcccacatgtttccttgaaacaaatttcttaaagtagaagggcgcatttgaagactgtgtgtgtgtgtgtgtgtgtgtgtgtgtgtgtgttttatttttagagacgggatctcgttatgtttcccaggctggtgttagaattcctgggctcaagtgagctcaagtgatcctcccacctcgtcctcctgaagtggtggggttaacaggagtgaccattatgcccggtccatttgaaattttgatttactttgtcaattgctttccccaaaggtgccaatgcacacacccttgagagggcctttcaaacagcttctaatgcaacacctctgaccccactgcacctgcccccccacagatggggaaactaaggtcccaagaagtaaggacttatctgacatcacaggtagcagagacccaggcctcctggtctcctggctgctgtggttgctgaggcaccaccactgaaggtggtctcaatctcctggtagtctcactctcttgctcaaatacctcctatggctccctagggcctataatacaaattccaagttcaacccacctcaccatctggggctgctgcctgggctcccatccctgcccggctacatcactgagcacctactactatgtgccagtctccctgcaaaacgctggataaacacgtggctttctaccagggaacctcccgcaaggtatttgacatgctcgcctcccgttctctgctgtgtctaaggattcacagatgcggctggagtctgctgcttagcacagtgagtgctcattatgggagctattcttcttatcaagaccgcaaatcccctctctggctatccacagccttctgaatgtcccgggcaactccaggggagcagggctggttttctataatcttctaccttactgggtggtctttggggtcctggcgggttccagtcccagaggagctcgaagggtccctcccaacaggggaagaggagtcccaggtgggtctcggccagggcctctgggcaggctctgagggcgggcttggggactgtggccagcaaagcccctgagtcgatgcctcagccctctcgctccctggtctggcctctctctggcaccaatgcgctgtgggattttgcggaaagagccgctcttctctgagcctcagtttctccagctatcatagggaaagcctggccttgtaccctggagtgtaccttgagcacagtcggggtatcgcaatggaaaactcttggcaaactgtaaagtgtagttcgcgtgtgtgggcacagccacctgggggtccacggtgcggggcacacggtgccgggtgcggtgtcgccgcgcacccgggctcgggctcggtcccgccccgcttcccggtccctggtccgctctccctccctccttcccgccctccctgccttcgggaacgccggctcccggcatgccgcgcgctgacagccttataaatagtcgcctttgccggccgccgcgaggacgggcagggcacgcactggccccggcgcccacccgcacccctccccaggtcagtgcgtgcccgcgcgtgtctgggggggcgcctctgcggggaggggcagcggcaccgggggagggcgggggcgtgctggtgcggggctccctgggggctgtgcggctgtgtatccgtggttgtgatccgtgtgtgtttgcgtggctgtgttccccgggcgctggggatctgtgcctcgctgcctgtgcctttgtggatccgtgcgtgtgtgtgcgtgtgtgtttgtgtgtgttgcagccccttccagcctccgagatagtcacccctttgttctggctggcactcccggggctccaggtcactgcccttggcatgtcccagcttgggcccagagagggagagctgtggcctggctccctgccccagaggacctggacaggggcagcctctgtgctccgtagggctatcgtgtcactccacttctagtgctgggtgcattggagaacaccccctggatgctcagagcttgccctagcctcctgaccagggccagcgcttggggccttcccacagcactgctcagtggccgcctggtactcctcagcagcagcaggacaggcccagagaggggacaccaactgcccaaggtcacacagctgagtgatggagctgggattcgaaccctagtcagttgccacccactgggaaccgactacgttgggtcagaagctgggagacctgggcttgccttggccttgtcttgtgattggggttaagtcaccgtccctctgggcttcggccccacaggccccttagcagaccatccagtcatattaggagtcgctggggccttgacccaggggccttataaggcctgggtgcttagcccgtaacccaactccatcctagacccctgtcctctgtgaggcctcctcacgacccaagttattttggatcaaggaagtggcaggtgccatcagggcggagggggcttagattaccaggaggggggcggggcagggcggggtcgaggccacttctcagggcttcactgtggttgtccctggcccaggacgctccccctcccatgggcagctgctgaggggcacttggcagctcctacccccgctgaagcacactcagcaggaaaagtggctgccactcctgcctggggcagcaggggcatcagcaaagccacttcagctgctactgggtgccaggcccagcgtagcagaaactcagggccgagttggaccctagctggccctcgaaccagtctgtcctcctccccatgcctcagtttcctcccaagatggcagtgaggatggaacgaggctccccagccctgtgctcagcccatgccaggcccagtcaatgggatcccaggcccgcagcacagaagaggggcccagtacagcgtggttgtgcagtgcagggcaggtttccaggaggcacctgccagtgtgggagtggagggcagagtccaggaaggcttcctgaaggaggtggcacctgagctgagtcccacacaatagcaaggtggggaaaggcatccaggcattgggtacaacatctgccagtggcagctgatagggttgcagagggcagcagaggtcagctcaccgggacctatccactatgtcaaggggcccaggctttgtctgggagccgagagggccacacatgcaaggttgtaagcgggtgtgtgatgtggtctgatacttgccagagaaaatcctgcaaattgcgtggcagggtgtggaggcttcaaggcccatgtggaggcgggggcagtggcccaggccccttacttagcacaggacatagtggtgaggagacagacggagagagcctggggaggggagggttgggcagtgggtgtgcagggctgtggagaggagagaggagccttcacactgactcagcctgtggcttggccataggggcctggagctgggacttggggagggctgttcagagcctgagaagcctgtggggcttctggggcctgtctcgggggcatggatgtctggggctggagagaaaggcctgggctgcctgcacagggatgggggtccttggagcctgaagccaagtagagagggtggtgtgggtgccttgggtggaggtcccggtgcgggtggggtcgctggctggaggtcaaggctggaggggagtgtggctgtggtggttgcgagtggccttggggagggctggtggctgggagtgaagaagtggaggccaaaggtgtccagagggcagttctgagataggggggcgaggtaggggaggtcctgggggctgtggcagcacagggtggggtcgcaggtgtgattgggctcatgggcaggctgagggcaaggtgggggcagtaaagccaggtcctcaaagggtgggggtgcaggggacatgcgtggggctggttgttgggcctgtagaggtgaagagcctgggaccgcctcactttgacaactgtaaagggctgtgttcatgcgagcggctcctgtagattccttcaccccaggcctctgtcccttagaggatccccatccaaacctcatcccagacacacatagttcctggccacctcccacctcctggcagcttccctctggccctggggagcgttgtcaaggtgtctgggcagacgctggccccgcgccctgttttctgggagtttcgaggggagcagctctgcagttgtgtggccgctgtttatgtccctcgtgccatcctcactgtcccagcccctccagcgggaacccaggtggatgggagggggctactgcccttctgtgacaggtgaggccatggaggccagagaggaaaggtgacttttccaaggtcactttcccaaggtggctttctcagggaaggggtcctgggccttccctgcccccagcagccccctctgccctcagactgcatgtcgggcctggcacacaccagttgccttgggtgtggcttagtggaaggtgagtcagggtgaggaggaaaatccctccccaacctgtgcccttgtcttacagagcactgacacggctcccgggacctcggcaggatggaaggtatgagcctcctctccttttgcccattgcctgggcctcagtgtgcctgactattaagggggtgcgctctcagggagacattctgggaggggttggaggaggctctggggctgccggagggggcctggctgggagcctccagtatcctcctctggcctctcacgggatgtgccagctccaagattaattttagacgtgacgaggcctccccaaggctcctgagggccccagcgcacaccccctatgctgggtttatagagctgagaccctgccccatggagaggccacagatacacaaaacaccaggtctaatgaggacaaggcaattccccgtacctctccgggactcagtttccctatcatccagtgagggtgggccttgaggaagtcttggaccctcctagttcctatgggctgggacttagagggagacacgggcaggcagagagtccagaacgggcccgccctcagctgctggcagcaccatccgtccagttcctggcactgtgccttggcctgggcagctcttaaagacacccagcgggcctgctgctgctgctgctgctgctctgcctgagctccaaatatcaacagccatagggctgcggccactgcacccccgggataggggcccacaggaggagcccttcttgacagctcctgtagggctccagccttatggctgggagggcccctgggagccgcccagcccacctcctccctggggaaggggcagagaaccagagaggggcaggcctttcctaagtcacacagcaaggtgggatacagcctggtcctctatttccctgggaagcgggggagcctgaaagcccagtggggagcttgggttctggttttggttctgacatcccttgagcaggccttccctctctcgagctcagtttccctctgcccagtggggctgtggccttgctgggatctaacagcaggcaggacgagacagaggttggagccaagctcaccgccctctctgggcaagagttccacatgcccaccacagccctccaccccggcaactgtctccatggcaacatatgttgtggttgctaagcccccactgccgggggaggcgggtgatgggccggcccagggcctgagaggggaagggcagggtgcacaggagacacggcaggacgggaccatgggctgctgctcctcgagtgacccccgcagagaagacgatctgagagccagaggtgaccggccccggggtccaggcacccacagggaggcgccatgagggctggcggcccagcccgctggctgtgtggagagtacttagcctttaggcttttgcctctgcccgtctggctgcctggagcaccctcccttccctgacctctcccaggctccgagctcactcacatccctgctgactctgggctgtgacttgtctgcctccctgacaggagcgccagcggtgtctgtccctccgcctggggcccagcacaggcctgggactccagaggtgcctctggctgtgggtccagcgagtgactgagccctgctccccttttctctcccgcagagaagctgaagaaaaccaagatcatctttgtggtgggtgagttgcgggcaggcgggtggtgcagcaagggtcttcactggcactggagggagcccgggcctggggctgcaccctgggctctgcccctccctctctgggagaccctggcagcccctgttcctcctgggaccctgtgtctcggggtttatgaatgggtgggcgtttgcaggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggtgagtgggccctggtggggtgagaggcaggggatgacagtagccctgagtgggtgtcccaccagcagcaaagcccacggcacacaggcaaagctgaccgtaaccgcccccggctccaaacccttctgtggttccccattgccctggacagaaagttccttccagaagctcccaagaccttgcaggactctgccctgcccccaactctctcccttccctccatccttcagccaccctggcctctgtcccctcagactagccatactccttccagcctggaatattctttcctcttcagctttcagacttccctaactccccagatttggcctaagacctccccccccaattttctactccagaagccccacttctctgcccgtacaacctgtgccatgcttagaaatggagaaatcatctgtggaatgtgtctgtcccctcaccagcccctgagctccccagggcagggaaggcctaattggtccatggccgtgtcctcgggacccaggacagcacctggctggaaggagggtctcagtgaatactgttgagtgaatgcatcattcattcattcattcactcagtccaggtctccacaattccgaggaagcttcctggagggggaggcttgtttgggacatttgtgttggggagagggcatttcaggtggcaggagcagcgtgagcagaggctgggagaagggatggggaggagaggctcatggccccttcctcctttgctgtgccccaggagacagtgttggacatgctccgggatgccatggtggccaaagtcaatacttccaaaggcttcctgattgatggctacccgcgggaggtgcagcaaggagaagagtttgagcgacgggtaaggcactgacccaagtggggatcctggtgggctggggcaggataagactcccatccccatgggcgggcctgcgggggctgtgatgcaggtcagagttctgagcagaggctgattcatggagtgtgggtgaggaggaaaaccaggaagactttctggaagtgtagaagaaaatgtgtagaaggggaagcgccaggaggggcagttgccaaacctgggctcagattccagctcaacggcttgagatcttgggccagtcattctgcctcctgaacctcagttttcccatctgcaaaatgcagggagtgggaggaccaggtcacagctgccttaagggacagtgtggggactggagaggatgtgcccttccagtgtgggccttggctccctataaacacacagaggggcagggaacagcactggcagggctggaaaggcaaggccagtgtggggagaacagaatatgtgggcaggacaacaagggaggttccagcctggctggaggctgcaaatgccataaagggacatcagtctccttccaggggtcatgaggagcctggctggaaagagcaggcctggaaaatgatggccctgagcttcctagcacgagcatcctgcagatacaccttccccaggatggggcaccccacacacgcacacacgtggacgcttgcacatacacatgcacaagccccacaagttcatacacacaaggccaggggcatgtgcacacatgcacacacacggcagtggatactgcactcctgcacatgcatgtcacggacgcagcacacatatgcaggaatgcacacgtgctcgcacacatggccctgtgcacacacatacacttttacctcggtgtcacaaggctgtatgggagaaataaacgggactgcaagggcctaggagggagaggtcggcaagggctagggggagcctaaccagcatcctggtgggctggggcaggataagactcccatccccatgccccattcccatgccccgtctcgtagggccttctgggcttccgtagcttccagcctcatctggggataggaggccatattttctgacctccgagtggctgcatgagtggctgcaagacctcaggaaagtgtctaccccactctgcccctcaccttccctatctgaaatgggggttagctggattccttcagacctcagacccctgaccctgtgttaggtgccacagttctgaaagatgtcctggcctggctcacacataccagctgtgtggtaccacctgtgaccctcagggccacatctagaaaatagagttaatgaaagtcggccgggtgcagtggctcacgcctgagatcctagcactttgggaggccaaagagggcagatcacttgaggtcagggtcaaaaccagcctggccaacatggtgaaaactcatgtactaaaaatacaaaaattagccaggcatggtggcgggcgcctgtaatcccagctactcaggaggctgagacacgagaatcatttgaacctggctggacggaggttgcagtgagccaagatcacgccattgcactcaagcctgaacaacagaatgagactccgtctcaaaaaaaaaaaaaaaaaaaagtccccacccttccagggctgttgtaggtgccgctgagggccgcaggctcagccctggtcccatccctgctgtggcctccaggtgtccgggcagctggtcttcttggctctggacaccagggggcgccagggcttcaccgaaggagggagggtcagcctggaagtgtggccggctcacacccaaagcttttctggagactggcagtgcccgttgtggactccccgggctagatgtccattgtcctgacagggagactgaggccccacagccagaatctcaagcccagaggctgagctggctctcccagatttaccacctctgctgggtgtgtgtaaagagcctactgtgcttggtcctggagacccagatgaaccagagactgtgagtctgtgccctggaggagctcagcagctgatggatgatgatggggggtgggtgaccttgaagttgaggtcagactgctgcatccaggcccagcctttgcccccatggtaatctgtaaggtagaagcagccgctgggtggtacggagtcatctccctgaaggcagctgacgctgtcaccctgaatccttaactacggaggagctagggatgagcgctaggatgggtatcgcaggcgaggacaaagggcttgccccaggtcacacagctgaacagaggcaggggtgagcctgggtccaggtcagtctgacgccggaggtcaggctgcttctcgcctctgtccagctgtgtggccttggacaagcctcttggttacacagctggacagaggcacgaaacagcctgacctgagaggcagtgccccaaggccttgacaggggtccagggccaaagctgcgcagaaacccttgggggctggcccaggcagttggaagcaggagacagggtttgaaggtcccaatcccattcctaaagctgtggcagtcatgggtgactctggggtggctctgccctcccaaccaggcagctgtggtagctggattgagcgaggcaggggctgcagaaccttattcctcttgcctttccaaggcgtcccatggatgacatggatgacatgctgttccaatgacacggacattgctcagaaccccccaggactcagcagcccctcaccccttccctcatcccttgttcctttgtcaaaggaccccagaattgtgagacaagtgcctccctgccctcaggggcccttgggagacctgcttaaggaaagataaaggcgctggaagagcctgttccaggaggcggggagtactggggggcggggggtggcatcagagagactgccctgaggaagtgagcttcgcactgaaacctgatgcttggtattgaggtgaaggcgagttaggatcaggctcgggggagagggctcctagcagagggaacagcatgagcacaggtctggcatggaaggaggttgatgagagcctagagcagagagagtcaggctctctcagtctggcaagtagtgtggactttctcctgagggcactggggagccatggtgtaggtttgagcaggggagtggcaggaaagattggttttaggaaggtctttcaggctgccttggggaagggattgaaggtctgagggggtatctactggggcttcatagatgggaagatggggaggagatggccctagggggcaggaatggggtccctgtgacatggtgcccgcctgcagattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtgggccccgcgggcccaggggcagctccgggaagaacgggttcctatgtggctccgcctcagctcactgtgtggcctcaggccagcccctctctctgggccttggtttccccactggttcaatgaggggctgctgtcaattaggttgggctcggggaggcaggcctggtctctggggcctgccatggtgaggcccaccccactccacctggtgactcagccctcacggcccatctccccacaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcacctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgcgaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatgaaagaaataaacaggagttcagcggagctagcagaagacaaggcatgtagggggagccattctgtcccagggaagttgtggagggtaggggctgtgtggaggcctctgcagctggtcctcggttttccgcatcggcagaaaactgatggggcacgcagggacaccgcaggctccaggtcctgggtcctgcatctgtcaaaccagattcacacacacacactcacacacgccagcgcgcgcacacatgcactcacacatacacactgatccacacacttgcactcccacacacgcatgcacacacacttttacacacatgcatgtgcacacaaaccactcatccatacacacatttacacagtcacccacacgcactcacactgacccagacacttgcactcccactcacacaaacacacttgcacacacactcattcacacacatttacacatgcacacattcacacacttgtacacacaaaccactcacattcacacacatctgcacactcacagtcatgcagtgcacacaccacacacgtgcacacaaaccactcacattcactcttacacgcacacacactcactgtctcacacatccattctgtctcaggatgaagacaaagtaataaagataaggaggcggtttggtgggggggtcctagttctttctcatctaccttatctttattttgatcacagcttcattcatccgggtgagtcccagtttgtgaaacctaagctgattcaaattgtcaaacgattcaccacagaatcactttatccacgtaaacaatacctacctatcatctctctccctctctcatctgtctagatgcagatatcctctttgctgaaaacttggaaacgcaaaaagttttaaagccctgggaaccaccaccccgtccttgccaccgtaaaccttcctttgggaatttctttcatgcatgtttgcttgttctgtagacattgctggagcacccgccgtgccagcgagacagaggcttagaggcccctggcctgctgcgatatggctcccagcacgaggagaggcctctgttcgcaacatcccgtcagacccactcaaccaagaccagttctgggcagctgagtgcaccaagctcagaggagacctagtggtgggaggttccttgaccagagttctggggcagggccctgaagacacctgggagttcgccacaagacagagggcaagaaaggacagagggaacagctctgcagagccacagaggtggaaaggacctgtgggtgttgggagagctgagaccgcagaggggggctgtaacgcaggctagcggggtggcggtagcaagagacaaggctagcagtgtacgaaccagactcacagggtttctcataagggcaatgagaggctaagaaagaggtgttttttggttggttggtttttttgcaacagagtcttactctgtcacccaggctgtagtgcagtggtgcaatctcggctcactgcaacttctgcctcctgggttcgaacaatcctcccacctcagcctcccaagtagctgggattataagtgtgaaccaccatgcccagctaagcagggtttcaccatgttggccaggctgatctcgaactcctgacctcaagtgatctgcttgcctcagcctcccaaagtgctgggattacaggcatgagccactgcacctgaccaagaggtgtatttttgtgtgttttttgtttgtttgtttgtttgtttgtttagagacagggtcttactctgttgtccaggctagaatacagtggcacaatcatagcttactgcagcctcaaactcctgggctcaagtgatcctcttgcctcagcctcccaagtagctgggactacaggtgtgcaccaccacacccagctaatttttaaaatttattttattttgaaatggggtttctcagactcttgagctcaagtgatctgcccacctcagcgtctcaaagtgctgaaattacaggtatgaaccaccacgcctgggttaatttttattttttattgtagacaggggtctcagtatattgcccatgctggtattgaacacctggcctcaagtggccctcccgcctctgccttccaaagtgctgggattacaggtgtgagccaccacatctagccagtttttgttttttgtttgttttttttttaacaaaaattggaagaaaatgtatactgaacacccgtatacccatcaacatttagcaattgttaacattttcccatacttgcttccttgtttaacttttgccaaagtattgtatttttatttatttatttatttgagaccaagtctcactctgttgcccaggctggagtgcagtggcgtgatctcggcttactgcaacctctgcctcctgggttcaagcgactctcgtgcctcagcctcccaagtagttggcattataggcacgcaccaccacacccagctaatttttgtatttttagtagagacggggtttcaccatgttggccaggctggtctcaaactcctgacctcacctgcctcagcctcccaaagtgctgggattacaggcgtgagccaccatgcctagccttgccgaagtattttaagtaaattacaaatatgagaaaaatttacccctaaagtatgaccaaagtctgggcactccactgcaatccagcctgggcaacagagtgagaccctgtctcaaaaaataaataaaaataaaataaataaagtatgaccaaaaataagaacattttcctaaataaccacaattcagagtttcaataacactaaattcagactcttgccactctcacacacactctcataatagctaatagcccgtgtgcaattttccccagtgtctgcaaaatgtgtcttatagctcatttgttgaaacttgcatgcaatccaggactgcacatcgcatttggttgtgatgctcatcagatcttatttatttatttatttatatttttgttgcgacagtctcgctctgtcacccaggctggagtgcggtggtgcaatttcagctcactgcaacttccacctaccaggctcaagtgattcttgtgcctcagcatcccaagtagctgggactacagacgcgcaccaccatgcctaattttcgtattttcagtacagacggggtttcatcatgttgcccaggctgctctcgaactcctggcgtcaggtgatctgcctgcctcggcctcccgaagtgctgggattacaggcatgagtcattgagctcagccaagatctcttttaatctaggaccactctccccctctttctgtgaaggaaccagctgttctgtggagaattcctcctcctacattcacctgtccctccttatggtgttgtttaacttgcacctttatccttcaacatttctgtaaactggaagttaattgtaaagtcttcgtagattcaggttaagcctttgggccacactcgtgacgggttttaaaaccagacaggaaggttagatctgcagcacttccagctttggtgcacgcacgaatatcccggggtgggggccttgtgaaaaagctgattctcattcagcaggtccaggttaggtggtgacgcccaggctgccggtctacggctgacaccgtgagcagcttagggagatcctgcttggcggagggagggccagagggggtccggtggaggcaggagctcagggaggagtgtggaggaggaggggacccctccagggtcagtgagtgctcacccccactggtggactgagagttgggcgtggtgttgggttggataacgtcaatgctgtcacacgcttcttatctctagggacactccaggcagtggcttgtcccaaggtgctggaacattctgaccagccagtgggattagagcctctataacctgggtgctcccgggcaggactcacttggtagtggcctcagatgacccctgctctccccccaccccccgcaaagactgtgcctccaggtcttggcctcgagggccctgagggcctgggccggaggcgctgaagtgggagaggaaggaagtggggagcagaggaggccaaggctgtcgcctcccagccgctctaggggcctcgagtaaacaggaaggcctggcgactccgcgagggggggctttagaggagtgggggccaggagccctgttggacacgtgcagcctgtgcgcacagggctccctcactagggaagtgggcccagagaggctgtgtggttgggcccagagaggctgtgtggttggccccaggtcgcacagcagcaggggcagggggtgagaccttctccctgtgcccaggggttctagtgcgtgggctcctgcatgggttgccatggtgggaatatacactgaaataataataagccaggctcagtggctcacgcctgtaaacccaacactgggagtgctgggtgagtccctttccctcttgggcctcagtttctctttctatgagctcagagcccttaccactcagaggttctagaatcctggcccagtggaatcctctgtctcctaggggggtttatgggttctttagctctagggggtgtgtttcatcaggaaggccaatttcacccaggatttggaggctccagctcccagggccccttccttggggaaagagagggtgactttaagggactctgctcttctagaacagagtagggtctggcgggacgtgaccaaaccctactcttggggagtcattccccctcttcagagaccctgtccctgcgctcagaatgcccccaacacccataccctggggactcaaatcatcgcccgtgagaccttgagccgtataacccagtggccaaacccactcattgattcacaagcttcttcagcacctgccaggccaggcactactcctagtgatggggattcagcagcaaacaaggcagaaccccggtcctcatagaacttctgttctggaaaggaagacaaatcaatcaacaatatctagtgtgtcagccgggtactgtggctcacgcctgtaatcccagcactttgggaggccgaggatggtgcatcacctgagctcaagagttcgagaccagcctgtccaacatggcggaaccccgtctctactaaaaatacaaaaattagcaaggtgtggcggcgagcacctgtaatcccagctactcaggaggctgaggcaggagaatcctctgggaggcagaggttgcagtgagccgagatcatgccactgcactccagcctggacaacagagcaagactccgtctccaaacaaacacaaacaaacaaaaaaacaatatctagtgtcagatggtgccatgtgggcccattgctagtgggaggagagggctgttttaaatgcgctgctcaaggaagacctcgctggccgtgtgacatttgatcagggatgagggagcgagccctgtggcgacctaggggaagaatgtttcagcgagcagtaacagcaggtgcaaaggccctggggtgggcgtgtgcttggcacatttgagaaagagcaaggagctggggtggagtagggtggaggcgagcagaaggggaggctgaagagggggcagggagaaactcattggcctgaggggctttggctttgactctgagggagacgatggccagtggagggtgctgagcagagccaggacggaattggactgaagctcccgtgatagcggagaaaaggctgggggcaagttggaagcaaggtgggctcagtgcagggactggggactgtgacattccaagagggaggtggctgtgggtggtgagaagcagccatattccacggtccctgggaatctgagggagggcctgccagatttgctgtggcttggatgaaggcatgagagaaagacccaaggtcaaccccaaggcttgtgtagtaggaggaggtcaaggtctgagatggaaagactgaggcaggagcagtttgcagagaaagaacagagcccagttttcaacgtgtggagtctgagatacgacatccagggccctggagccagggggagttctggctggagacatacagtcgggagcccttgatatctagatggtatttaaagctgttgtctggacaaggttgcctggaacaggccttctcaaacgttgacgtgcacacgattcccttggggatcttgtgaaaacgcaggttcggatccagcaggtctgggacaggacctaagagtttgatttctttttgttttttttttttttttgaaacggagttttcctctgttgcccaggctggaatacagtggtgtgacctcagcttgctgagatcaacctccgcctcccgggttcaagcaattctcctgcctcagcctcatgagtagctgggattacaggcgcgcgaccccacacctaatttttgtattttcagtagagacagggtttcaccatgttgcccaggctggtctcgaactcctgacctcaggtgatccacctgcctcggcctcccaaagtgctggattacaggcgtgagccactgtgcccagcccttgcatttctttttattaaaatgttttcatttttcatttttattatttatttgagacagagtctcgctgtgtcacccaggatggagtacagtggtgcaatctcagctcactgcaacctccacctcctgggttcaagagattctcctgtctcagcttcccaagtagctgggattataggcacccaccaccacacctggctaatttttgtacttttagttgagacggggttttgccatgttggccagtctggtctcaaactcctgacctcatgtgatccacccaccttggcctcccaaagtgctgggattacaggcgtgagccaccacacccggtccttcattttttattttttagagacaaggtcttgctctgtcacccaggctggaacacagtgacgtgatcacagcttactgcagccttgaactcctgggctcaagcaatcctcctgcctcagcctcctgagtagccgggactgcaggcttttaccactaagcctggctcaaatctgcatttataagaagcttccagaagaaacaagaccacactttgagtagcaacagtctagggcatgacattttatggccgagactcgttggtgggtaacaaaaccaacagatgagcttgtgacgagtagtgaaagaaaatgcaacaggttgggggttactggagggcatcacagccgcaaatctatctacaggaccacaaaatgcgtttccattatttgagtctgagtcccagggtctgtgttgggacgtgacaccagggtcacaaaggtttgcgaaaacctggcttgggagtgagggtaaacaaagaaggaaggggccagcaaccaagcctgggggaacaaggaggaaccagggaggagacagataaggtgaccagggaggtgggaggaaagccaggacagaatgttctggaagccaagggaaaaaggcctggatttcaattatcctctgcctcttcccagccctgtggccttgcaaacctgagcctcagtttcttccatcgtaaaatgctgacatgacagcctcagccactgaagtggctgcaaagtggcacttggcacagggccaggcaagctcatggatggtggtgcaattccaattcttgtcttgccctttgaactcctccagaccagcaggctgccctccccttgtgcagatgaagaaactgaggctcagaaagtggaaagatctggctgggtgcggtggctcacgcctgtaatcccagcactttgggagggtaaggcgggtggatcacttgaggtcaggagttcaagaccagcctgggcaacatggtgaaatcccgtctctactaaaagtacaaaaattagccgggtgtgatggtgcatgttcccagctactcgggaggctgaggcaggagaattgcttgaacccaggaagcggaagttgcagtgagccaagatcatgccactgcactccagcctgggtgacagagtgagactctgtctcaaacaaacaaagatcctgcctgatgccacctggccagtgtagggcagagcctgggcaccctgctccgccctgtgggtctggccctgctgttatcaatggcccctggctccaggccagtgctggagacagtcagccgcctggtgggtccctgggggccgcctgaaattccttcagtggccagtggccagggtggacgtgctctgtcttttcctgcagccctggccttcctggccagccaggaggaagaaagagcagaaagtgtgcatctgccctctgtggggtccaggcacaggggcctggccatcagccacgcgtctctcgggcgtgtggacagacggcacctgaacacatccgtatcagtcaaagccccggcaggaaacagatggcacgttccagtaggatcattagaggagagtttggtgaagggtctgtttacacaggtgtggtcggggtgtagggaagccccaagggacggtgcagaaccccagggctggcagcggcgtgggctgtgaccaccctcagcctgaagaggccaggggaggagctgagtccacagctggacagggctgggtggagggggtccccaacaggaccgtggccttcagtggagggaggccaccagtatgcagtgaccctgcagggaaggggctggaagacggaccctcctcctcctgcctcctctgacctctgcaggggtggggaagtggatgtgtcccacaagagggagagtgcagctgggggatgtagaagacagctaccccaaggcctgtgcccagcagggaggccatgtggccaccaggcttcctcgggcaggagacccagtccaggactggccttttctcctgggaaccaatgacaaggcccacttctctgggcctccatgacccccacccctgccttgacttctagggtccctcatgctttcagcaaatccatctcaagagctgaaaggccctgggctctgtgctggggacacagcagtgcaaagggtgtcaaagtctctgccttcatggggcttctaatcaagtagagagatacatgcagatggctgcacacaggcttaggtgtgacagggaaggtcaggatgctgtgggagccagaggtgacttccgcttcaccccccacccgcggtggtcccaatctcttccttcctccatgaggtgtctggggtcggggccccagttcttcctggagtccatctggagtctctcctactttctagagaatccattgggtcttgtttacaacgtggatggggacagactgtgcagcgtggagggaaggggagggagggagttttgggaagagcctcctgtggggtccctgtcactgccccagatgcccccaacaccctgtgatacctgcagcccctgccacatctgtccctcactccaaactcagctcaggggatggtggcagggaaggaggtgagcttggacccaggcagccctggggtcaccaccctccagctggggttcctcctctgtaaagtggaggtataacggtacccacctcctggggtggctgtgaggattcagagctgataaggtgaacgcctagggcgggccctggtgcagagagagcgctcagctcctagggctggattaactgtccctggggcacagatctcggtctggggcctgtggaaacctcagagccacccctgaacccccaccgagccaccctttgcctcgcagtgcccatggcctcgtctccgaggttacaggaaaaggcagaggagatgcccttctcagggtggccctctgggagaggacactctcccttgacctcaaagccacgcttggctgcaaactggccaggcagccacaaggctgggcaagcagaacgatccctaatccccacccaaagagccacaccgaccctcccagccgctgtgacagctcctgcagagacaaacacacggcctactcttgtcacccgggccggccaataagcacggagaggcaaggcctcagaccctggacagacatcctccctccagaggcacccagggcctcagccttctcctccctccctgggcctcaatttctccacctgtgacccagggcaggtggatccagggagaagaaccttc

SEQ ID NO: 809 - DNA, 2497 bp, Homo sapiens
gggccggacgaatgtgtcacctacatccagaatgagcacagtcgcaagggcaaccaccaccgcttcatcaccgagaaaagggtcttctcatcgtgggcccagctgaataaacacacctacgctccggcttcgtgtcctgtgtcgcctgggtcgagcacagccttctggtccagcgctgcatgcggcctcaggaccacgtcttccggttgggggctcccagtaaagcgatcctcagcttcttcagcagccagtggccagtgagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcacctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgcgaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatgaaagaaataaacaggagttcagcggagctagcagaagacaaggcatgtagggggagccattctgtcccag

SEQ ID NO: 810 - protein, 194 aa, Homo sapiens
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 811 - DNA, 55544 bp, Mus musculus
  misc_feature (1)...(55544): n = A,T,C or G
ctgctctgcctctcatcttacttggtcctataataggacaactatcctgatgaagttcctccttccaagtcatcctctggcttctcctggagtccaagctgctttctgcactgctgttcctgcatacccacagctagctagggaggatgtaagtgctcaagtttgagccttaagaacaaggagttcttgtaggtagggcccgtgggagggtttacagccaggcaagaaggtctgacctgcagtttttccagcataccggaatcctgaaggagcttggggaaagccggttggctaggcattgcgctgcacacttgtaaacccagcccttgggaggctgagacaggaagacatcacgaatgcaagatcagccagggctacaagaaggaacaccagacctagtgcctggagagatggctcaatggctaagagaacctttatagaggaccaaagttctgtttcagggacccatgtgggaaggaggggatgagggctcacaattgcctctaactccagctccaggggaccccaaacccttctggattccaagagtacccacattcatgtacatgaacacacacatataaaaatagtatttttttttttttttaaatcagggctagggctggggctacagttcagtggactgaatgtttgtgtagcacacaaattctgggtttgatccccagtgctgtgtaaactcgacatggtggcacatgcaagtcattgtagcatttgagcttagaagcaggaggaggagaaatataaggacctaggagcctataggaagtttgagggtagcctgggctacatgagagcttgtctcaaaaaaaaaaaaaaaaaaactaattaaaaaacaaagcaggtcaggtgcagtgatggcttccaggcagctggccgccaggtcacactgccgtcagctcaggaaaaccagctctgctcttcagcggctgaagcagaggtcagaggaaggcagtagcctgctggtgcggagcagggtcttctctggcgtcactggggtgtggtgggcatcagaaggtcaccgatgctgtcattgtcttctggtctctagggacattccaggcagctgtttgttgcagtgtggggggaatgttctctgtagcttgtaagattgatgctgctatgcccagagagtgtcagagaaagcatgctgcaggcaggcattgcagggggcggggtggcctcagatgcctcccctggactgcacccccatgccttggcctcagggccccctgagtgcctgggccggaggcactgaagtgggagaggaaggaagtggggagcagaggaggccaaggctgtcgcctcccagacccgagaggggcctcgagtaaacaggaaggcctggcggctccacggtgggggtgtttggagggctgggggccaggagcccttctgaacatgtgcagactgtgaacacagggcttccttgctggggaagtgggcccagagaggttgtaaagcttcacctagattgcagagcagtaacactttcatctgcctccccgctacccccaagtcaaagtcatctatctctcaggccttagattctcttagtccctggagacctgccaggagcccaaaaatcctggatggttctaatgtacatatgaaaaaatatatatttattcaaactgcttagagttaagaaggaagaatctactttcttctttttttcctctctttctctctctctctttctttctttctttctttctttctttctttttctttctttctttctttcttcctttctttctttctttcttttttcttttgtttgtttttccaagatgggatttctctgtacagtagctctggctgtcctggaacttgttctgtagcccagattggccttgaaattatagagatccgggactggcgagatggctcagtggttaagagcgccgactgctcttccaaaggtcccgagttcaaatcccagcaaccacatggtggctcacaaccatccataatgaaacctgatgccctcttctggagtgtctgaagacagactttcatataataaataaataaatctttaaaaaaaaaaaaaaagaaaagaaattatagagatccatttgcctctgctacacaagtgggcttttccaccactgcccagcaagaacccactcttgattttgttccgagacaggttctccctgtgtattgcatgctgtcttggaacttaaaattctcccgagtgctgggattacagacgcactgtgatcggatcttggggtacaggttgccacaggaacatggctcctgccattggaaacagaaggtcactttgaaggcatctgttcttctaatgcacgggtgcctgacccctggcaccagctgcattttggggacattgtcccctctctgggaggctgtccttaggctcacatgcctctctgcacccacattctggggcttcagactgtcacttaagagacatggcactgtgcaagcaggtaacaaggcccatcatgtccctctagtgtgtctaacatggctgctattcccaccacccacaccaggcagttcacaaccattcataactccagctccaggagacccaatgcttctggcctcctggggtattacatgcagacacacacacacacacacacacacacacacacacacacacacctacacataatttaaaaataatacaaatttagctgggtgtggtggtacatgcctttaatgctagcacttgggaggcagagacgtggatctctatgagttcaaagccaccttggtcaacagagttctggggcagccagggctacacagagaaactctgtctcaacacccccactctcagctccaccacaaccaccaccccccaaaaaggaaaaagagataagaaagaaaggaaaggaaaagaaacaaacatagccgttgacctaaggaagtgtctgtttgtgatgggaaaggacaccatatcagctagtggcccaaaggcctgctgttcatgtgagagaggtatcttatttttatgtgtaagggtgttttgcctgtgtgtatatctgtgcaccataaatgcctggtgcctgaggagaccagaagagggcataggatcccctggaactagagtgacagatgtctttgagctgccatgtaggtgatggtcctttggaagaacagccactgtttttaaagactgagccatcaagagaggccattgttaaagagacagtcaggggctggagaggtggctcagtggttaagagcactggctgttcttcctaaggtcctgagttcaactcccagcaaccacgtggtggctcacaaacttttgtaactccagttccaggggcatctgacgggtcttgtcacatccttgggtactgtacacacatgatacatatacctacacataggtccacacacatacacataaaattaaatgttaaaagggacagtcagagctgggcgtggtggtgcacgcctttaatcccagcacttgggaggcagaggcaggcggatttctgagttcgaggccagcctggtctacaaagtgagttctaggacagccacggctacacagaggaaccctgtctcaaaaaaaaaaaaaaaaagggatggtcagagggagccttgctttctgagaggagactccaaaggggaggaaaactggtgctccctagacacaaagggatgtgcagaggcctggaagtaagcatggtcaagacacactggagtcagtgtcactggggtggcatgagcaagggggaaagggagatcaaagaagggaagggtcctcgtcggctgcttgagaagtcttggttataggacagagtaaggctaccactggactccacttgaacaggcttcctgcctagagcggagacggggctgtgtcaaaggaagaaggaagcagaatgcggctacatgaccttgatctcccagaggggacagttacagagggctggatgaggcttgctagggcttggatggagtggcagcccaagggagagtgacagactgaggcagactggaaccctgcagtaggtgcaggcagtcagaggcatcctggagccctgagctgtgagagtcctggggggaggggggaggggccagtgcccaccaggcacggaaagctttctgtgtgacagtgtccccaggaacaagtttccagcctcgaactggggaagcatgcagaacagtccctggagagactgagaaggcacgggcctgtccgatgaatgtgatttgggctctgttttgtttttttttttttaaataaagcctcatgaaggctaacctactcagtgtgtagttgaggatggacttgaacgactgatcctcctgtctcaactggctaagagctgggactgcaaatgtgtgcttcctcacatcggcactctgtcaactgagctactccccagatccagtttggcttttttttttttttttttttttttttttttaaagatttatttattaatatatgtaagtacactgtagctgtcttcagacactccagaagagggagtcagatcttgttgcggatggttgtgagccaccatgtggttgctgggatttgaactctggacctttggaagagcagccgggtgctcttacccactgagccatctcaccagcccccccagtttggcttttaaaaaaacattagtgtgtgtgtgtgtgtgtgtgtgtgtgtgtgtgtgtgtgtgtgtgtgtaaaggccatgttacccatatgaggatcagagggcaacttgtaggagttagtgtattctgtccaccgtgtaggttctgaggatcaaactcgggtcatcaggcttggttgcaagcctctttatcccttactccccctaatttggcctttcttttttttctctttttaaaaattgtgccgggcgtggtggtgcactcctttaatcccaacacttgggaagcagagacaggcggatttctgagttcaaggccagcctggtctagagagtgagttccaggatagccagggcgacacagagaaaccctgtctcggaaaaaaaaatcgttttattttgcataattttttgcctgtgtgtgtctggtgcccagggcagccagaaaaggatgtcagatctctagatttggagttacaggtatgtgagccactgggaagcacgccaggacccctgtagtagtagcaagggctcttagctgctgaattatctctccacttctgccttggctttttgggactaggctgactctgacctcatggagaaccacttctgtgtatcagtgctagatgactgcaggcctgtgccacccagttgagggtctgtccttgtaactagttcctagaagagacttggccctcactctccgtctaggaagaagctgatacactttgtttcccagtcaggacccgttggtgggaaccaaaatccagtggtttgtggtcagagcaccaacaagttcacagaggtctgtccctgtcccctccttacctgagcccaagtcccccaggtgacttgtcccttagctatgacatgatgtcatgggttacatgggtcttctgatttggaagtaagagtgaacagcaaaggaaaggcacaaagactgcggagggggccgcgagggaccagggacaaataagatgacatggattgtagcgaggagactaggacagaaggttctagaaacaaggaaacaacgccagatccaaccctgcacctcctttgcctctctccagcccagtgaccttgcacatctgggcctttctcccactgttaaatgaggatggtctgtgaagcggcattggatattgggccccaccatgggctagcttgggctagctggctgccttcccattgagcaggtaaagataccaaggctccagaaagtcaaaggccttgccttaggctccctggctagcacagggcagagtcggatacccagactcctggcctagcactcccctccccatgcccaaacgaacctaaccttgctgttactaacggcccctggctgcaggcctgtattggagactcaccgccgccttggggtccttaggggctgcctgacattccttcagtggccaggggccaaggtagacgtgctttaccctttcctgctgctcaggccttccaggccccaccaggaggaggatggagcccactgtgcgggccagacacaggcctggccaggggccatatctctcttggagtgttgcacaggatccacgggagaacatctacattgggattagggcctctgcaggaaacagatggcaggctcccaagggatcgctttgacaggctgtggtgaggggtgtattcacacaggtgtggtcagggtgcatggagctatctctatcaccctgtgcagatgaccacttggcctgaccggtaaagggaggagcctagttccccggtatagcagtataggatagaccctggctggattatggtcctcaggaaggggagaccaccaatgcagggtcagtcttttggggacaaagccaagggatgtatccttctctcttgacctcgtctgtccctcaggagcaggggagtggaaaaacagacgtacccctggctggagagagcatgctggaagcaaaccacagcttgctcggctctgtcccttgttgcaagatgctagggtcaatgagcttctggggacagaggaaccagcacggaactggtttttatttactacagatgagaaacaagacagtcttctctgtgcctcagtttctccattcccacaaccctcagttccaccttggcttccagggcacctcatgctttcaatatatttgtcttgctgggcatagctatgcacatctgaaatctcagcacttagtctgaggcagggggattacacatggaaaaccttctcaacccttatagaaaaagaaaaatatcccaagaaacacattcccttggctctgaagggacaaagcatcagaggccatcaaggcccctggcctcctgggacatttagtgaaatacaccaggtattgagacaccacccagactgccaattggcagggacatcatctttgctcaaaacttccaggctggtggtcccagacccttcattcccttaggggggtccctgctggtaaacttccccctaccccctgttcttttcttttaaaaaattttaagctacattttatgtctttacttaatgtgtttttgtatgtatatgcatgtgacatacatgtgccatggcctacatgtggcattcagaggacagtttgggggaatcagatctcttctttctccacataggccccagggtcaaacgcaagcacttttactccctagaccatcttgttggcccctctttcttttccttttgggtgtctcgagacagggtcttgctataaagccccgagcaggcctagaccttgttgcatagatcaggctggccttagccttgtggttatcctcctgcttctgacggtgcgaagaggggattgtaggcgtcccattagctgccactccacagttcctgctcttatcagcctggagcctcccgtgtttcctggagagtgcattaggtctcgtttatgatctgaatggcaacggcttgtgctgcacagggttggtttaggaagatcttttaaaagggtccttgggaaccaggcatggtggtacacacctttaatcccagcatttaggaggcagaggcaaagagatctctatgagtctgaggccgagcgtggtctatgaaactagttctaagccagtcaagcctacacagtaaggccctgtttcaaaactaaaaaccagaaacaaaaacaaaaaaggctgggatgtgtccaaacataggctaaggcatggacttagaaagtacttagatcaccctgggacacagggtgtggaaaggttaagacaactggagaggcagaacacagctagaagggcctggaacacaaggactttgtcctggggtcccagaggatcccctgcctgtcatctcgccctgatgttttgtctttgtgtcagctgactcttctatccactcagctcaggtggagtggccggcatggggcccgggttgagatcaggccctgaggtgtccactctgggtgttccctgtcaagctggtctccctccacctgtgtaaaacaaagcctaaggcgcaggcctcttgtcaatggtgacttgagactgataaggtgaacgcccagggtgggccctggtgtggcacttagtcccagggctgactgctcccaaaaccccaaaacagattctgttagggcatgaagggagaagctcacagccatgctaccaccatcccatcttgccctctagagttctggtatctacctgctatctccatggctgaaggaaaagggcagagcctgccacccccaagaggcctggtgaggcgatgtctcccatgcttgcctgggtgagagcaggctgaccttcctccaggctgccttaggaaccacacccaccctccctgcctcatgtcagccccccacagagacaaactgctgaccttgcctggtcactgaggcacaaagactggagggcacctagaagccaggcctgaaacgccaggtcaacgtctcctttcagaggttctgcttctcagccttctcaagagagatgactcccactgccccttatgttggagtgggcagagataggcatcttaacctccccacatccttactattgccccgggatgatgcaaataccacttacagctttagcctatgcttggttctttgcttgctgcatctggactcccccagtccctgacacctctctgggcagctcaggtttcttcttcaagcttccctgggcttgaccctaaatgctacccagcagcacagtggggacacagtatgtgttcactgtttgcagaatgagcaggggtctttctgggattgttgccttggctgaggaagggagctggattgagaaccggctcctgcagacctggcccagggttcagtgttgtagcaggctagcatctggccctcagggatctcccaagagcctggctgtgaagaggacccagctgggccctgcgttacaaacaacaacagagattagggagttacttggaaataaataaggcaggcccagacccagggctatcagacttcagaaatgccatgaaagtttgtgcctgtccctctttggatacatagtgtccctatgtatcagcccaggctgatctgcaagtcagcgaatcccttctgccatggcctgcagggggcaaaaattataggtgggtgccaccaaagtcagctgtgtttcccttgcctttgggactgtgtgggccctgaccatctccatgggaacagtctcagctgttctactatgttaacctgggaacgcatcttcttcatgttgggcttcagtttccctgtctataatacaaagggtgcaaccaagggcgatgcttctgaaagtctgtgttgatgctggcggggaccagctagaatcccaagttccatcttcccagaaggctgtcccagtttgttttctcatctgtagaatggaacccgagctacagggacttcaaccagaccttgtcccctataaggttgccagatgtgtcctcaccagccagccttggcaannnnnnnnnnnnnnnnnnnnaataggcaatgcagaaggaaaggtggccccactggtagtaaacagaaaggagtgagcaccgtcacccccaggggcaggtgtccctgggacagccatggctgctggcttacaggctatctgggcttacaggggaagtcactagggatggagacggggccccaggacaagtgagtaccaacagaggcttcctgtgtaatgagaccaaagaataaagagcagaagagagatgccagctcttcttggcatccctgggtgtcctctccgggtcccaggcctggtccttgatcccacatctttgtattatgggtacctcccccatcccagggccccccacccagcgacaaagcctgtggcacttccttctactcgcctggcaggcagcctggcccggccccttctctaaggaagcgcatttcctgcctctctgggccgggctggatgagctgagctccctgccctgacagtcagacccctgccttcatctgtgtcccgtccccaggccaggaccgccgacagctgctgcccgaaagagcccagtgactctttcccaccacccagtcagctagagactcctgccctgctgtgagtctcgagcccacttctcctgacttctccgccgccacctcagaaggctggagcagggacgtggtcgctccggccgcctgctcccttcggatccccgcgcgaacccacgcaggccccggcgcccgcccgcagccttacctctggataccggataaggcccagcgcacagactcccgggtggacagcatggaccgtggcgtgctccctctgcccattaccctgctgtttgtcatctatagctttgtacccacaagtaagtgtccagcgcccctgggtgggaacaagcccaggctagaccctgggtgttacaggtcttattcccatgtcccaagctactagctgatgaagccacccccaatgtattaggaggtagaaatgggatcaccaactattttggttcagtgggagtaaaatgtttcataggatgccaaacttaagcattagacgtctggggagaagtgggataagctatttaagttagcgttggcaccttcctgttatccttcctgctgtgttcagctatcaagaaggccaggagctacactgctatgcatcactgagagtattccctcccatctctgagccttgagtttcccatttgaggaagtttaggaaggaggatgcagaagtaaatttaggctctgggtccaactttgacctccttgttttcttgtatgagccttgaggcctccgtgccagaggatgcttagagcaaagactggtgatgagatcatttgtccgaagagtttctgtttcactagcttcaagttctcccagcattcccgggctttgcccgctcccggaaccccccaagggcacatgctctggccttctccatttgcctttctgagaagggtacaggctccattagggactctgtggatcttctcagccagggtgactattgaaagtgatctgaggagggtcggtgaggagcctggaccccagtcctactcacgaagggtcacagcagggcctggtccccagccacctccctgaggatccccgcctaccaacctgcagattcaggggcatgttcaagggttggggtgggcagcctggaagaaagagtatgggaaatgatggggccatcctggcactcaaagtccacaattgatgggaaatctgtcatcgcgggttaaccggaaattgagtctcagaaacactgagtgacttatcagggatttgactcaaggcctgtggcccctcagaacccttattctgaccacacatgaccctgcaagatggctgccccaattaccccatttcccagaagagaaaatgaaggctctaaccttccaaatccacctactccaacagagtctgaccccaggctgggacaggattccaggccctcttccccccggcttggggaaacctgccttgtaggatgggaagtggggtgtcagtgtctaggtgactgttcagaggatagaccagtagactgtggtggtatgcatatttcctcagagctgatttcaggtcacaaacactcagttcttatttggaaatcagagtacagtggcacacagcaattgcctctctcccctacagagctgagaggtacaggtgcccgcaagggtacctgagggtaacgtggctaaaagaattaggaaatatgagttctcattgtgactagctgggtgtgtagtgccatggtagggctcttacccgccatatggaaggtcctgaattttaaaaaaaattatacacatttatatttacagatgcatatgtatacatatatacatatatacatacatacatacatacatacatacatacataacttattttctttcttgaaaccaggtttcactatgtagccctgactggccagggcacagaatttagcttttcagtgcatagggtgagggactgggcacaaaaaacaggcccagtctcccagaacacaacacagcagaattttctaaatctgtaacttgtgtgtagcgccttaccctcacaactcaaagccagccctaagctgggtgtggtggtacacagctgtaatctcagcacttggaggtttgaggccatactgtccactcaagtcctgggccagcttagattatgtggtgagttcgaggccagcctgggctacatagtaagactctatctagaaaagaaaagaaagcaaagtcagtccttgagagttacctgtctactccactgtaaggatatgtggcccacaggtaccagattctacccaaatgtctgtcagcaggggtatcattgaagaagtcttgtcacagaatgtcatccagcagctaccacaatggatccaatcaccatgacacatgtgtatgggacacatcacaccgtaaaaaccttacacagacatccgtttctactgataaaacagcactgatgccatttgcacagagaaacttctggaaggttgtgcactcagtgtggccgcgcattcggtgtggctgttttccagtgtgcgattttctctagactctggagaaatcgaagacgtggatttgttttattagtttatctgtatgtttgttttgcctgtatgcatgtctgtgtgtccagggaggtacagacagttgtgagcctccaggttggtgccaggaatcgaaccctggtcctctggaagagcaagtgctcttaaccactgagtcaactctctggccctggaattcctttaaagaacatgcgtgtggagattcttaaagaacaacttaaccatgtgtctgttccccaaggaaaacagatgaatgaggggctctggggtacagctatgtggcaaagcacttagtaggctaggaggacagagggaggcatggcggccacacctgtcataccagtagtcagggggtagaggcgggatcagaaagtggatcacaagctcaaggccagactggactagatgaagacctgtcttgagagaagtggggggcaggggagcaagggaatggagtgggggagataagaagagatgggggaaatgaattttaaaatcttaggtccaggccgggtgtggtgacgcacgcctttaatcccagcactcgggaggcagaggcaggcagatttctgagttcgaggccggcctggtctacagagtgagttccaggacagccaaggctacacagagaaaccctgtctcgaaaaaaaaaaaaagtcttaggtccatgggccaacaaaacagcttagcgaataaagacctgccgccaaggctaataacttgagtttgattccccagaatttatataatgggaagagagagccttatgttgtcctctgacctttgcatgcggtggtagacacacacacacacacacacacacacacacacacactcacactccttctgattaaggctagcatatcaatggcagtgtttttttttttctagaatattccatgtccagtcttcagtactgcagacaaacactccgagctctgttggcatctataggcagcctccagggcttcaccaagtattctggtccttcagatgagcatgcgagagtcctgtggacccttctgaactgccgtatttttttcatggcattatttggactctatcacagtttgtctgcagttctggaatattctgttgcatctgcacgccaccatttgaacagcaagtccctgcttgaatatctaagtggtctcccttctgttccagtttggcgcacgcacccatccccgtattttggcttatggcatttggaagctcctggcacttgtggcatgagcctggtgactggggttaggcacctgtggctgagcagtgtctcaaacagtaggtgtcatttgcctgcggctggggcggagaatgacctgaaacttccttaccgatggctgggaatcttggattcagtgcagaaggagctggtggcaaagggcagagattgaatctatggtttcgaggtcacattccagaaggaaagagggatgaacaaagaactgcattagtcaggacagtagctccctgagacctatgaggacatgaccactcctgcgaccactattgggacattctctctccacacccagattcaacttattcacattaaaaccacctgtaactccagttctagggaatcccatgtcctctggctgccacagtcacatgcacacatccatgtagtgcgcataagctcatgcaggcatgcacacatacacacgaataataaaataaatcttaaacagttaaaaaaaaaaagattttctctcacctcagccagagagacagagggacagaggacttgctctgtgtcacatgtggaccagtgctgggaccttggaggacaggcctgctccgtgtgctctggggtcttcaggcaggtctggcagttctcagtgacaggccctgatttccaccccaggctgtctgctctaacccagcctcctctctgggccgtttggtggctaggcacaggagatttagaactctgggggcccagttctgggttctaccttttcctccagaccaggcgttggggcagcaattctgcaagttgaggtggggtgcccattccagagtaaattggatttaacatggatgtgtaagtagggtgctgggtatgccagttggcatttatgtggcgcttactgtataccagcactggcactagtctaggctgttacccctctgttgcagatgaggagactaggagataagagcaattgctaagtaacacaaattagagtggatagccatgtccctgaaccttggaccagccgtttccatgagttacctaaggggatggacaagcatcttcctgtggtttgagatttgcccccgtgcccccaccgtctcagcccggcaatggccgtccctcttagacaaagctaaacagctgcagccaagtatgggtgcacttgggagactgagacaagagaatcaagaattctagatgcgttccacatccatagtcagtttcagggcagcctgggctgtggggaatcccgtctcacaaagcaacccagcactggggagcatttggaggacatgagttgggttcccagaatccatatcacatagttcgcaattgtctttaactccagcactaggggatccagtgcaggcacctgtacacatacacacacacacacacacacacacacacacacacatacacacacacacattaattgaatcttaaaaagagaaaaccagaggttgggagatggctcagtggttaagaacacttgttccttcagaggacccagattttgttcccatggttatggcgcacatacatacaaatacatacacacatacatacatatgtacataatacacatacatataaaaataggtacatatatgcatacatacacatgcatgcacacatatacatatatacacacatgcatgcatacacacaatacatgcatacatacatgcatgcgtatatacacacatgcatacctatatacatacatacatacatataaaagactcatacagagaaaaataaatgcatgtgaaacaacacaacaagaacacaggccaggagtggtggcacacacctctaaagccatcactcaggacaaggagatggcaggtgagactgcctgagaggtcaatgaggtcagccagaactgcagagtgagaccctgttgtttgtttgtttgtttgagacggggtttctctgtgtagccctggctatcctagaactcactctggagaccaggctggccttgaactcagagatctgcctgactctgtgtcctgagtgctgggatcaaaggtgtgcaccaccgctctctggctaagaccctgtcataaatggggagaatgttcatctagtaagcatttgctatgcaaacactgaggacctgcattccgtgcccagagctcactcagtaatgttgatgatgatgatgacaataataataataaataatagtaataaatttaataaaaacaaccgggcgtggcgctgggcagagcaatccacatgctagtgagtaggagctgggaagctccctgggggtcactggctattcagctcagtctgcccagtgagccccaggctagtgaaagactatctccatcagcaaggaggtggtgctgaggatcctgggtgtaaattgcacacatgcacaagcacgcatacacccttacacacttacccacacacacatgagaaacaaaactgcccaaaccatcaaaacagataaaggcagtgaagtaccacctgactctaagacatcggggagagggggggcccacagacctaaggaagtacctctcccctctccccttcctctttctctcccttttgttttggtggtggtcgtcgtggtttgggttttgttgtttttgttgtttgcttgtttgttttggcttttttgagataaggtttctctgtgcagccctggttgtccttgaactcaccctatagaccaggctgtccttgaatttagagagatccatctgcctttgccttccgagtgctgagattgaagctgagtgctgtctccccgttgctaccaccagcaggaggctaggaggcacctgcttcaagaagaggccacagtgggtttttttgtttgattatttttgtttttgtgtttctttttgttttttgagacagagtttctttatgtagccctggctgtcctggaactcactctgtagaccaggctggcctggaacttagaaatctgcctgcctctgcctcccgagtgctgggactaaaggcgtgcgccaccacacccggccaacagtggttttgacagttgagacaagttggtcaggctatcaataaaatgtggtcactagggtctagacaggtgactctgcagtagccagcacttgccattcttgtaggggacccagatttggttcccagagcccacatggcagcttacaactgtccatagctccagttccagtggtcctgatgcccctttttgccctctgagggcactgccagcacatggcacacaaacacacatgcaggtacacacttatgcacatgacactaaaataaatacatctaaagaggacagccgttggcctgagaaggggcagaggcaggcagggtgtgtttggaggaaatgttcacctctgactggaaggacacagtccccacagcagttcctgagccatctccattcattagcggatggcttagcgctgtgcatgtgaccagctctctgaaggtgacagagggtttttaccacctcagtgtagggatcataattgggaggcataaaaaggagcctggccggcggctgcggcacagttaggataggaatttgtggaatgtgtcaacctcgccatcctttgacctcactttagaccacagcttgtgaatttgactcagtggctgttgggaaattctgggaaaggcatacaagcggggatctgtgtcttgctggtggcctggctgggagatgggacagctatgaggttgtgattggactctgaagagagtagagggtgcctgagtcgggtgactgaagaagactttggtctgaaagtgccctcctcggtgtcgcagacactcatagcacccatgggaaccacggagatgagcatcagaactgacttacagaaagcacacgctggggctagaactagaccctcagagttcacgaccagggcctgttgctgaaagtctgggtctcctagggaaattctttagcctccctaactacccatgagatgggcataagaaccccccccccccactgccctccaaaggctgctgtaaggatccaaggaatgtagtcatacaaagcttccagacagggatcgtgatgggacttactgtgtggttattatgcctaccaataaggagagcgaggcctttatgaccaggccatcgggccccagagcaacttgatgacctccgggagctatttggggtggaatggggactggctgtgtaaggcctgtgattgtggggtgaaggaggaggaggagtaggaggatggtccagacgtttcctcgggaggtcagggtcacccagttctccaaaggtgacttgtaggcccccagcggcccttcctccaacagttccctggaggccccgggcagttcccttggtaccaggggattgttttcagctggcctgggcccgccttgggctgctggagacaggctcaggcgtcacactccctcctgtctccccattctcgtctgtggggtgggggcaaccagtattcgaaaaggccccaaaataaatgggcctcttatctgatctcccagcctggcctgttatctgatcattacataatggccaggcccgcggcctctcctgctggcgctggctgacggcatggaggaggcggccccaaatgccagaggaactggggttcctggaagtctggggagggggggtcaggaaaagtccgaagatctgtaggccagatggtgggccatgtggagggagtagtcggagacccagagggcagccatacgcatgtatgaccttgatgtgagtgtcctgtctcttgaggttgcagcctccccttctaggtaggagtggggacagaccagatgggagactgacaagaggaaatggtgccaacccttagtctgttggggtgagggaaacctcaaaattagtcctgtcctcagcttcacccccacccttaaatgcagacaagaaaactacagaaatgaaactaccacatgccctgtctcacaaatggctcccaacaacctccagggccgggtgctttctcttcctattgccattgtagagatcaggaaactaaagcccaaagtcctgaaatcattccctcaaaccacacagctagtcagaactagttgggcctgggatactgggcctggctcccagggacttgctttgaaccaaactcccgtattgctcaaacacacagatgtctcttgcaagttgctactgcgactagagtaatggctgctaagtttgggctcttacagcagcagtagatacctgctcctattctcctcccaagatggagatatctgagggagggtgttggtggggtgtaaggtagccatcttacctccttctctgacctcagtggctttgggcccaacaagctagctacaaaggtgggggagaaggctggccaggccacaggcgcctggggttcaggaagagccggcctgccccccatcctcagcactggcgtcagctggacgtgaagcctggccctcctcgcccatctttgatctccaagaaaacaggaagtgaacacgacaagatggagacataaacttccaaacagcctccccttctctgtccctcctccacagccccccttcccctcagcacattccttaggacgaggtgtaggggcctcatttcctcttcctcctctgctgggtcagggtgaaattccattcctctcccttgggacccgtgtttccgggccgccctgcagccgactgtgaggcctgctctacatcaccgcctttaacctgggctgctccccctgaggcaggaaattccctcctcagaaacggcctctcaggaatggacaccttgaggtctgaagagggaaaaccgtttttcctcctcaacgccacccggtacacacactccttcctttggattgaactggccttaagacttggggtccaccatgggccctaccccttgggtcaccctgccagcaatagatagctgggcacggtggcacttgcctttaatcccagcactggggaggcagagacaggccatctctgtgagttcaaggccagcctggtctacagaatgagttctaggccaactgagattacacagtgagatcttgtctcaaaaatacaaaaagaacaaaaaacaaacaaatacttctgaaaattagctaaaatttcatttcaggcaaactgtttttgcaatataagtatataattatatatttaaaattataccttgaaaaaggattcccgtttatctgaaattcagacttattggtaccctggctcttaccttccttccaacattatacctactaacactatgatcctaggagagactttctccggctgtgtctcagtttgcccatctgtggagagtatgaaatgatatctaccatgtaaggtagctatgaagatgtcatacgccttgagctctgggctcatacgtgtacctgggaaatgttcagaaagtgaacgtggttgtatccaggcgtggtggggaatcctagcattagggaggcagaggctggaagacctgaaggtcaaaaccatccctggctacattgaagccagcctgggctaccacagctctgcctccaaataacaacaacaacaacaacaacaataacacaacaataattcttttttttttttttttttttttggtttttcgagacagggtttttctgtagccctggctgtcctggaactcactctgtagaccaggctggcctcgaactcagaaatccgcctgcctctgcctcccaagtgctgggattaaaggcgtgcaccaccacgcccggctagcaacaataattttttttaagatttatttattattacatctaagcacactgtagctgtcttcagacacaggtgttagatctcactaaggatggttgtgagccaccatgtggttgctgggatttgaactcatgacctttgaaagaacagtcagtaatcttacccactgagccatctctccagccccgcaacaataattcttaaagagactaggaatacaattagtactcttccctcccagtgccagggactgccttgcccacactagacaaacattcctgccccatcctcctctgacctaacctgctttcccactatgctttcccagcaggtctcgcagaaagagtcggctgtgatctacagcctgtggaccccacaaggggtgaggtgacgtttaccaccagccaggtctccgagggctgtgtagctcaggctgccaatgctgtgcgtgaagtccacgttctcttcctggattttcccggagtgagtacctcaggcaggtttggcggggtcccttaagaatcggagtagactgggtgaagggtgacttcttacagctttactagcacctcagccatggggctgatggggcaagtcctgggagggcccttaagaggtagaaggtatgattttctggaacacatcacaagagccagctggagggccggtgacatggctcatgggtaagggagcttgtggctcaccgggtgagggcacttaccaccatacaggatgacgtgagttcaagtctctgaacctacataagcaaagaacatcttcctcaagttgttctctgactctcgtgagcgcacacacacacactttttttttcaagacagagtttttctgtgtagccctggctgtcttgaaactcactctgtagaccaggctgtccttgaactcacagagatccacctgcctctgcctccagagtgctgggattaaaggcatacgccaccacacctggcaaaaaacaaaaaaggaaaggacccagatagaaaagagctagttaaatgtgttagtgtgaactagggaagcttgtgtctagatgcagctagtgacagggctctcagagcttttcagaggacatgactccactctaagctgggctttggagaaagggttgagttctagtctacctcacctcaaacatctgcgagtccactaggcatcctttgagatccaaaccccgcaagccagcctcaagtctgatctccagcggcttgcctccagtttgtctagatgtagagcagccatagcccatttgtcaaatgcttgctgcatgctaggtgttaggctgcagcctaccgtcacctaggaagccaccagctttgtctggttgattagttctttttttgaactaggattcatgtagcccaggctggcctcggttttgctatacagctaaggatgactctaatcctcctatctccaaagttctgggattataggtacgtgtaccacatcagacttacatgaccctgggcttcagggtcagagtctcatgcctgccaggcaaacattctaccaactgagctacatccctagccatggatacagacatggcgggggctcattagggtcccgtattattctcatttcttggaggaggaaactgagtccacccttgagaagtaaaacatgaactgaaagtcagaggacagacacaccagaatcctagggacctcagagccaaggtcaggttcactggcctgcctgggctgcagcccacgcctagctgatgtagactaaggccacaagaatgaattaggagcatgggatgaatttgtagccaacctgcccctaaaactgttgagttactttgcattttgtgtagtgataagaaggtgcccagaccaccaatatcggggggccctgcctgccacaaggactgtgggctttgataacccccaaggtacagatagtaccaaatacattttatttggctttcataagcatagcaattgtttttcaagtcagtaatgatatggaaaaataagaagctttcctgtaagttcattttgttctcaggtttaggcccttgcacctcttctgggtgatcctggggtctcctgacagcaaagccaggcagaggaagatcccagccagatggccaggtctctgggccacaggtgtgtagacagttccagccaggacacaggagactggtgttgtggcagggtacttcagctgctaagcttaggcagggcttcctggaggacgtgacaacacagaggagctggaccctcccaagtgtgggcacagccggggagaggatgtaagcagagggagggagctgcccgctcagactctgacaggaccttgaggttcacctaggagcagaactggagaaatggcagttattgagaacttggtttttagtctatgagcaatggtgaccactgaaggagttttagggctgtgttgtgtgtggggtgccacagtaactcatggcatagtccaaggattccagcatctgtgacaagagaatttccttgtagccctctgccccttccagagaactttatagatcatgggacatttttatttttactttttttggtgttttggagacatggtttctctgtgtagccctggctgtccgggaactcacagaaatccacctgcctctgcctcccaagtgctaggattaaaggcttagggagctgctgccacctctcttcccaaccgaccttgtgacatctaacccatcaggccaggcctccagccctaggactatgaaggatatgcattttgaaggggtaggaaagagagctggggtcccagggttcagtcctggacctgtcattggcctgcaccttgcatagagcttgagctgctgaaggggcacctcttatatttttcttgggttcagaggctcgctcaagaattatgaaactatggaacctggttcaggacctggtctattccaaataattaatatattccataaatgaatgcatatttgtgtaataaatgcattcaaatgggaccacgatacagtgtttaggagcacggcttttagtcaggcattgtagtgtgagactgagctcccagttactcaggagcctgaggcaggaggatggcttgtaacagtacacgttttaggtcatcctggccaacgtagtgagagtttgctcagaaaacaaaccaaggaaagaggacgtagcgtctggagccagtcagtcctcatctgaacctcagctaatctcacggccacatcgctttgttggcaaagctgtctgaaccctggtcttcccacgggaaacatggagacaatgataatctttcctacctcacaggttactgtgagactccaggataaagaaagcagaacacagaacacagaacctgcccacagtgaaagctctagtttggctgttataaattttgtcattattactatgtctcctggactccatttttcatctgtaaatacttggacatgacccagtttccaaacatcttccatttagtttattactctttaaacctcacactagttcgaactcaatggagaagaggcagagactgaagatccattttcaggcaggctaatggaggtggaggctcgtggagttcctggcctatctgtccgtgatcctggtcagtcttggtgctttgaccaccaagagcctgtgacctgctgagcactgacttcccttcctgggagtctccaagaacgagatccatgccactccctcactaccaactctacaagggtgcttgctgttgtcaagggtagagataggaagtaaagctgagccaatcacaggccaagaattgatatgagtgagtgagtgagcgagtgagtgatggagttagccatcttgggaaggatgagaggctgtgggtgacagggagatactcacccgttgtagagaggaagggatttgggggctgcacatggagctcagttgttagggtgcttgtccatcatgaggccatgggtttgatcaccaacatctcataaacagcgagtagctcagcacccaagaggcagatgcaggagcattagaagtccaggttaggcgagagcgatcgctcagcagcaaagaacacttgctgccctttcagaaaccccatgttcttttcccagcacccacatcaggcagttcacacccgcctgtaactccagctccagaggccccaacaccctcttctggcctctatgggcacccacatacagacacatacacataattaagaataattgtttttaagttcaaggtagcatggcacgtgtaaaggcctaaaggccaattgcgtgggtgaacaggcctagtgggggaggcactgcctctcctgacctttggcctcctttgtcagtccctggcacagaaagatggctttctcgtccatccccacatggctttataaccatcagatttcctgtgtgtgtgtgtgtgtgtgtgtgtgtgtgtgtgtgtgtgtgtgtgtgtgtggcatatgagtggtggcagccaagaaccccaggaaagtgacatttgaagtgtctgtctgtctgtctgtctgtgtgagtgtgtgtgtctgtgtgttgaggaagtctgtacacaaactaggggctgctgggcaggggttatctcactgggtccccaaaagacaggccggagcctggattccgggaggggcctagggtcacatcctgaccttcaagacaggaacaggcctggtgcctcagcgattcccatcagctgactaccctgttctgctgtcccagacctaggcagccaagcttgtttggctgctgatttgctcccccccccacctccccctgccctcggcctgggcaaactcagggagctccttcctcaagataggagccagccaggctctgactcacgcctagccagagggggcatggagacagcgagccaggggaacctccactgattgtcctcagctatcatgggagacagtgaggggctgggaaggcagggtggctctgagaagtggtatcacactgaacagcctctctgtcacccatttccggcgacacctctgctccacagtgggaaacttgcagcactgaagggatgtacctagaatccttctcttacaccgcagagcctgctcagggtgcccagaacccctgagtgtcttgctcagttgtgtctgagcctattgtgcaggctgcaggggagtggcttttattattgtccccagaaaagaaccctgcccggctgatgtgagttcttctctacctgaagagtggcagagctggctctgggggaggcagcccagaggattctgggctgggtttctcccatctggacgcatgagcacactcactttgctctcagaagctgaagagaccaaggggccctggagagggagcttcctttgtgtctttgtgccttgcaggtgatgagcagggaagggaaccggtgtagcagggtcaggtggctgcacaggggctctcatcatctccccggcttcagcactgagtcaccctgagaggacatatttattggatagacagacagataggtagtagacgatcaaaaaagggggggtccataaagcctggagaaaatcaaatgaagtcttttaagtcctgaaagtaaacagctgtgaatcaagaacactgtactcgcaaaactatcttccaacactgaagaataaaaaaaggcattttgatgctgggcagtggtggcgcatgcctttaatcccagcacttgggaggcagaggcaggaggatttctgagttcgaggctagcctggtcctacagagtgagttccaggacagccaggactacacagagaaaccctgtctccgaaaaaaaaaaaaaaagaaagaaagaaaggtaggtattttgagacagacacaaatgaaggtaagacatgattagtaaggacagcaggcagtcctcggtgggatactttacaggaaagaacctggcaactcagcaagccctaaaccttgtatgaaagcaagaaaagaaataccaataacttcacaaagcagaacaaacctagcacatttaaaggaagaagcaaaacccccccttacaattctcttacaaataaattgttttggcttatagtttagtgcatcacagttaaataggacactctgtgtgtgtgtgtgtgtgtgtgtgtgtgtgtgtgtgtgtgtctgtctctttctctctctctctctcatttgttgagtcttgacttgtgtcctaaggctggtcttggaggagaagtttctgagaaaatctgctgaggaagacatgtgcgttcccttcccctttgggtggaatgttctgtccgtatgttaagtccagttcatccacactgttcttggctcccgagtttctttgctagcttttagtttggaagacttgctgagtaggagagtgaaggattgaagtctcccggtgttactgtatcaggacctggttggtctttgtatcttggagtgtttgttttatgcaattggaggctccaatgtttggtgcatagaagttagaattgttgcatcgtcttgaattgtttcttttattaatctatgcctggcatagtggcccgcatctttaatcccagtactcaggaagcagacataggccaatctctgagtacaaggccagcctggtctacaatagttccaggacaaacagagcttcatagttagaccctgtctcaaaaataaacaggcaaacaacaccaaaaggtagagtcctttttatcttctttaactagttttggtttgaagttgactttgtttagcataagaataaatttccattggcttggcagtttgttttccatgcttggagatgaagttttggggtatctttgttgactaagtatgcttctcggagagcgcatatagcttgttcttgttatttatccagcccgttagtctgtgtcattgaacttgcaggagttcttgtgcctcctgagggccagactcacaggcatgtgccactgtatgtagctcaaacacattgtgtttaaatatatttaaacattttaaaggtttcagactagacatggtggtatatctcttcagtcccagcaattgggaaacagaaacttgaggccagctatgtctacatagtgagttctaggccagccatagttacccagtaagacctggtttcaaaaaagaaaaaaaaaaatcagacttgggcttggagagatggggcagccctcaagagcacattctggttttgtaagaattccagtttgattcctagcacccatgttaggtggctgtgagccggggacctgactccctattctggcacattcgtgcacacatacacatacacactatacacacaccgcatacagacacactatatacaccacacacatacacatacacacactacacccaccataaacacacacatacacacactacacacaccacacacacacacacacacacacacacacaccatacacactcacatacacacatactgaaaacatttcattcagaaatcagtcatgatggcacatacctgtgaccccaatatccaaagactgaagatgttgagtttaaggccaaacttgcacacaatgagattctatctcaaaatggggtggtggcacatccctttagggctacatagagaaaccctgtctcaaaaacaattattattattttattaagttaaaatattggggtcaacagcagtgtcacattcctgcttcccagttctatgggaagttgaagcaggagaatcacttgagtgcagggcaaggtgccatctcttaaaataaaaataaagaattttatctgcattagtagaatctatcagtggacccagaggggctgagctaggcatcgtaaaaccagctatgaggccggatccctgcatcttcacacgtacgtgagcaggtaggttgtctagctcctgctccagatcaggcccagagaggaagacagaacgtccagactcacagagccacgtttaattcaggtctgtctggctctgaactctttgcctgcgacactcttcctgtgtgcaccatcacagtctgctgaggccgacttgggcctcctctgggctggccctgggagggtgggggctgcaggcagacccaaggctccactcctagaagaattgctggaaacggctttctataagtggctactaatactcagggcctcttcaccgaaatccccctttcccgacaccaaccactgggctaacaatggcatctaagggacagctggtaccaaaatagcaactggtctcccacccacccactcagggaaggagtcacacaggcccgtgctggcaggcctggggtcaaggaactggcacatacgtcatccttgctgggcctccagatgcccaggagcccatgctgaagacgggcagcccctcaggggacgaaagagggaaatcagcatgcatgcgtgcaaatggctggcgtagtgactcagggtggaggggaagggaagtgtttactgtggaaaccctggctgagtgattctggtaactggtcgtcatcagttaggcctgggagcacagagcccccagaagctctgctttccagtctccccgtgtctcacactgctcactctggggcctcagtttctctcagccccttcctctgtacataagaccctggtgacaatggagtgggaatttgccttatgaattcgggaagaattgctgaaacttgtcacaagtgtcctgaagccacagcctcttgacccgtggtacagcccccaacacccccaccccccaccccaccccctgcggcatgaccgtgccctgccctccgatttcttttcttcacttcctctatccagggcccctcctggtcttggtttccaaccctttcctgcccccatttcacagatgagtaaagggaggcaccaagggatcagagctacggtaaagtagctgcagggttcatgtccagggcactttccaaatcctcctcatagttccagctgtgtcaacctgtggtgtcctcccagagtgacattgcctcatctccctgtctgcgcgagtctcctggcatagtctgccagataactgactccatctatttgctctctgggtggagctggtagcagtctgtttggggggacagagaaaaggatctactactgggcagccaagtgccgtacgctccactcaagtgctggtcccggactgtgggctccacactctctttgggtgacttccattctagagcctgggagctgagaaatccctgtgcctgctttagtcagcctgcacttgctgtgcgctcagcacagagcatagcatgaattccattggaccataacacattacaggcacacaattgctttactgaggtaaaacccactgatttgaagtgtgcagtctaactgaaatgagaagttttaggttcagggagagactctgtctaagaaaatatagacacatagctgtgtaaccaacctgtggtgttcaagctactggtacacagaaatcaatcagggtgatatgttgcatgtgaatatattttcggagacagagtcttttttttttttggatatatgtagctatcccagaactcactatgtagatcaggctatccttgaacgtacagagatttacctgcctctgcctcccaagtgattgggtcaaagttatataccacttcagccatcttaaaatgtataatttttaagattaataaaacaagatacttatgaaattaaaatgtaaacccattagtaaacattatgtgggctggagagacagctgaatggtaggatgtttgttaagcatgcacaagactgggtttgctccataacactgtaaattattattattattattattattattattattattattattattattattggtggtagtatttccacatgtctgaaatgcattttttcattatactataagttactgtgaggatacttatttaagaataataacctagggggctggagagatggctcagcggttaagagcactgactgctcttccagaggtcctgagttcaattcccagcaatcacatggtggctcacagccttctgtaatgggatccgatgccctcttctggtgtgtctgaacagagagacagtaagaaaccctgcctcaaaaactaaaatggaaaatggcagagaaaaatatccagactggatctctggcctctacgtgtgcacacacaggcaagtgagtccgtgcgtacgcacatgcactacacacactactaagataaaggggctggagtcttctggcctccatggggtccaggcatgcacataatacacatacatacacatacacacacacacacacacacacacacacacacacacacacacacacacgtttaagtttttgtttttgttttttcgagacagggtttctctgtgtagccctggctgtcctgaactcactttgtagaccaggctggcctcgaactcagaaatccgcctgtctctgcctcccaagtgctggaattaaaggcatgcgccaccacgcctggcttacgtttaatttttaaaagaattaaaataaagatcacctaaagggatcgagcaccatcaggacaaaaccactgggcacacgttgaaaacaaagcgagaccgtttgctcttctcctctgtggctgtaaagagtaaccccgaacacaaagagtgattaagagggtcgtttaccgagtagcggaaatatttctgagcagatttttccagggactgaaacgcttgtctctggctctgtgacatcagtcagggaaacaacagtgagtcgattagaagccagaccctaaaactttccactgatgtctctgtgctaagcccatgctctgctttctgacagaggacagagcttgcttgcagtccgctatcggacttcatgctgctggcaggaactgccagagaccgtgtctgggaggatttccacttgtctttgttctctgagacaccacaaggtttctgaggcaccgatctgggccaggcgcctttgtctcctgctcattccccctccctcaccatctcatgggcccagaaagctctcggaatagctttgatctggccatcttttcttttcttcttagtcttcttgacagagctggacattgccagccttccgtgtgatcatggggcaagcaacctcacttctgtgactcggtttcctaatttgtgaacgttttaccagtacccacttcttaggttgtttccatggagctcataggtaaatgtgggtggaaccaggtcatgcgcgtgtgatctgccactgagccgccatgccagctctaggaacaattgtgaatggttggagtgagctggcatcagagtggcctcccagagacaactagaaaaggggagaggacagtgagagaaggctcgctgcttccatgcatagcttaaccttcagacatttacaggcccaggttacagcagacactcagtggaaatcatcctgactggatgtgctggcatgtgcctgacattccagcactgaactaggtaggaagagtcaagagttcgaggccagcctgggcacaaagcaagaacctatgaggagaaggaagtggaaaaggaaaggaaaggaaaggaaaaatgaatctcgcaatcctgaatgttacgtgaagcacagatctgacttagtttgtcctcttttttgcttgattgggaccaagctcattcattcatgcatgcatgcatgccttctttccttttttaaaaaaaattatttatttattttatgtatatgagtacactgtccctctcttcagacacacctgaagagggcactggatcccatacagatggttgtgagccatcacgtggttgctgggaattgaattcaggacctttggaagagcagtcagtgctcttaaccactgagccatctctccagcccccagcctcctttccttattaatttacttatcttttgtttaatttgtacttatttacttagcgtgtttgtgcatgcatgggtgcatgcgtgtgtgtgcctgtgcatgtgcgtgtgggcacatgtcacagttctggtgcagagctcagtggataacctgcaggagttgggactctccttccaccaggtgggttctgggaattgaactcaggacctcaggcttggcagtcatgcttgctgaaccagtccctcttatgtttccaaggggtgtgagggataggtgctactttgcagatgggtaactggtgagagggtgggtaggtcaagccacagagggacagaggaataaccatcaaccataaagcatcgctgccccactggctgcaaacctgactgatatatctacgtccatggttcttctccagatgctgtcacatctggagctgactcttcaggcatccaagcaaaatggcacggagacccaggaggtgttcctggtcctcgtttcgaacaaaaatgtcttcgtgaagttccaggccccggaaatcccattgcacttggcctacgtgagtgtgtgacccttaactccaggcaggctgtgggaaatctctgcctggtgtccctctctgtgagcaacatggcacaccagaaaggcagaggcagataggaacaggaccagaaggtgccagaggaggcagaggtgggcagtagaggtgaagatggctcacagatggacacatagaccagcatggtggagacaccatggaaaatcccctcccaagttcaagggtccggcctcccttcccagagtgctcttctccttctcattgagaggggaagtcaggtcccagagatcttcccatggtgcctctccaaccagtcccttccccacttgctacccagggttgaggagctgccagggtcctgaatgacacttggaatgcaagctctggctgtagggttgcagctgcagcctagcctggttgcatctttttacttgctctgaacacacacagtgacagccctgaatcatctgtgtgcagatcaccactcagaggccagaggccgtaaaccaggggcctgatagtcacggctgtaaccctgttttacaggggttaatgcctgcagagtaggcagtgtgcgctattatatctcttctgactgtcatgcagtcctccttaatatctaatctgaagccctcctgctgctgctgctgctacctcagctcaaagtagcttggagtcaatagtcctagctgcttcctctagatcacctcctccaggaagtcctcttcatttccttccttagcccaacagaccccagaggagcctaagggaggtagtaaggtttgggatctctccagactccccgtccccagaataaatttaatctaattttatgtataggtgttttgtctgcatgtgcgtctgtaccatatgtgagccttgggcctgagggggccagaaaaatgttgcattccctagggctttagttacagatggctgtgagccaccatgtgggtgctgggaattgaacctgggttctcatgagagaagagtcagggctcctaaccactgagccatctttccagaccctctttttgcttttcatgatagggtttctctgtgtaggcctgggtgtcccagaacttgctatgtagttcaggctggcctcgaactcacagagttctgcctgcgtctgtcactcaggtgctgggattaaaagcacgagccaccactacctggctccagccttggtttttgttatttattaaataatgtcctctatcttctattacttcaactaatgatgtctctctagtttcttaatggtgagctcccagagttggcagaaccccatctgtcttcattcatttactcattcatttttttctcacacctttcttcctttccccttccactgtccccttccccgtgcattgagagtacctaatatgtggcaggtctcaaggtgcagctggcgtatcagatccccaatgaacaaaggctcagagccttcaatgagtcaagtgctatgggcaccaagatttccctcccataccctcagagtgcagacagttacagacagtagctacattggtgccattatatatggtttgaatgagtgcctccatggtgagggtaaagcaaggacagacagacgaacaaatgtgtgtctctgtacagccatcacatgcaggagggagatggagcagatctggctatgctagaagaggtaccgggggctctgggctgactgacgacttccgagccttgtcatttgaggtcccggcctctttgctgccagattggtaggaagtgacccagcactctgtgtctccacaggactccagcctggtcatcttccaaggacagccaagagtcaacatcacagtgctaccatcccttacctccaggaaacagatcctcgactgggcagccaccaagggcgccatcacctcgatagcagcactggatgacccccaaagcatcgtcctccagttgggccaaggtcagctccctcagttgcttctgagttcaggttcacttgcagaggagactgagcaaactcctgatatgggcactaccagcttgtggtggcatgtgatttgcccacagtcaaacgtgactggctggtgccctttgcagttagcgactgcttctgcatcatatagcagatgagaaatgccagattttttacttgggatgtggcttggttggtagagcctgtgcgtagtgttaagccctaaagccctagaaccctagagcatggtggcatggacctgtggtgccagcactcagagggcagaggcaggagaatcgggagttcaaggtcatcctctgccacatagcaagttcaaggcttccctggagcttgctggtcagccagtctagccaagtcttcgagccaggttcagtgagacactgtgtctcaaaaaaataatatggaaaaaaaaccaaaaaaacaaaaaaataatatggaaagcaattaaggaagatacttgacctgtgctggcgtgctgggtgggggtgggggaatgcactcttgacacatgccatgggctcacttgctatgttaaccctgtgctgacacaggcggaaacaaaggccggctactcagtggtgagtcatcctcagccctgttaagctttgtcctgaatgtcctcatcaatgccttgtctggaagtggggtaggaccctctgatatatctgtctccacagacccaaaggcaccattcttgtgcttgccagaagctcacaaggacatgggcgccacacttgaatggcaaccacgagcccagaccccagtccaaagctgtcgcttggaaggtgtgtctggccacaaggaggcctacatcctgaggatcctgccaggttctgaggccgggtaagctagcctttgtgtgtattacccaatcagatcctagtctccaaatgcattacccaatcagatcccagcctccaggcgtattaactttcctattgctgagataaaacaccatgaccaaggcaatgtgtagaagagtttattttgggcttgcaattccagagcatcagttctgcatcagcatgagttcacgacagcagagtgaaggttgcaggcagcaggcagctggagcagcagctaagagctcacatcttgaaccacacagataggaggcagagagctcaccaaagcctaccccttgtgttctacaccctccaggaaggcccacttccctaagccttcccagactgggatcaagtattcagatgctcatacagatgatgtctcatccaaaccagcacaccaggtctgtccccatactaaagccacaacccatctgcccgcccgctgcaggccccggacggtgaccgtaatgatggaactgagttgcacatctggggacgccattctcatcctgcatggtcctccatatgtctcctggttcatcgacatcaaccacagcatgcagatcttggtgagccttgtactcccaccccagccgagaccttacacacacaccttccccagcttcctaccttcatctaagttgttaaagtaaaggccacttccaggaagcttgtcttgatgggccagggaatccgttaacctagcctggtaggccaaggaagactcctggagatacaaactctgagctgggtcagaggtcaaaggggaaatggagaaggtgaggggaagggacggcaaggcacaggcgaagggcaggggtctccgtaggtaagatgccagctctctttttctgccttcagaccacaggtgaatactccgtcaagatctttccaggaagcaaggtcaaaggcgtggagctcccagacacaccccaaggcctgatagcggaggcccgcaagctcaatgccagcattgtcacctcctttgtagagctccctctggtcagcaatgtctccctgagggcctccagctgcggtgagccacagccctgtgcccctgtcccagacctgttgctcctcctccctttccattactttgtgcctctctgttctttgagcttggctggtttctctgagcctcactggcctcatctgccacccgtagtgcacacccagtgacggtctactccacccactccataggtggtgtgttccagaccacccctgcacccgttgtgaccacacctcccaaggacacatgcagccccgtgctactcatgtccctgatccagccaaagtgtggcaatcaggtcatgactctggcactcaataaaaaacacgtgcaggtaagtaaagccccgcccctccaccttgagatggcatggacagctggtcccttgccaagaatgtcaggggcccagcccaggcagtaagagcaagtcacatccctgtgcaagcctcggttttctcacttgtgaaatgcagtttgaacagagcacagagccgtgcactggtattctcagaacctgggaggctgagcgaggaggatggtgaatttcaggtggactaggctacatagaaggtataaaatagagtcatcctcaactacatagggagtttgaggacagcctaggctacatgagccccaatctcaaaacacaagtaataatcataccaacattaggtagtcattattaatctttgtttatttgttttctttttaagacagggtttctctgtgtagctctggctgtcttagaactcactctgtagaccaggctggccttgaaatcatagaaatctgcctgtctctgccttctgggtgctgggatcaaagctgtgtgccaccactgcctggcttagtcattattattaatcttaatggtggttgagccaggtggtcacagaaatttgtattatgtggcctttgcatgattgataaatccaaaagacactgtgcagggctggggtggtgcccagggaataacgtgttcgccgtggagtaatgtgtttgtttgccgtggagtaacgtgctcgccgtgcaagcaagagggcctgagtttggattcccagcactaggaggcagagaaaaggaagccctggggtctctctatccaggccagccaatccgtgaggtccaggttcagtaggagaccctccctgtcttgccaggtgtggtagcttgtgggtccccaccccccttggttttctttggagacagggtttctctgtgtagtccttggctgtcctgggactcactctgtaatgtgagcctgtaagccaccgaggatttcccggcactcaaaatgcacacaatactcggaaatattttttaaaaagattctatatttatatnnnnnnnnnnnnnnnnnnnnnnnnnnnnnnnnnnnnnnnnnnnnnnnnnnnnnnnnnnnnnnnnnagtgagttccaggccagctaaggctatgtagtgagaccctggagagaaagagagacagagacagagagacacagagagagacagagagagacacagagacagaaatcaatggaatgacccagtggtgaaacatttgcacacagcctgcttacctgagttcaagccccagaacccacaggaaggtggaaagaagaacagctccattaagccgtgctctgaccttcacctgtgtaccctgcccagggcacacactagataaccataataggttagttttaaaagcaaggtgctttgcactgcatggtatctgcactcagcagttctttcctgttgggtgttcaaaagacagtgtgatagaaactcactatctggcatcgttggtttcttggctttgtgcgtgttaaacctggtatttctaatgatacagtttaaaaaaaaaaaaaaaaagcaaggtgcagtagtaaaagatgcccgatgcctgatagcaaactctgtgctccacacatgagcacctatgtgggggtgtacatatggtagataggccacacacacacagagtatataaactgcacacacaacacacatagagagtatataagctgcgcgcgcacacacacatacacacagggtatataaacttcacacacatacacacacacacacacacaaagtatataaactgcacacacaacacacacagggagtatataaactgcacacacatacacacacacacacatgcacgcagagagagaggcagagagaggtactaataccttcactatgtattccttattggactagagccttaaactcacagagatccccctgcctctgcctcccgggtgctgggattcaaggcgtgctccaccctgccctacacagaatggaggaagtcttcatcttcccttctgaacttgtgaccctcctgacctcccctcctggatgctggattatattatattatattatattatatacaatgctggattatattatatattatattgtgcatgcggcactgtgccattctcaatttgcttttgagcaaacagaacatatgtacgcgcccactccgatttgtttcactcattcctcccctcccccacccacctcccagtgctgggggtggaacccacctggagtcccaaaaaagtctcgtctgttctgtacctactcagtagagctgtgtccccacccccctacaataacttgcttttatttggggagtctgaatctggctatgaaccatatagtgtggaatttgctatatggaccaggctggtcttaaactcagtagagatctggctgcctctgtctcctaggggatgggaattaaaggtacacaccaccattcctaacttttaacttataagaaaaaacccaaataaaaaaaattaaatattttttaatgtatatgggtgtttttcctgcatcaaagtctattcaccacacttgcccacagaggccagaagaggccattggatccctggacccagagttatagacggttgtgagatgccatgtgtgagttggggactgagcccaggttctatataagagcagtcagtgctcttaggcactgaacagtctctctagattcttattttaactttggagctttttgttgttgttgtttaattttttttgagacagggtttttttttgtttggtttttgtttttttgagacagggtttctctgtatagccctggctgtcctgaaactcactttgtagaccagactggccttgaactcacagagatctgcctgcctctgcttcccaagtgctttgattagaggtgtgtgctgctaccacccaacttaaaaaaaaatttttttttaaatgttagataggagctgggcatggtggcgcacccctttaatcccagcattcgggcaggcagaggcaggtggatttctgagttctaagccagcctggtctacaaagtgagttccaggacagccagggctatacagagaaaccctgtctcgaaaaaccaaaaaaaaaaaaaaaaaaagaaaagaaaagaaagaaagaaagaaagaaagaaagaaagaaagaaaaaaaaatttagaaaaagttagatagggtggagaaatggctgagcagctaaaagctgttcagaagacctaagtttgattcctagcacctatacggtggctcacaaccatctgtaactctagttccacggggtctaatgccatctgctggcctctgaaggcactacatgtatgtggtgcatacacacacttaggcaaaacaacacacacacacacacacacacacacacacacactcacgtgccctgggttcagttcccagcaatggagaaaataagaagacattctagttgcccatccactactgaataattttttcctggtttttctgaagtctctgtcagagctttgatgtccccttggaaaggtttcaataaggattcattttacttatttttaaactatgtgtagggtggggggggggtatgtgcacgtggctacaagtgtctacaaggccagtagtcatactcccgagctggagttacaatcggttgtgagcattctgacatgggttgggtgccgggaactgaactcgagtcctctgcaagaatggccggggctcttaaccgctgagctatctctccagcccccatgagcggtacttacagtgtttcagtagtgacagcgaggcctgagggaatgccgggcctcctgatgattcagcccttctcccctgggtcagactctccagtgcaccatcacaggcctgactttctgggactccagctgccaggctgaagacactgacgaccatcttgtcctgagtagcgcctactccagctgcggcatgaaagtgacagcccatgtggtcagcaatgaggtaaggcctgggagtaggaaggtgtcatgtccagcagagtcggtgtcccctcagacacctcactgatcccggggctgagggacattttggggagcgggaagcagcagtgagtaggagccaaaacatagatgctgctagcttggcccttcccacccatcagtcaggcctgggagacaggatatcctctggggtctttctggctctgaccggcttcttggctctgtctttgcaggtgatcatcagtttcccgtcaggctcaccaccacttcgggtgagatggacggtcctacaaggctctccaactggtgcagggtggcctgctggggtggggccactttctggcctaccagggagcagacctcaggaaactcaggcctgaaccctgacaaggcccgtgtttccagtgtgcctcagtctccccttccatacaatgggagcagtgctgctgagggttaagctttcggcctcttaaatccaggcaaccagctcacagtggctgtgtcaccttgggcaaatcatttaactctccccggggctcaatggtcattggctataaactgtggcataaaaaaagtccccaccccataggggtctttaaggagcagtaccgagaggtgtgaagtttctctccactagcccaatgccaagtgatttcttcataaatgtgagaactatgagtttattatttaaaaggtgaggatggtggtcaggcgattcctgctgtcactccgttcagaccgcccgcctcctcgtgtcctcccacagaaaaaggtacagtgcatcgacatggacagcctctccttccagctgggcctctacctcagcccgcacttcctccaggcatccaacaccatcgaactaggccagcaggccttcgtacaggtactgtgcaccccacctaactatctccttgagtcttctatgggcctttcttcccaacgttgctaaagagaagatcggatgccaccttccagaggaaggagaaggccagcccgggtgtgtgtgtggaaggcacagagagaaaacgacttgcactttggaatgtcactctgtcctgcctgcttgttcctggagcctgtggggctccttcttgtcttttattcagaggggtccctttctaactgacgtcaagagggcgagggcgtcagtgaagagccaaggatacctgcgtgtatctcctccgtctgtctgtctgtgcaggtgagcgtgtctccattgacctctgaggtcacagtccagctagatagctgccatctggacttggggcccgaaggggacatggtggaactcatccagagccgaacagccaagggcagctgtgtgaccttgctgtctccaagccctgaaggtgacccacgcttcagcttcctcctccgggtctacatggtgcccacacccaccgctggcaccctcagttgcaacttagctctgcgccctagcaccttgtcccaggtgagtggacatggcttgagactagtttcactgaagctgtgatgtcagtatatacacacacctgcaactatccacctacacgtttatcctctacatattttaacatccatccatcacccatctgcccacatatcaggatcccaaccatttatccacatacccatcaatctacctacctattcatggactccacctacgcacccaccagaagcctagccattcattcatagacctacccacatacccagctatttactcacccacccaaacaacccacatacccaaccatccacctacccacacacacagcatttactgcctgtcaatccatgtacctatccacccatccatcatctatccaccaatctacctacctatccacacgcacactcctgcatccacctacctcccctctccctaccagccgctcacccatcacccaccacttgcccttctatctactcatccacaagcatccattattctcaatactttcactagctcacctagttactcacttactctagaatcccacccacccactaaccacccacctacccacccacatggcgatcaccaatgtgactgatctcaggaaacttgacactctgccctgctggtatcacacgttgccctcagtcctgacacactcacaagaacactccaggtgtctgcacacagatttctttctttttttttttccattttttattaggtatttagctcatttacatttccaatgctatatcaaaagtcccccatactcacccacccccatgcacacagatttctaggactcaaaacctcctgaagctgggcccccacacagacagctatacctgtcttccaggccctgagcctccaagcatctgggctgacctggcttgtggctcacggcttgcacaggctaacagatgctgggctcctactggagaccatttacagtagccgcaggctaccctgctgctctcgcacaccatgtgcctccctaggatttgcctgcagcctcccagcctgaaaatagcggacaaatgactcagccaagggctgggatggcagcaagggagagctgcagacagggagaaccgcatgctgccagctgaaggctgggtcacttaccagactcctccctcctcaggaagtctacaagacagtctccatgcgcctgaacatcgtcagccctgacctgtctggtgagcagagaacagggctgggaatggagcccagatatggggcccttgggaggagaggagggtttctcaggcccagcagcccgaggagctcacagtaagatgccaggtgccatagacagccctccactctcagacccctcctgggcctcatctctgtcccgttagtcactggttgccatgatggaggacttaacctcctggacagaacataaggcaccttagctatggtataagaccccacattccttgacatctcaagggtagaggaagccccttgagcctaacaccctctggtctctattgttcccctgggcccaggcactaccaggcaagagagtcctgttgctaggggcagatacaagcggtgtagcctaggatgggcctagcctagggctgagaatgcagggctcctaaactccctgcacagacagtaagtctaaggagactaagggcccagaactatgtagaaacaggagggaagcctgcagtaacccgagcagcactggttttaaaaagatgctctggcccatttgaatctggtgtaaggtgcagaggtggggcggctggttggagaggtcacacagcatggcagagcaggccccttcattctttgcacccacaacaccatccataaaggaattacctgctgggctttggagacaggagggtggcccaaagagcctggccggctgggccctcggcttagtaccgaactagatgaagagacctctgtccagagaagtcgagtcactgacccagttgaatctagctaatacccgtgaccaaggccagcatgagagggtagggacaggcctgaggccacaacacactgactatcttggccctcctttgtcacacaggtaaaggccttgtcctgccctctgtactgggtatcacctttggtgccttcctgattggggccctgctcacagctgcactctggtacatctattctcacacacgtgagtatcccaagcctccaccccattcccacagcaagcgctcagggcccgtccacaccaccccggggcacacccagtggagcctctgaagaagcggggagtcctggctggggccctgaccttcacccacgcccctcaggtggccccagcaagcgggagcccgtggtggcagtggctgccccggcctcctctgagagcagcagtaccaaccacagcatcgggagcacccagagcaccccctgctccaccagcagcatggcgtagtgcccagcctggagcctcggggagccccccagccagcccttgccctgcaggagagaccgagcagccacaagctggaaaccaccggccatgaacttgtcccaggaaccaaacacctcccctgcacctgttcattcctcccagtggagacttcagattggaataccttgggatctcctcaccccactttacagaactgcccaatccaggggctctgggatatggctgcccgggattacagaaagacacggcactgccgtgcacacccatgctgcttagaagcctaagcctctgccttcaagctggatcctgtgcagggtgggcaggcaagaactcagacatgcccagcctagcccagggcggcctgcatctggccccagaagcctcctcacctggactggcacaacttcggttggggaaacagaagctgagggagcttagatggggtgggggatccaagcccctcccagcccacccattggccaggcagcaggggggagtggccaggcggctggttgtgggccaagtcctgcatattcactaataaatcagacatgaaaccagtgcccctctgggttgtatgggagaagaggaagatgggcaattatgtcacagaacaagggtgcacacccctttggtcggcatggtagcagacagccagagcccatgtgtggaggaagtcagttctctctgctgcttgctcatttggtagcccaaccttgggtcagaggggacagaaaccaaacactaaaaagccctgtctacagtctctgggacacagctacccctataaagttctgggttctaatcctgtacatgactcttgtgggcaatgagcctgtggacagctccaaagtcagccaccctccctcatctgtaagatgggcgtccaacttgaatgcattgtcaccaaggaggcttgcgatgcagtgccttggtgtgtgacacacagtgtgccagtctttcatgacatgagaggactaatcctaggccatactgtgttaaactccaacccccaaatgtctgatgagggagctaggagaataggagtcaatcaaaagttttgtcatttatttacaaaaaataaaaaataaaagggtttaaaagcttcaattagttccagcaacacagtccccaaatgccaggcaagggccctctcttttgccagaaagcattgggagggaggaggaggtctctggtctaacctcaggcaggatccaggctgctcaggcagctgcaacagtaagctggacctgagcctggaggcagcagggagatgggccaggctgaaagcctgctacgatggtggggactctgggaagcaccctgctgtctctgccagaggaaggagaggccgaggtacagagagcctctcccatccctacactctaccaagagcccaggaccctgggccagtccgaaaaaatctgagagcagaaatcacaaggcactgagtataagagtctgtggaaaggcagaccgatgtaggatggtccttggctactgggacatagagggatccagcagtttcagaaccccgcccaccaggtgcaggcttcctgtaaccagtacatggatggcagcagcctcacggagaatgctggccccgctgttggctgtggggtggttgagaagattcccttggaaggctctggggctgaaagatgggatcccgggccttggctgatcccacagcaaggcgtgggagatgcagctgaaaacgagggagctcgtcctaagtaggctgaggtgggtgcggggccagcagcagggagcctggcccagcagggtctgggccgcagctgctccagaggttggagctagcctgtttctcagccaggccgttccaatgctgctggtgttggaggcagcggagcagcacctggtccagagtcacagtgaagttctgctggtctgtggggtccagaaccaggcatgtcagtggagggggaagggaaagggagcacggtgagcatctgcttaacccttacaagcacaacttcaccagactgctggctgtctgcacgatggactgtgaccagtgcaacctgctcactgtcatgggaagcacgctcacctttacaaactgtcccctggggtccctcacgtgtgggcatgagtgtttcccaggaagcctgttaaagacacaggtcccagatctccccagttggtccaatgtggaacctggaggtctatctgcatggttcacacacacgcttttaaaatacaatgcatacaaaaagcattctgggagtcagtgagatggtttagtgtgaggggtgcttgccaccaagcctggcagcctatatataatccccatggcccacgacccacatggcgccaggagagaactgactcccccaggttgtcctctggccttcacccacgtgccccaacccaaattaattaatgtaataaaaaaacagcttttaagccgggcgtggtggcgcacgcctttaatcccagcactcgggaggctgaggcaggtggatttctgagttcgaggccagcctggtctacagagtgagctccaggacagctagagctatacagagaaaccctgcctttctcaaaaaacaaaaacaaaaacaaacaaacaaacaaacaaaaaacgtacttcacactgcaagctagttctacactcttccatagggacccagagctgagtcttcagcaggcagtacctgcccatcttcgtgcagcgcacactggggttttctattctcttccagtcaataaatcttagttgagtctcactgagctgatttcagtaggtgtcagtgggctgtaacctgccctttaaaaaaatgctatacctgataattctttcacagtgctgtgactacatgccataactttgaaaatgtaccaaaaggtgtttctacaataaaatctacataccctggggctggtgacgtgactgagttgttaaacatcccttgctgctcttgcagagaaccggggttcagctcctagtacccacatggtggctcaccaccatcttaaccccacttccaggggatctaatgacttctggcctccacaaagctgggcactcagacacacacaaacaataaaaataaatcttaaaaaccaaaagccgctgtctcctagcatgctttggaagtccctgttcctcactgagcagtctgccatgggtgcctggcattagccataccatctgccccctctcacctgcatttcctatggatgaaacctctgtcacgttggggcagaagacagcgtagtcaaactggcagggctgggagaccaaggggagacgttattagtatcagtcttctgaaagatgtccctcacccccacttgacttccaaatactccccaggccacacctctggagacaaccgcccctgcactgggatgtgtagtaacgagccacagccctccacagctgccccatctgcctcagtgcactgcctgctgtacaggaagctcgtgcatacatgtactgttctgagtgcagagtcaggtggtacctacttagggcagccgagctgaggagcaggccccaaacccaggctggagtagtctctggatatgaaccactccagcctcctgtcctgaagtgggaagtgattcgaggagccactctggccctggcagcctagcactgacgcagccccgcaagcaaagcatgacagggattggctccatttacaggtgaggacgtccaggcctcggcgcccaccagagccagggccacctgccgcctgcccaccctccaggtgggtcctttacctgcagcagcttcagcagggcagcagagtccctgtcaccagtagagttgaagagcaagatgtgtacttcggaccctctgcatcaggaagaaatgggtgggatatgccttctgcccttcctcctacaccattccagccatttccccagaatctaacccatgtgggttctctgtaagagcagcgatgtaacagccatctctccagcgccagggtatagactttatcgtagaaacaccatttaggacattttcaaatctgtaccatgtagcggcatcactgctaaagaattatcagtagagcatttttttctaagagcaggttatagcccactgatagctactgaaatcagccctaagggggttattacccaccctgcatgctcagacagacttgcaagagagctcacccatcggtgcgtttgctgcgctccaatgactggcggtaccagtgcacacaggcctgcacactgctggtggtatgggcgccatccaggtaccaggtaaggggtccccgctggagtatctgtgtccggccaggccacactgtgtcccgaagccctggcaaaggcagatgagacagtgctctgggatccacaacaaggcctgtgatctcctggccctacaggcagatccacttactaatggctgtctctgggttcctggaatgagctgtcctgctgtgaaatcttccagacagccctgagatggggctgctattacacaatcatacattccccaagtgacagtcagtgttgtgctcacacagcaagtgagggctagggctggagtttgacccaagatctgctccagggctgtccctgacagcaaccctggcacactgaagctgttctacaggggtctaacagtttgagccttactctgggatgaaagcagtttagaggactgaagcaggggcaccctccctcaatctgactggcactctgctccaggcttcccggctctgggctcacacctgaatgatgtcacaccaggaaccatccaaacagcccctggcagtgggtgttatcagcatctcatttggcaggtaggaaaactgagctgtgaactctaggccagagaggaatgctcaccccgaggcactacctacaactgccccaacccccaaacaggaaaccaaaagagacatctgaaagggcacacagatacaataggaactcaacatacacctcagggggaacggaggtgtgcagactccggattggggaggaaattccaacttaccacgcctcatgtgaggggtagggcggaacacaggtgccaggggcagctgccaccgtatgcttggcctggataccttcagctcctggatgtctgtagggtgtgagtctggattcagacccctccaaggcaggctccactcatgccttggagctgcccacctgcacgcccacactggcccacctaccttggtggtcctgccgctccagccaacagtgggccagctgcaaggccaaggcagcattagaccgctggtgtgctccctccagacccaggctcaatggcagtccaacctcctccagggcttccaatggcggacacaggtacaacgggcactgtggggggagggggagagctggtcagctgacctgccaccaccactatgttagaaagcctctgaccaccagggcccatcaccaaccaccaaaaccaccagggcctaccaagacctgcttccagaaccagatgcgtcctggagccacaacagctacccccgctatcccctttgcacatgaggaacccaaagcccaacaggagactgtgttcttctagtcagcacacccctccaccccaccaagccagccagtcactcactccaatctgctgggctcgatccctcagcacagccaggggaccttctggctgcaccacagtgaaggcagggacaccaggctgcaggcacaccagaaaaaagggacaggggctgatttcaactgaggccacagagggagaaggaggagaagccaggctgtgcagctggctaggacctggtaatgacttgccacagtcattcttcagtaagcggtaaaaggacagaccctgggctcccatgaacctctcctgccttggcccgctatgttaccttaaagatgccccctttctgccatgctattttctccactgtatctcctagtagactggtgtggtcaatgccaagagaggagactccacacaccactggctttctgaaaaagacaagaaagtcctgctccccagtgccgagccgttgcgcaggctccgggtgactccacagccacggcggctaccttacctgatgatgttggtgcagtcaaaagccccgccaatgcccacctccaccactgccaggtccacctgtaggagagcagaaagcacacagggagcagggaacccctccactcatgctctgctccccaaggactcagacacagggctaggaaagacactcaccttctcttggaggaagacatggaaggccatgagtgtgaggaagcggaagtaagagggcatggagacatggctgtcgtcctgcacacagaaggagccagtcagggccagagccccgtaccccacacggggatgggccctccccagtccccagccacagtaccttgaactcctccagctggttatagaggcaccagaagtgcttggtgaagagctcggggctgattggtttcccgttgattcgaatccgctcccgcacctgcaccatgtgaggagagctgtggagagacctggggtcatcgggactccccacttcccaggccttccttgccctaatcagactgtgtctgccctgttcccgaggctccatgacgtacgtcctcaagactcttgagctcctgcctagggcctccagagcctgtggaggctgagccctgccccagcagcttggcggcccctccagtccctagccaggcctaccgtctgtctgtcggtgggttcatcctacgataccactctcaactaagacccccacctcagaaaggagggagatagccctgtccccacgatgatctaacagagtctctgggccccaaaggattagtaactctgctaacacatgcctattaacagccgtccgcctttcagtctcaaagcaataaatccagaggaaggaactgtctggagtcattcccctgccgcatccacatctgtaggctggctggctggccgcgtaggccaaggtcagtggttagagctttattatcagggaccagcgacatggcacatgctgccaacgttgatgatctacggtcatcctaagaactcacgggagaaacttctcctaaaggttgtctcctgacctctcacgtgggctacagcaatgcacacgggcaaacacacacgcactaaagcttgtctcctgacctctcacgtgggctacagcaatgcacacgggcaaacacacacgcactaaagcttgtctcctgacctctctcgtgggctacagcaatgcacacgcactaagacacccaaggtaatgaaaaagtcattacatgttttcaagcttcaaaagtattattctttggtcaatgacacatatactgtgtcctatcgatgcggtggccacaatcacacaagcctcctaagacatgtctgcattttaagtcctcaaagaccctctcacaccaagtcatctccctttcttttcttttgtttttttttttttagatttatttatttattatatgtaagtacactgtagctgtcttcagacactccagaggagggcatcagatctcattacggatggttgtgagccaccatgtggttgctaagatttgaactctggacctttggaagagcagttggcactcttaaccactgagccatctcggcagcccttgtttcattttttaaggtttctctgtgtagccctggctgtcctgaaactcgctctgtagaccaggcttgaactcacagcctgtctcacctactgagtggtgggatgaaaggtgtacgccaccaccgccctgcccagcttccatgtctttattttgaacaatcaccagttccaggaaactgacatgtcagttgatctgaattggccccagccaactggcttcaggtgcttatggaggtggcctgacagaactgacaaagctaatgtcggatacgcttctccctcaagggacaaatccccaggagtatactcatatgcactcctctgaaacgtcctctgtttaaggtgacaggggaggagaggctcgcatcagtaagccagctccacatcttgtgggcttctgatgtctgtgagtcaccacaagggggcgctgctccagaagaaaccacagctatccctggcagagctctactgcctccctgtggagactctgacatgggggccatagccaaactggctctgcacctttatgagtcaggtttgtgttccttactgcagagacatcttagccaacaaatatctctatgcttaaaaactggatctggagagcctgggagatggtttagtcagtaaagtgcttgccacacaaatatgagggcctgcgttcagatccccagtattctcacactccatcctcacccaccccaaccgctgcaaaaagaaaccagccagcggctgtgaattgattaccccacttctggggagcagacacaggagcatccctggggttgctaatgcatagttatccagctgaatctaggaactccaggttcagtgagagacccaatctcggaagaagacagagaggagagggggaggggaaggggggagggagaaggaggggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggaagagggggaaagggggaggggagggaagggagagtgggagagagggagggtagagggtaagggagagggggaaaggaagaaggaaggaaggaaagacagaaaaacacacactgagataaacatatgcttgtgtgcccatgcacacataaatcatactcaaaggtgggtaaagtggtgcacaactttaatctcagcaatcaagaagcagagacaggttagactgtgaattcttcgccagactaatctatagaatcccaggccagtcagagcttcatagagagacaccccaccccccaaacaaaacaaacattaaaaaagcagacaaaaccaagttgtgcagtgcggtggctcacacccgcaactccagcaggagactgaggtaggaagagcccaggttgtaggcctgcctgagggacaaagtgagttccaggtcagcctgggctagagtgacacctgcctcaaacagggactggatcgatggctcagcaatgaagagcactgaatgctcttgcagaagacctgggtttcattcctaacacacacgtggctcagaaccctgtgtaattccaatactagcacatacatgcagcaaaatacacacacacataaagcaagaagaataatttaaaaatttaacgggcaaaaattacatttggaacttaaattaataaaaggtcacctggttcttccagccaggtacttaggccacaccttgagacacaggtcgcctctctccctccaatttattccttatggaaactgatggctgctattagtgggctaacactggcactgtggatttaatgtttgctgaatcaacaaataccgggggagaggcagagaggctgaccttggctctagcaccatagccttctagagctgagacacagacacccacacccactcacacagagcccagtacctaaagaagccggtcttcaggccgtaattccgcaggatccgttcggtgaaggcacaggtggagccctggaaagcattgggtaggatgaaatgatgggtactgctggttgtcgcccagaatcaccagggagacgtgccgggcaggcctggggaggagtttctcgacagggttgaccgaggcacacaagcacacatcaatcccttcctgactgaggatgcaatgtgatcatgtgatcacctgccatgggggaccacatctcccagaactcacagccaagtaaactctctttcctacatgcccgacatgacagtctgatgtcagcttggcaaaagctggccatccgagaggggaaacctcagcgatccagcttatgggagcctccataagctccagcatgaggtgccgggcgtggtggtggcggcgcacgcctttaatcccactactggggaggcagaggcaggcggatttctgagttcgaggccagcctggtctacagagtgagttccaggacaacaaggactatacagagaaaaacctgtctcaaacccccccccctcaaaaaaaaaaaaaagcaggctgagaaagccctgatgactaagccaatatgcggcatccctcctggcctctgtatcagctcctgcctccaggttcccaccctgtttgagttcttgtcctgacttctttgggtgagaaactgttctatggaatgcaagtgaagttaacccttccctccccaggttgcttttggtcatggtgtttcagcacagcaatcgggaccctaacaggacaccctaaggtgctctttggtagcagcatgtagagaatcaattaataaagttggacaggcaggggctggagagatggctcagcagttaagagcactgactgctctcccggaggtcctgagttcaattcccagcaaccacgtggtggctcatagtcatctataatgggatctgatgccctcttatggtgtg

SEQ ID NO: 812 - DNA, 2885 bp, Mus musculus
cgcatttcctgcctctctgggccgggctggatgagctgagctccctgccctgacagtcagacccctgccttcatctgtgtcccgtccccaggccaggaccgccgacagctgctgcccgaaagagcccagtgactctttcccaccacccagtcagctagagactcctgccctgctgtgagtctcgagcccacttctcctgacttctccgccgccacctcagaaggctggagcagggacgtggtcgctccggccgcctgctcccttcggatccccgcgcgaacccacgcaggccccggcgcccgcccgcagccttacctctggataccggataaggcccagcgcacagactcccgggtggacagcatggaccgtggcgtgctccctctgcccattaccctgctgtttgtcatctatagctttgtacccacaacaggtctcgcagaaagagtcggctgtgatctacagcctgtggaccccacaaggggtgaggtgacgtttaccaccagccaggtctccgagggctgtgtagctcaggctgccaatgctgtgcgtgaagtccacgttctcttcctggattttcccggaatgctgtcacatctggagctgactcttcaggcatccaagcaaaatggcacggagacccaggaggtgttcctggtcctcgtttcgaacaaaaatgtcttcgtgaagttccaggccccggaaatcccattgcacttggcctacgactccagcctggtcatcttccaaggacagccaagagtcaacatcacagtgctaccatcccttacctccaggaaacagatcctcgactgggcagccaccaagggcgccatcacctcgatagcagcactggatgacccccaaagcatcgtcctccagttgggccaagacccaaaggcaccattcttgtgcttgccagaagctcacaaggacatgggcgccacacttgaatggcaaccacgagcccagaccccagtccaaagctgtcgcttggaaggtgtgtctggccacaaggaggcctacatcctgaggatcctgccaggttctgaggccgggccccggacggtgaccgtaatgatggaactgagttgcacatctggggacgccattctcatcctgcatggtcctccatatgtctcctggttcatcgacatcaaccacagcatgcagatcttgaccacaggtgaatactccgtcaagatctttccaggaagcaaggtcaaaggcgtggagctcccagacacaccccaaggcctgatagcggaggcccgcaagctcaatgccagcattgtcacctcctttgtagagctccctctggtcagcaatgtctccctgagggcctccagctgcggtggtgtgttccagaccacccctgcacccgttgtgaccacacctcccaaggacacatgcagccccgtgctactcatgtccctgatccagccaaagtgtggcaatcaggtcatgactctggcactcaataaaaaacacgtgcagactctccagtgcaccatcacaggcctgactttctgggactccagctgccaggctgaagacactgacgaccatcttgtcctgagtagcgcctactccagctgcggcatgaaagtgacagcccatgtggtcagcaatgaggtgatcatcagtttcccgtcaggctcaccaccacttcggaaaaaggtacagtgcatcgacatggacagcctctccttccagctgggcctctacctcagcccgcacttcctccaggcatccaacaccatcgaactaggccagcaggccttcgtacaggtgagcgtgtctccattgacctctgaggtcacagtccagctagatagctgccatctggacttggggcccgaaggggacatggtggaactcatccagagccgaacagccaagggcagctgtgtgaccttgctgtctccaagccctgaaggtgacccacgcttcagcttcctcctccgggtctacatggtgcccacacccaccgctggcaccctcagttgcaacttagctctgcgccctagcaccttgtcccaggaagtctacaagacagtctccatgcgcctgaacatcgtcagccctgacctgtctggtaaaggccttgtcctgccctctgtactgggtatcacctttggtgccttcctgattggggccctgctcacagctgcactctggtacatctattctcacacacgtggccccagcaagcgggagcccgtggtggcagtggctgccccggcctcctctgagagcagcagtaccaaccacagcatcgggagcacccagagcaccccctgctccaccagcagcatggcgtagtgcccagcctggagcctcggggagccccccagccagcccttgccctgcaggagagaccgagcagccacaagctggaaaccaccggccatgaacttgtcccaggaaccaaacacctcccctgcacctgttcattcctcccagtggagacttcagattggaataccttgggatctcctcaccccactttacagaactgcccaatccaggggctctgggatatggctgcccgggattacagaaagacacggcactgccgtgcacacccatgctgcttagaagcctaagcctctgccttcaagctggatcctgtgcagggtgggcaggcaagaactcagacatgcccagcctagcccagggcggcctgcatctggccccagaagcctcctcacctggactggcacaacttcggttggggaaacagaagctgagggagcttagatggggtgggggatccaagcccctcccagcccacccattggccaggcagcaggggggagtggccaggcggctggttgtgggccaagtcctgcatattcactaataaatcagacatgaaacca

SEQ ID NO: 813 - protein, 730 aa, Mus musculus
LFPTTQSARDSCPAVSLEPTSPDFSAATSEGWSRDVVAPAACSLRIPARTHAGPGARPQPYLWIPDKAQRTDSRVDSMDRGVLPLPITLLFVIYSFVPTTGLAERVGCDLQPVDPTRGEVTFTTSQVSEGCVAQAANAVREVHVLFLDFPGMLSHLELTLQASKQNGTETQEVFLVLVSNKNVFVKFQAPEIPLHLAYDSSLVIFQGQPRVNITVLPSLTSRKQILDWAATKGAITSIAALDDPQSIVLQLGQDPKAPFLCLPEAHKDMGATLEWQPRAQTPVQSCRLEGVSGHKEAYILRILPGSEAGPRTVTVMMELSCTSGDAILILHGPPYVSWFIDINHSMQILTTGEYSVKIFPGSKVKGVELPDTPQGLIAEARKLNASIVTSFVELPLVSNVSLRASSCGGVFQTTPAPVVTTPPKDTCSPVLLMSLIQPKCGNQVMTLALNKKHVQTLQCTITGLTFWDSSCQAEDTDDHLVLSSAYSSCGMKVTAHVVSNEVIISFPSGSPPLRKKVQCIDMDSLSFQLGLYLSPHFLQASNTIELGQQAFVQVSVSPLTSEVTVQLDSCHLDLGPEGDMVELIQSRTAKGSCVTLLSPSPEGDPRFSFLLRVYMVPTPTAGTLSCNLALRPSTLSQEVYKTVSMRLNIVSPDLSGKGLVLPSVLGITFGAFLIGALLTAALWYIYSHTRGPSKREPVVAVAAPASSESSSTNHSIGSTQSTPCSTSSMA

SEQ ID NO: 814 - DNA, 59725 bp, Homo sapiens
  misc_feature (1)...(59725): n = A,T,C or G
ttactctgttgtccaggctagaatacagtggcacaatcatagcttactgcagcctcaaactcctgggctcaagtgatcctcttgcctcagcctcccaagtagctgggactacaggtgtgcaccaccacacccagctaatttttaaaatttattttattttgaaatggggtttctcagactcttgagctcaagtgatctgcccacctcagcgtctcaaagtgctgaaattacaggtatgaaccaccacgcctgggttaatttttattttttattgtagacaggggtctcagtatattgcccatgctggtattgaacacctggcctcaagtggccctcccgcctctgccttccaaagtgctgggattacaggtgtgagccaccacatctagccagtttttgttttttgtttgttttttttttaacaaaaattggaagaaaatgtatactgaacacccgtatacccatcaacatttagcaattgttaacattttcccatacttgcttccttgtttaacttttgccaaagtattgtatttttatttatttatttatttgagaccaagtctcactctgttgcccaggctggagtgcagtggcgtgatctcggcttactgcaacctctgcctcctgggttcaagcgactctcgtgcctcagcctcccaagtagttggcattataggcacgcaccaccacacccagctaatttttgtatttttagtagagacggggtttcaccatgttggccaggctggtctcaaactcctgacctcacctgcctcagcctcccaaagtgctgggattacaggcgtgagccaccatgcctagccttgccgaagtattttaagtaaattacaaatatgagaaaaatttacccctaaagtatgaccaaagtctgggcactccactgcaatccagcctgggcaacagagtgagaccctgtctcaaaaaataaataaaaataaaataaataaagtatgaccaaaaataagaacattttcctaaataaccacaattcagagtttcaataacactaaattcagactcttgccactctcacacacactctcataatagctaatagcccgtgtgcaattttccccagtgtctgcaaaatgtgtcttatagctcatttgttgaaacttgcatgcaatccaggactgcacatcgcatttggttgtgatgctcatcagatcttatttatttatttatttatatttttgttgcgacagtctcgctctgtcacccaggctggagtgcggtggtgcaatttcagctcactgcaacttccacctaccaggctcaagtgattcttgtgcctcagcatcccaagtagctgggactacagacgcgcaccaccatgcctaattttcgtattttcagtacagacggggtttcatcatgttgcccaggctgctctcgaactcctggcgtcaggtgatctgcctgcctcggcctcccgaagtgctgggattacaggcatgagtcattgagctcagccaagatctcttttaatctaggaccactctccccctctttctgtgaaggaaccagctgttctgtggagaattcctcctcctacattcacctgtccctccttatggtgttgtttaacttgcacctttatccttcaacatttctgtaaactggaagttaattgtaaagtcttcgtagattcaggttaagcctttgggccacactcgtgacgggttttaaaaccagacaggaaggttagatctgcagcacttccagctttggtgcacgcacgaatatcccggggtgggggccttgtgaaaaagctgattctcattcagcaggtccaggttaggtggtgacgcccaggctgccggtctacggctgacaccgtgagcagcttagggagatcctgcttggcggagggagggccagagggggtccggtggaggcaggagctcagggaggagtgtggaggaggaggggacccctccagggtcagtgagtgctcacccccactggtggactgagagttgggcgtggtgttgggttggataacgtcaatgctgtcacacgcttcttatctctagggacactccaggcagtggcttgtcccaaggtgctggaacattctgaccagccagtgggattagagcctctataacctgggtgctcccgggcaggactcacttggtagtggcctcagatgacccctgctctccccccaccccccgcaaagactgtgcctccaggtcttggcctcgagggccctgagggcctgggccggaggcgctgaagtgggagaggaaggaagtggggagcagaggaggccaaggctgtcgcctcccagccgctctaggggcctcgagtaaacaggaaggcctggcgactccgcgagggggggctttagaggagtgggggccaggagccctgttggacacgtgcagcctgtgcgcacagggctccctcactagggaagtgggcccagagaggctgtgtggttgggcccagagaggctgtgtggttggccccaggtcgcacagcagcaggggcagggggtgagaccttctccctgtgcccaggggttctagtgcgtgggctcctgcatgggttgccatggtgggaatatacactgaaataataataagccaggctcagtggctcacgcctgtaaacccaacactgggagtgctgggtgagtccctttccctcttgggcctcagtttctctttctatgagctcagagcccttaccactcagaggttctagaatcctggcccagtggaatcctctgtctcctaggggggtttatgggttctttagctctagggggtgtgtttcatcaggaaggccaatttcacccaggatttggaggctccagctcccagggccccttccttggggaaagagagggtgactttaagggactctgctcttctagaacagagtagggtctggcgggacgtgaccaaaccctactcttggggagtcattccccctcttcagagaccctgtccctgcgctcagaatgcccccaacacccataccctggggactcaaatcatcgcccgtgagaccttgagccgtataacccagtggccaaacccactcattgattcacaagcttcttcagcacctgccaggccaggcactactcctagtgatggggattcagcagcaaacaaggcagaaccccggtcctcatagaacttctgttctggaaaggaagacaaatcaatcaacaatatctagtgtgtcagccgggtactgtggctcacgcctgtaatcccagcactttgggaggccgaggatggtgcatcacctgagctcaagagttcgagaccagcctgtccaacatggcggaaccccgtctctactaaaaatacaaaaattagcaaggtgtggcggcgagcacctgtaatcccagctactcaggaggctgaggcaggagaatcctctgggaggcagaggttgcagtgagccgagatcatgccactgcactccagcctggacaacagagcaagactccgtctccaaacaaacacaaacaaacaaaaaaacaatatctagtgtcagatggtgccatgtgggcccattgctagtgggaggagagggctgttttaaatgcgctgctcaaggaagacctcgctggccgtgtgacatttgatcagggatgagggagcgagccctgtggcgacctaggggaagaatgtttcagcgagcagtaacagcaggtgcaaaggccctggggtgggcgtgtgcttggcacatttgagaaagagcaaggagctggggtggagtagggtggaggcgagcagaaggggaggctgaagagggggcagggagaaactcattggcctgaggggctttggctttgactctgagggagacgatggccagtggagggtgctgagcagagccaggacggaattggactgaagctcccgtgatagcggagaaaaggctgggggcaagttggaagcaaggtgggctcagtgcagggactggggactgtgacattccaagagggaggtggctgtgggtggtgagaagcagccatattccacggtccctgggaatctgagggagggcctgccagatttgctgtggcttggatgaaggcatgagagaaagacccaaggtcaaccccaaggcttgtgtagtaggaggaggtcaaggtctgagatggaaagactgaggcaggagcagtttgcagagaaagaacagagcccagttttcaacgtgtggagtctgagatacgacatccagggccctggagccagggggagttctggctggagacatacagtcgggagcccttgatatctagatggtatttaaagctgttgtctggacaaggttgcctggaacaggccttctcaaacgttgacgtgcacacgattcccttggggatcttgtgaaaacgcaggttcggatccagcaggtctgggacaggacctaagagtttgatttctttttgttttttttttttttttgaaacggagttttcctctgttgcccaggctggaatacagtggtgtgacctcagcttgctgagatcaacctccgcctcccgggttcaagcaattctcctgcctcagcctcatgagtagctgggattacaggcgcgcgaccccacacctaatttttgtattttcagtagagacagggtttcaccatgttgcccaggctggtctcgaactcctgacctcaggtgatccacctgcctcggcctcccaaagtgctggattacaggcgtgagccactgtgcccagcccttgcatttctttttattaaaatgttttcatttttcatttttattatttatttgagacagagtctcgctgtgtcacccaggatggagtacagtggtgcaatctcagctcactgcaacctccacctcctgggttcaagagattctcctgtctcagcttcccaagtagctgggattataggcacccaccaccacacctggctaatttttgtacttttagttgagacggggttttgccatgttggccagtctggtctcaaactcctgacctcatgtgatccacccaccttggcctcccaaagtgctgggattacaggcgtgagccaccacacccggtccttcattttttattttttagagacaaggtcttgctctgtcacccaggctggaacacagtgacgtgatcacagcttactgcagccttgaactcctgggctcaagcaatcctcctgcctcagcctcctgagtagccgggactgcaggcttttaccactaagcctggctcaaatctgcatttataagaagcttccagaagaaacaagaccacactttgagtagcaacagtctagggcatgacattttatggccgagactcgttggtgggtaacaaaaccaacagatgagcttgtgacgagtagtgaaagaaaatgcaacaggttgggggttactggagggcatcacagccgcaaatctatctacaggaccacaaaatgcgtttccattatttgagtctgagtcccagggtctgtgttgggacgtgacaccagggtcacaaaggtttgcgaaaacctggcttgggagtgagggtaaacaaagaaggaaggggccagcaaccaagcctgggggaacaaggaggaaccagggaggagacagataaggtgaccagggaggtgggaggaaagccaggacagaatgttctggaagccaagggaaaaaggcctggatttcaattatcctctgcctcttcccagccctgtggccttgcaaacctgagcctcagtttcttccatcgtaaaatgctgacatgacagcctcagccactgaagtggctgcaaagtggcacttggcacagggccaggcaagctcatggatggtggtgcaattccaattcttgtcttgccctttgaactcctccagaccagcaggctgccctccccttgtgcagatgaagaaactgaggctcagaaagtggaaagatctggctgggtgcggtggctcacgcctgtaatcccagcactttgggagggtaaggcgggtggatcacttgaggtcaggagttcaagaccagcctgggcaacatggtgaaatcccgtctctactaaaagtacaaaaattagccgggtgtgatggtgcatgttcccagctactcgggaggctgaggcaggagaattgcttgaacccaggaagcggaagttgcagtgagccaagatcatgccactgcactccagcctgggtgacagagtgagactctgtctcaaacaaacaaagatcctgcctgatgccacctggccagtgtagggcagagcctgggcaccctgctccgccctgtgggtctggccctgctgttatcaatggcccctggctccaggccagtgctggagacagtcagccgcctggtgggtccctgggggccgcctgaaattccttcagtggccagtggccagggtggacgtgctctgtcttttcctgcagccctggccttcctggccagccaggaggaagaaagagcagaaagtgtgcatctgccctctgtggggtccaggcacaggggcctggccatcagccacgcgtctctcgggcgtgtggacagacggcacctgaacacatccgtatcagtcaaagccccggcaggaaacagatggcacgttccagtaggatcattagaggagagtttggtgaagggtctgtttacacaggtgtggtcggggtgtagggaagccccaagggacggtgcagaaccccagggctggcagcggcgtgggctgtgaccaccctcagcctgaagaggccaggggaggagctgagtccacagctggacagggctgggtggagggggtccccaacaggaccgtggccttcagtggagggaggccaccagtatgcagtgaccctgcagggaaggggctggaagacggaccctcctcctcctgcctcctctgacctctgcaggggtggggaagtggatgtgtcccacaagagggagagtgcagctgggggatgtagaagacagctaccccaaggcctgtgcccagcagggaggccatgtggccaccaggcttcctcgggcaggagacccagtccaggactggccttttctcctgggaaccaatgacaaggcccacttctctgggcctccatgacccccacccctgccttgacttctagggtccctcatgctttcagcaaatccatctcaagagctgaaaggccctgggctctgtgctggggacacagcagtgcaaagggtgtcaaagtctctgccttcatggggcttctaatcaagtagagagatacatgcagatggctgcacacaggcttaggtgtgacagggaaggtcaggatgctgtgggagccagaggtgacttccgcttcaccccccacccgcggtggtcccaatctcttccttcctccatgaggtgtctggggtcggggccccagttcttcctggagtccatctggagtctctcctactttctagagaatccattgggtcttgtttacaacgtggatggggacagactgtgcagcgtggagggaaggggagggagggagttttgggaagagcctcctgtggggtccctgtcactgccccagatgcccccaacaccctgtgatacctgcagcccctgccacatctgtccctcactccaaactcagctcaggggatggtggcagggaaggaggtgagcttggacccaggcagccctggggtcaccaccctccagctggggttcctcctctgtaaagtggaggtataacggtacccacctcctggggtggctgtgaggattcagagctgataaggtgaacgcctagggcgggccctggtgcagagagagcgctcagctcctagggctggattaactgtccctggggcacagatctcggtctggggcctgtggaaacctcagagccacccctgaacccccaccgagccaccctttgcctcgcagtgcccatggcctcgtctccgaggttacaggaaaaggcagaggagatgcccttctcagggtggccctctgggagaggacactctcccttgacctcaaagccacgcttggctgcaaactggccaggcagccacaaggctgggcaagcagaacgatccctaatccccacccaaagagccacaccgaccctcccagccgctgtgacagctcctgcagagacaaacacacggcctactcttgtcacccgggccggccaataagcacggagaggcaaggcctcagaccctggacagacatcctccctccagaggcacccagggcctcagccttctcctccctccctgggcctcaatttctccacctgtgacccagggcaggtggatccagggagaagaaccttctggctccatctcaccgtgggtcctgccagcacacacaaagatttggcctctcaaagcctagctctgccagcgtccttctgctcaagaactctccatgactcccagtggccctaaggacaaagtcctggcatttgaggccctcccaatgcagggccagactctgcctctccagcttcctgtccccaccacacccctgctggtctcacggtggtccgactgtttcctgcttctgtgcctttgcttagtctggcacccctgcctggcatgctttcctcaccccttcttctccccaatcccaactcacccagtctttcaaagggcaggcctaaataccaggccctccaggtggcccaggattccttctctgagctttcatgggcctggccctgggtgctacctgtgagtagtcccacggtgggtacatagtaggtgcgcttactgtttgcagaatgaacatgggacagtttggggactgtcacccagctcagggagcactgatggggaagcatctcctgtatgtcccagggctcagtgctgtagtgtcctgaccctcagaaatctcataatggcttggtcaggaaggcatcgtgccccactttgcaaacagggggtgctgagaattgaggggccttgtccaaggtctcatggctaggagcaagcagaatcggatttgaacccagggccacgtgacttcagaagtgccattaaagtccccataatttggagctgtcttctttttttttttcttttcttttttttgagaccgagcctcactctgtcacctaggccaggagtgcagtggtctgatctcagctcactgcaacctccgcctcctaggttcaagtgattctctagcctcagcctcccaagtagctgggactacaggcgcacgtcatcatgcccagctaacttttgtatttttagtagagatgggttttcaccatgttggtcaggctggtctcgaactcctgacctcaagtgatccgtctgcctcggcctctcaaagtgctgggattataggcttgagccactacactcggcctggagctgtgttttgtcggtgaaggattttccacccatgaaggggtcagacgtgaagtgtgtggccctgggcagctcctctgagcccagagacgccagccctagccgccttgctgtgccactttgggacttccctccctagcctgagcttcagttttcctgcctgttaggcagccccatgtcaactgcacttagtaggccgggtttgatgcccgacaagacgtgaagtggtggaggtgggcaggatcccagcgctaccatcttcttgaaccagtgatctcaacacatcggatttctgtttcctcatctgcaaaatgggatcagtgagctcaggtgggtcacaaattctacaggaactactttagccaagcccggccccctgaaagttcccctcggtgggctgttagggtgattgttttcatctgtggggctccctgatgcgtcccacccaccagccttggagagggtgggatgggagggtggggtgcttggggagacaagcctagagcctgggccctcccaccccactgcctccccccatcccagggccccccacccagtgacaaagcccgtggcacttcctctacccggttggcaggcggcctggcccagccccttctctaaggaagcgcatttcctgcctccctgggccggccgggctggatgagccaggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtaggtgtccagggacccagggtggggagactcggcctccggtgcacggaccaggccccaagtattcccggcctccttcctgtatcctgagctcacgcccagcagagccatccttggggctctggagggtcaccaaccctcccagtttgctggaactaaatggttatgcaggactttcagtgttgaaagaaagcctcgggcaaactgggctgactctttcactttaaccctggtctctggcgtctgctcacccagctgcgttccattactccccgggaagcctaggtcccagaatgctgtgcagcgacgggagagtttcctggcctctctgggccttgagtttccccatgaggaatggatgggaaggagggcccacagcctgggctctgagcaccgtctctgggttcaaatctcacataggcacttccttgtggtgtgatcctgggggactgccttcgggcctctgagcgaagtggggaagagaacagacttccctctcagagctgctgaggaggtgggtggtgagggatcattgcagagagggctctggcagactggccacttctgtgttgttttatttttagctttaagttcctccagctcaccttccccagggcctttgggcagctcctcaaaccctttgaacaggccaaggctgcagggccctgccctgcctccctcctacctccctgatccccagaaagggtgcaggagtgggtgcaggccaggttaggggttctgtggggctccttggcctgggggctcttccaaggggtcatggcctctgctgctttctgaaactgaccagaggaggggtggtgaggagcaagggacccccagccccatgtcccactccctatccctcggccacctcaagccgctggccggtcctgtggacatcctttgacccacctgtgcatccaggggcttcctgacagatttgggggaagaggggcagaaatgagctgagagtgtggggaggaaggggaaggaaaacagcggtggggcagccaacttctccccacctccccacctgatggcattttagagtccctgattctgggtctctaaagctctgcccaccacctgattgacaggaaactgagtctcagacatattaagtgacttagcagggatttgactcccggcctgcggctccctaaatgtttgctcctagtaaggtgtgatagggcgaaccctcttaatgcggctcacaacgaccctgcaagatggctgccatcatcatccccattttacagaagagaaaagggaggctctaacctgccaagttcacatggctaagacggagcccctacctgagctccaagatctccctctctcgtatttgtcgctgcagtaacactctcttcctcttggtcgttagagaaaggtccatgcagacatttagggcctggttttaaaggatcaaaggcagtgatatgctgctgaataattaacaacggggtggggagctcaatttgtagcgtttgtggattttcacagcgtaagtactcccacccggctgacttcaagccaccaactcaccaagtttggagctgggaatcagtgcccggtagcacctggcggttggttctccagagtctctgcaggcgcagatcacaccgagagcagagatgacagtcaggggtgtaaaatgattagaaagaaatgagtttggacattcatgaccttttaaaaatatatagtaatagctatgtaacagccagttggaaaaactcctggaaacgtatccgtctgttcctgtgagcaggtaggagctggtcccagtgcaccaggagtcacaggctcaaaggtacaacagaccatcaacccaactcatttatggtctgggaagctgaggcccatggaaggcagaggggagcctggggccagggcctggaagccagctgggggtaggggtcggagtgaccctgacctcctagaaatgggtctagaatttgggggcaccacttgtaagaatctcctaaaactgtaccttgcatgtgacttgataccctcacaaatcagccttcagtagtcagccttctaaagttattcgtccaactctgtaaagatgcgtggtccgtgggtacctgtaacaaaaacccgataactggaaatcatctaagtgtccatgagcaaagactgttaataaattaccacacgacggaatgtcatgcagcaggcaccaagaaggcagagtcatatgaacactgccatggacggatgtcagggacacactgttaggtgcccaaacaacaataattccattttggcaacaataaaatagtaataatgtacaatatgcacagagaaaattctggaatagagttttctatttaacccactattactgttctctggtctggggttttctctgtgggactttcactttcttttttaaatttttttgagacagtcttgctcttgtcacccaggctgcagtgcaatggcacaatctaggctcgctgcaacctccgtctcccgggttcaagcagttctcctgcctcatcctctcgagtagctgggactacaggcgccggccccacacccgcctaatttttgtatttttagtagagacggggtttcaccatgttggccaggctggcctcgaactcttgacctcgtgatacgcctgcctcagcctcccaaagtgctgggattacaggtgtgagccaccatgcctggctgggactttgactttctaagacacactttcctgtcatgttgggtttttttgttttcttttgttttagggacaagcaggccgggtgcagtggctcacgcctctaatcccagcactttgggagggaggctgaggcgggtggatcacctgaggtcaggagttcatgaccagcctgaccaacatggcaaaaccttgtctctactaaaaatacaaaaattagccaggcgtagtggtgggcgcctgtaatcccagctacttgggaggctgaggcaggagaatcgcttgaccctgggaggtggaggttgtgatgagccgagatcaagccaccgcactccagcctaggtgacagagcaacactttgtatcaaaaaagaaaaaaaaagaacaagcatgtagagatttttttaaagcaattaaaattaaccatatagctgcctcagcttgcccctcaaaaaaaatagagaaaagggaaaaaatcacctcggaactcctttattgatacaggtaccgttagtatggtggtagatggcttactagtttttttttctaactttttaagctacttttaatccagatgggtccacattttgggagtcttttgtctatttctttcgaaccaggtctccatgttgtcctgtggactccatgaccatcctcttgcacttctggaatattctgtcccatcaacttgtcaccgtttgcttattgttaaatatttaggtggtttcccctttgttctagttataaatactaccacaatgcacagttttggtacgtgcaccttttcctgtattttggattatttcatgtggattgcgtcccggcagcaaggctgcagcggctcgtggcctgtgctgggtggctgggattgaagagtgttcctgagtgtggaggatcctttgctggaggacttaaagtccccatgctgctggctgtctgtgttggagtctgggacttgctggagaagggtcagtggcgcaagagcgagaccacaaacacctgtctcttagaggctgcgttcccatttgctaggaggaaaaagagcctggagcaggagccgtgtgaaccaggagagggtgggctccccgagacacgggggacgtgaccattagcattctccctcaccccagccagacagacgtgacccagagggacagagggacttgcttgtggtcacggatgtgttggtgctgggccctcgggcgacagacccattcttttgccccagggctggaggtggatctgggcaagagtgaggcggccacctctcctctgtccccagcatgtcaggcataatgccagctcctccttgcctctatccccagtttatagatgagaaaattgaggcttgggacaaatgacaggtccagatttcaactccaggccgtctgcttccaaattcagcttcttttccccacaacttttgtgacctgaatgctggagacctaaagaactgtttacccttggctctgggaccctgcttcctagttccagcccaggctttggggcaccagccttggaggctgaagggaccctcagccagggttcagctggcttcaacccctgtggcaggagtgggggtgggataaagagataatataacaactgacatttattcagcacttacagtatgctagacgctgctctaagcgtggtatgtgtactgtcagacttaacgcttgcaaaagccctacaaaggagatactctttctgcccccatttgacagatggggagactgaggtactcgtataactcagtcaggtgaagaaatttacccaagtaacactgccctgaaatgagccactggggctcaagccctgggcctaagcactgcagtgtgctgccacagtggagaggatggggatcttcctcttgcctgatcttctccccgcaggcactcagccttttctctggtccccataacggccctcccatccggggtacaacccctgggaccctgcctttaccttcagcagtcccatctatgccctgctctgtcttcctcctgccttcatccttaggtgaaatctcagactgtcagacccctagtagaacttagaatatgtcctatccacccccgctcttccccacccactagccatagggaaacagagtcccagaatggtggggggacttgatgtgggtcacccagcaggtcagaggcagccctgaccagccagttccacaaatggatgtttgtggtgttagaaacaaaatgcttgttcctcagtgccgcaaagaaatagcacttgaacataaatttaatcttctcagcaaggcaatttttacttctacagaagggtgcgattcaagaatggagtaatggcgagagcacatctgaacaagggaggggaaggggttcttactcctgacgcaggtagcccctactgctacgtcgttcccctacgggctagtgttggaccgcacagtctaagctaattccagttagctattttagagagagcaggggtatgagccagagtggcggggtgagtagtttggagggaaggatggttaggaacaggtaactaaaggtgacttaggtcaaagcaggtgaccaggggtttgtgaggtcaaagcacatgaccaggatgagtcaggatggagcaggtgaccaggggaacagatgtgaactactgattaaaactggtggaaaaggttgtttactgaaaccatgaggaagttaaactttaaaatggaggacaaagaactgaacatactgacatactgattctttgaagagaaatctagaactcactgtatccagtggaagtggatgtttgctctgagccctggactaactgattgggacatggaatgctgtggactctccttgtcctggaaaaactcactgtctgctgggagtgcagacacactgacaaatcaaaacagcacacctgggcatgtatggtctggttctccaaggacacccaaggacggatgcacctaagaaaggagggactggcttcagtgagattttcaggacagggttttgaaggatgaatagaagttcgctaggggctgggcatggtggctcatgcctgtaatcccaatgttttgggaggctaaggtgggaggatcacttgcggccaggcgttcaagaccagcctgggcaacatagcaagactctttctccacaaatatttttaaaatttagttgggcataatgactcatacctgtagctgctcgggaggctgaggcagaggattgcttgaggccaggaggtggaggttgcagtgagctatgattgcaccactgcactccagcctgggcaacagagcaagaccccgactctccaaaattaaaaaaaaaaggccaggtggtcaaacaaaggatgagcgttggtctgggaaagggcatggcagaggcaggagcgaggtgtgtttaggggaagagcccacatatccccactgactgggcataaataattgtgatggtagtcaccagttcctgagcaacccccacttagcaggagccggcctagcgctgtgcaggtgtaatttactggcctgcttgccgactccatgggaagctgttatgatgaccctcatccccatgttacagatgagaacactgaggatggaaaggcagctggcaggtggaagaatcaggacctgaacctttggcatctgtcaaatcgctgtgcttttcacctctactgtaggctgcagtgcaggaacttgaccctgcaggcatcgtagaaccaggggggagcccggggccaaggcatgctgagacctcctggtggctgggggcagtggctgggctggatgctgggaaacctgtgaggctgtaattgggcctgaaaagggtaaagagtggcccgggggtactgaacaagacggggcaggcattgcagcaagaaggacccttgttgaaacgtatcttccttgggaggctgagatgggtggattgcttgagcccaggagtttgagaccagcctgcgcaatacggcgaaaccccgtctctacaaaaaatacaaaaattagctgagtgtggtggtccacttgtagttactcaggaggctgaggcatgagaatcgcttgaacctgggacggggaggttatagtgagccgagatcgagacactgtactctggcctgggtgacagagtgagactctatctcagaaaaaaaaagggggggtggcagcgggaagaaaagtatctgtcctagtatgatgaaataatattcacagcttctgtgtctggggcacctacttagtaccaggcactcaacaggggttaccccatcaaactgacacactcagcctgtgaatgcctgctgcttgctggagccagactgtctgggtttaaatccaggccgtgacacttagtagctgggtcacctcgggcagctggtcttcagtttctttaaccgccctggtcttcagtttcctggagtgtgcatgggtgtaatagcgccgcccacctcacaaggctgctgtgaggatcaaatgagttcactcgtgtaaagctgcctaggctcccagtaagcatgatgggagcatctgcagtgattattggtggtctgcaaatggggaaactgaggctcagagaggttaggcttctgctcaaggtgaccagcattttaagaggcagagctgggatttgatccaggccatctggctccagagctgtttttcttgatcatcctccaaggtgctgaaggtagccctctggaaatctgggaggtgctgtgtgcacatgggtggcgagggtggagaggggacagtggtgggaggtggcttctgggtctctcacttggggttccagtcacccaggcccccagcggctcctcctctgacccagtcccgggaggccctggcgtttcccttggtgccaggggattgttttcaacttggtctgggcccgcctcaggctccgggagacaggcccaggcgtcacactccctcctgtctccccattctcgtctgcggggtgggggcggccaggattcgaaaaggccccaaaataaatggacctcttatctgatctccccgccaggcctgttatctgatcattacataatggccaggcttgtggcctctcccgctggctgacggcatggaggaggcggccccaggcggccccagcaatccgggaggaactggggttcctggaagtctggggagggggcagggaaagtcccaaagggaaggagggaggcgctgcgataatctgcaggccagacactgggtcatgttgggagacgcgggtccgaggcccggcctggtcaaccatgtgctgtgagactttgacctgtcccgtccctccagacctcagtctccccatctgagtaggaggggcttaagctaggtaacagccaaggaacctgcgctcaccgatgaggaaaggagagggtggggagaacatgggggctggtgggtcagagggactggagacaggagatggcaccagcccttgattttgttggggtgagggagatcccagtgacctctccatcccagaggaccgtcacctggaggccaccccatcccgccacttcaccccaccccttagaacagtcaattctacagtgactgaagtcagtcaaataattgtaattaagagaaagctgccggccaggcatgctggctcactcatggtggctcacacctgtaatcctagcactttgggaggctgaggcgggaggactgcttgagctcaggagtttgagaccagcctgagcaacatagtgagacccagtctctactgaaaatttaaaaaattagccaggcgtggtggcgcccaactgtagtcccaactactcgggaggctgaggcaggaggatcgcttgaacccagcagctcaaggctgcagtgagctgttatcacaccactgcactccagcccaggagacagagggcaaccttgtctgaaaaataaacaaatagaaatttaagaaagaattgccatgtgcccagtctcatggagtcctcccagccacctctgtggatcatgtgggctctgttgtcattttatagaccaggtattgaagccccaagaggtgaaatcattcaccagagccacatagctggtaagcattgggcctgagaggcaaaccaggtcagcctggctccagggagcttgcttttaaccaaaatgccactatgtccaggcactccagagtccctgggacatgtaggatagggtcagagagacgacatataaggcctgggcccccgtggcagccagaagtcctcatccagatcttctccttcccaagacagagctgggaatggcgttgccatggcaaggggtgaccatctcacttcctttgctgacttctggggcccagagcccaacgtgctgtgggaaggtgaggaaggaggccggtgaggctccagacagcccagggttcagcagaagcctccctgccccctcctctgagccggccttggctggacatgaagccagtctctccgcgcccatctttgatctccaagaaaacaggaagtgagcgcgacaagatggagacacaaacttccaaacagtctccccttctgtcctccttccctcctccggagcccccttcccccggcacattcctcaggacgaggtgtaggagcctcatttccttttccgaccctgctgggtcagggtgaaattccattcctttccctcaggacctgtgtttccgggctctgcggtctgctctggcagcctccaaacctgggccgccttctcggctcgccctgtcccttggggctagggaactctcaaccccttcagaccattcctcccaccaccttgaggcaagagaggggaagctttgtctcctgagctcagctcctgccttacctggagggagacttgggttcacacctaggccctgccatgaagttagggttgccagatacatcaaatgaaaatcagccgggtgtggtggctcatgcctgtaatcccaacactttgggaggccgaggtgggaggatctcttgagtccaggagttcaataccagcttgagcaacatggtgaaacctcatctctataaaaatgcaaaaattagctggatgtggtggtgcatgcctatagttccagctactcaggaggccgaggtgggaggatcacttgagcctgggaggttgaggctgaggctgaggctgcagtgagctatgattttgccactgcactccagcctgagcaacagagcagagtctgtctcaaaaaaataaaaaataggccaggcgcagtggctcatgcctgtaatcctagcactttgggaggccaaggcaggcggatcacctgaggttgggagttcaagacgagcctgaccaacatggagaagccccatctttactaaaaatacaaaaaattagccaggcatggtggtgcatgcctgtaatcctagctgctcgggaggctgaggcaggagaatcacttgaacccaggaggcagaggttgcagtaagtcgagatcacactgttgcactccagcctgggcaacaagagcaaaactccgtctcaaaaaaataaaataaaataaataataaaaaataatttttaaaaataaataaaaaataaaaatataggaggctggccgggcacggtggctcacgcctgtaatcccagcactttgggaggccgaagtgggcagatcacctgaggccgggagttcgagaccaacctgagcaacatggagaaaccccatcgctactaaaaatacaaaattagctgggtgtggtggtgcatgcctataatcccagctacttgggaggctgaggcaggagaatcatttgaacccaggaggcggaggttgcggtgagccaagatcacaccattgcactccagcctgggcaagaagagcaaaactccatctcaaaaaaaaaaaaaaaaaaaaaaaaaaaaaaaaatatatatatatatatatatgtatgtggatgtgtgggtgtatatatgtatatctatatatgtatatatgtatgtatatatgtagatctatgtatatgtgtgtgtatgtatatatacacacacacatatatacatggggcccagtgaaatccgaatttcagataaacaatgaaaatttagtataagtacgttccatgcaatatttgcaatatactaatacttaaaaaaatgcactcattgtttatctgaaatttaaatttagctgggtgtccttctattcatcgaccctatacgtagtagcgctgtgaccttgggcaggagacgtttcctctcctagccttggttttttttaatccatggaacgaatataatgatatccacctcataaggtggctgtgatgatgcaggaaagccgttagctcatgtcaagtccctaggagacgtttggaaagtaggagtcattgtcatcaccttattctcacctggcctctttccggatgtttctccaacaggtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacggtgagtgtcccatggcagggtcgggtgggggctcagaggaagctccaaggcagatggggtgaggggtgccttccttgtggctgtccctggggcagtggctgagtcctcgttaggccccctgccaagagagtgatgtgggcatctcacagggcccataagaggtggcatttctaggggcagggtctggatcagggcagtcttttgggtgccaccagaagactcaggtgggaagagctgagtagagaagagccagatgggtgggggggaccaggtgagtgttgcttatgcacctccaatgatggagacctcacagaatctcagaagaatgcagctcctctctagggagcttggactttgaaaagtgcttcttgggccagccacagtggctcacgcctgtaattccagcactttaggaggccgaggcgggtagatcacgaggtcaggagatcgagaccattctggccaacatggtgaaaccccatctctactaaaaatacaaaaattagctgggcgtggtggtgagcgcctgtaatcccagctacttgggaggctgaggcaggagaattgcttgaaccagtgagttggaggttgcagtgagcttgagattgtgccactgcactctggcctggtgacagagtgagactctgtctcaaaaaaataaaaaataaaaaaataaaaataaaataaaaatacaaaaattagctaggcatagtggcgcatgcctgtaatcccagctgtacttgggaggctgaggcaggagaatcgcttgaacccaggaggtggaggttgcagtgagccaacattgcaccactgcactccagcctgggtgacagagtgagaccctgtctcaaaaaaaaaaaaaaaagaaaagaaaaagagaagtgcttttcagttgagcccagatctttctccctggaatgtcccctgctgaatatctgtgaccctcagagatccaaaggctgctgccggcctggagacgattctccccaggagacccccactcccagcccaccatcagtttgtctgatacgtctgtcctgaataataacaacacctttgttaagcgctatgtgctagagactgtgctagggccgactctatgccaggaattaagcatctcacatgtattaagcctcccaaggctcatctgccagggtctgttattatccccacttcttggagaaggaaactgaggctggctgagagcgatggagtgacgtgcccagggccagagttcacaccagatccctggggatgccagagccagcctgccacttggttccccacgtggatctcagtgttcaggtggcttctggcctgttggactggagattacacctggttgatgtggcctttggtcccgatactgacttcgccgtgtcagctccgggtaaacttatggccaatctgcccccaaaactgttaagttgccttgcgtttgtgcagtgataagaaagtgctcagaccaccaatatcgggggaccctgctccccaccgccctgccctctacgaggactgtgggctttgataatttccaaatcatagatagtgccaaacacactttgtgtggtttccataggcattgtcatttttttttttcaaatttggtaatgatattcaaaatacgactgcctctgttagttcgcattgtttgttttaatgttcaggtccctgtgcctcctctgggtgactgggatcccccaaccctaattgctcaatactgggccagggtgagaggagggcccctaggcaggtgtctaggtctatgggagataggtgtgtagatagccagccaggatccaggggactggtgcattctcacggggcacagggccagggcactccagctgctacgggattaggcatggcttgttacggccacaccatcctgaacacatccgacctcatctgatcttggaagctaaggagacttgggcctggaggaagaaacatcatggatgtccaggagctcaccaaggaaggaggtggtgtggaagagcacagaatagagtgaatgcggaggcagagggaacaggctctggggtcatcaggtggcaggagctagaggttccccagcaggacaggggagatggcaaaggcctgtcgccatattaagaagtttgatctttatcccgtgggcaataacagttcttggagggattttaggggcatggcagggggccactgtaactcatgccatattccaaggatccttgagttcatgacaacaaaatctccctgttagcctctgcctcttctagagaactcgctccagggagcttccaacttttaattcaaggagccaggctgcaggctccagggctttgagggatgttcatttgaggaggtggtagagacatctggggtccaggaaacccagggttcagtcctggatctgtccctggccagcacctcgcatagcatctggtgtgcagagggtggtccttctccccacttgctggtagacacacctttctcggactcaggagctcacctgagaacacagagtagcagaacctggcccaggggcctggcttacaccaaatcactctgtttgtttgttttttgttgtttttgtttgtttgttttttgcctcagactcctgtagctgggattacaggcgtctgccaccatgcccagctaatttttgtatttttagtagagacagggtttcaccatgttggagaggctagttttgaactcctgacctcaaataatccgcccacctcggcctcccaaagtgctgggattacaggcatgagccactgcgtctggccccaagtaactcttgaacgtgtgagtgaatgcacgcatgcgtgcacaaatgtgtgcgccgctgtatgaccttgatgcaggggttgagaacacaggttctggagccaggcagccctccagctgaactgtggctccgcctctgagagccacatcgccttgggccacctccgagctttgattttcccacgggaaacctggacccattagcagcacctacctcacaggtgtgttgtaagaatccagcaggacggtgcaagcaaaacaccaagcgcaggacctgcctggagtgacggctcagcgtatggtggctacggttattgttattattatttctctctgggttccatttctcctctgtgaacatccccattttgccagggttgttaccgtttacagaatgtcttcgtatcagttgaataatttgaacctcaatggttattgctacaagatcaatggggcaggtcaggcgcagtggctcacacctgtaatcccagcactttgcgaggctgaggcaggcagatcacttgaggtcaggagttcgagactagcctggccaacatggcgaaaccgcatctctactaaaaatacaaaaattagccaggcgtggtggcaggtgcctgtaatcccagctattagagaggctgaggcaagagaatcgtttgaacccgggaggtggagattgcagtgagccgagttcgcaccactgcactccagcctgagcgacagagcaagaccctgtctcaaaaacaaaacaacaacaaaaaaaagattaatggggcagggctgtgaattcattttcagcagggcaagctgaggtccagcctcatggagctgggccttcctcctcctgctgcttcttgtctccctgctctgagggttgagcccatgatgctgccagcccctactgctgtgaccactgaggaccctgtggtttccctgggaggcaccttcctccccaggcatcccctaagagtggggtctagagctcacagtccccattgcgcagccctcaccaggtgccactctgtgcccagcctgtgttgatgatgcagacagaaggtagagccagggaggcagaggtggcatcagcagccctggtatgagtggtgggatcagcaaatggggcttcagggggccgcaggtgatggggtgatgagcactgaaggtagaggagggaggggcgttagggaaaaggcccctggtgtctagcccaagagcagggtagagggcattccaggcagaagccagtgcacagcaaaggcctagcggcatggggctggacgtggtagtgggggtggtggcttttagcagccagccggatccctcctgacctatggccggcttcttcgatctctggcacagagaagtggctttcccgtccatccctcagaatcctcagatttcctgtgggtgggtggtagatgggcggtggcagccgagagccttggggaagtgccgctcagtgcgtgtgctgggcaggtctgcagacagccccgctgggcaggggctggatctcgctgggtccctgaagggcaggccggagcctggattccgggagggggcccagggtcacatcctgaccctcggagacaggaaaccagcctggtgtctcagcaattcccgtcaggctgactgggccgatctgctatcctcctaacaaatgcacaggctgccaggccagggcagagctgggtcagcactgattcacccactcctgggcaaacttggggcagctgagaccccacccacccctgaacagacacagcctgtcaggccccagcactgactcactcttgaccagaggggcaggcaacaccactcaggcagagagagagagccgggagggaccttagctcccccagactgtcctgggaggcagtgggaggccatggaaggcagtacagccctcagacttgggcaaaggggacccctgcctgggcttgggggaagcagtctccctctggccctctgccaatggcagccctctcccagggtggggactctgtggggccaaagggatgtacccccctgaaacctgcacccctcccttctagatgatgctctgggtacccaggaccccaaaatcccaaatggctctgagcctcctctcagggctgcagggatctttcctgttccatcctccaggggagcactgcatggctatgtgagctcccccagacctgaaggatggttgagttggctacttggggaggcaggcatggtggagtttgggtatccgggctgagctgtccacatgtggacacatgagcacccttgctggctgtcagaaccacagtgatgagaaggagaaagcactggggccagaggctgccatttgtattcttgtctcaggccttgcaaatattagaggcaggcttgctgaaggggcaggattgggggttggggagggtcagacaggctgagcagggattgtgcctgccctcttactgctgaatctttggtgttaagctcgaagtcagcccaggaatcaatatctgttggatggatggatggatggatggatggatggatggatggatgcattcatgcatggatgagaggatggatggataagggcgggagggagagagaataaaagaaaggaaggaaaaactgtacattcttataagcatttggtgattggctattcccaagtgggctgatgatgttccttgctgtttatgtctggtcgttcggaggtgttggtttgttctctgccaagctcttgaggacagagttatgccttttctgtcctttgagaacacagaagccccaggctgggcccagtgccagcctctcagacaggcaaatgagttggagaggtgaggacacgtgggctgaccaccagaaaggctggaggtaccaggggccccctcagctgaggaagaagcatatctctccagggcattctgaaaacccactctgtggccatctggctggagaccaggactcctagatgtaaaatgctgggacccccagaaggcagcctgggatctaggggccacacaattctagaacatcactgagctcaactcctccctgcacagatggggaggctgaggctcagagataggatgccacagcgaggcatggctgagagatttgtagttctcaccagctgcagcccacctctaactggacccatgcttcccagcccctaaactgtggatggctctccttggatgactgtgtgcaaggggagaatcagagggattaaaaagccaaccaggccaggcgtggtgtctcacgcctgtaatctcagcactttgggaggccgaagtgggtggatcatttgggtcaggagttcgagaccagcctggccgacatgggcgaaaccccgtctctactaaaaatacaaaaattagctgagcatggtggtgggtgcctgtagtcccagctactcaggaggctgaaccagcagaattacttgaacccaggaggcggagattgcagtgagccgagatcgtgccactgtactccagcctgagtgacagagcaagactgtgtctcaaaaaaaaagccaaactactcccacatgtttagctgggcactggacaacctactttgcaggcagaattgcactgaaacctcataagtcaatgaagtgggaataccattttccaaatcaggaaactgaggcccagagaggcatagtgactgtccaaggtcacaggctaatgactgagcccccatctgaattcaggttggtctggctttgatcctttcccctgccaccctgcctgtaggaccatctgagttttctggggtggacagagggacggctggctccaatctgaccgcctccagtcaggccctgggagggtgggggctgcaggcagccctgaggctccactcctagaagaattgctggaagcgactttctataagtggctactagcactcagggcctcctcaccgaaatccccccttcctgccaccaactgctgggcaacaatggcatctgtgggacattggtacaaaaatagaaacgcggtctcccgcccacccactcagggagggggctgggtaggcgcaggctggccgggctgggggtgaggggctggccagactgcggaattcccagggtcccatgaggaaggctgggagcttggggttgggggcaaggctggcgccatcgttttttgcctctggggcccccggccgggagagaagggggaagtcggtgtgcgtgtgagtggccgtggcggtgagtcagggccgtggggagggaaatgtttgctgtagaaaccctgactgggtttttctggtaaccagctgtttttcagcttggccctgcagctcagagaacctgagcacccagctttccagcccccctgagtttcccaactactcacttgcccccacctcctacctgccctcaagcctgcagggaaggacttggtgacaactgagtggtagctttggttcgtgagctctgggatgagagctgagtgtcccaagaaacattccgaagttccagcctcctcgtcacccctcacagacagcatgaccaggctgtgacctgcacttcccttttttttcacttcctttatccatagcccaacctggtactggttcccaaccctgtcctacccccatttcacagatgaggaaactgaggcatagaggaacagggacagtggcggagcagcagtaggactggatggccatggggctccttcatccccactcagggcttggccaccagactgcactctggcttctgcagcatgcttggcctgtgggtgtcaccatgggatggcggatggatgtcctcatgcaccacaggctgtgctgtgtcctggccatgatctgactatccagagggcccatctcttcatcgtgtgggccttgcaattctttcctccaggttgggacaagcagatggggccgcacagcaatggactgtagggcaatctgggagagaggtgcagttgagagggaggacatggtccagggaatgcaggccccgctctggcaccacgcccagcctagaaagcgtaatatttttaaaaactgccaggcatggtggctcacgcctgtaatcccagcactttgggaggccgaggtgggtggattgtttgagtctaggagttcaacaccagcctgggcaacatagtgaaaccccatctctacaaaaaatataaaaattagccaggcatactggtgtatgcctgtagtcccagctacttgggaggctaaggcgggaggatcacttgagcctgaggggcggaagttgcagtgagcaatcacgccactgtactccagcctgggcaacagagggagaccctgtcttaaaagaaaaaaattatatatatatatattttattcaaaactgatgaaacaatatattttgaaaaccaaaagttataaacccactagaaaacattaatcaaaacatgaacttatacaaacataaatttgaaacatatcttatcccataaattagcataaaataattatttaaaaataaccaacctaactgggcgcagtggctcacacctataatcccagcactttgggaggctgaggcaggcagatcacaggtcaagagattaagaccattgtggccaaaaaggtgaaaccccatctccactaaaaatacaaaaattaggctgggcgtggtggcacacgcttataatcccagcactttgggaggctgaggcgtagggatcatgaggtcaggagttcgagaccagcctggccaagatggtgaaaccccatctctactaaaaatacaaaaactagccaggcgcagtggcaggtgcctgtaatcccagttactcaggagtctgaggcaggagaattgcttgaacccaggaggtggaggttgcggtgagcagagatcgctgtactttagcctgggcaacagagcaagactccatctcaaaaaaagaaaaaattacaaaaattagttgggcatggtggcgcacacctgtagtcccagctgctcgggaggctgaggcaggagaatcgcttgaacccgggaggtggaggttgcggtgagcagagatcgctgcactctagcctaggcgacagagcaagactccatctcaaaaatatatatatacaaaaattagctgggcatggtggcgcacgcctgtagtcccagctacttgggaggctgaggcaggacaattgcttgaacccaggaggcggaggtggcagtgagccgagatcatgccattgcactccagcctggcaacagggcaagactccatctcaaaaaacaataataaatagaaaaaaactaaatggcacactaaaatgaaaaaaaaaattgtgtttacaactaattgatcacaaccagttacagattgctttgttccttctccacactcactgcttcacttgaggagcctaaaaaaaggaaacaaaatatttgtgacacattgaaaatgaaatactattatttgttctttttgtgttttaaagaggaaacttaaaagcaaagagtaattatggtatcattattgagtaacagaaatatttctgggcagatttttccagtggctgaaacactgtctctggctttgtgacgtcagttggggaaatggcaagatgattaaaagttaaatctcaaaactttccactggtgtcttcatcttgaaatagccttcccctttttcataactttgaaaagagcttttggatcatcttttagactggcagcttttgtatgagagcactgggagtctgtgtttcagcaaattacatttgtctttgtcctcctgagttggtggcagggcttctgaggcatttacctgtcttttttttttttttttttttttttgaggcggagtttcactcttgctgcccaggctagagctcaatggcgcgatcttggctcaccacaacctccgcctcctggggttcaagcgattctcctgcctcagcctcccgagtagctgggattacaggcatgcgccaccacacctggctaatttagtatttttagtagagacggggtttctccacgttggtcaggttggtcttgaactcccaacctcaggtgatcggctcacctcagcctcccaaagtgctgggattacaggcgtaagccaccacgcctggtctacctgtcttagtctcagcactcacctgttcacatgccactagttcagaaagtctttgaggtcattctttcaatagacactggcttgtagattgctgtgttctttttcttcttgggaataaggttagaaaaatgtgctagggaaggatgtgctacacaaaaatgtgtggaaaaatgtgagagcggccgggtgcagtggctcacgcctataatcctagcactttgggaggccaaggcgggtggatcacctgaggtcaggagtttgagcccatcctggccaacatggcgaaaccccatctttactaaaaatacaaaaattagctgggcatggtggcatgcacctgtagtcccagctacttgggaggctaaggcaggagaatcacttgaacccaggaggtggaggttgcagtgagccgagatcgcgccattgcattccagcctggcaacagagcaagactccatctcaaaaaataataataaatagaaaaaaactaaatggcacactaaaatgaaaaaaacaattgtgtttacaagtaattgatcacaactagttacagattgctttgttccttctccactctcattgcttcacttgacgagcctaaaaaaaagaaacagtgagctaggatcgcaccattggggtttcaccatgttgatgaggctggtctcgcactccagcctgggcaggaagagtgaaactccatctcagaaaaaaaaaaaaagtgaaaagaaaagaaaaatgtgagagcacaggcctacctgggcacgaatcccagcccctggctgacttcctgtgtcatcaaaggcaaatgacttcacctctcagggtcttggttccctcatctgtaagtgaaaataagaatagtggccgggtgcagtggctcatgcctgtaattccagcactttgggaggccgaggcgggcagatcatttgaggtcaagagtttgagaccagtctggccaacatgctgaaaccccatctctactaaaaatacaaaaattagccaggcatggtggcaatcgcctgtagtcccagctactcaggatgctgaggcaggagaattgcttgacccaggaggcagaggttgcagtgagccgaggttgtgccactgcaatccagcctgggcaacagagcaagactctgtctcaaaaaaaaaaaaaaaaaaaaaaaagaatggtagctcatgtctgtaattccagcactttgggaagccgaggtgggaggattgcttgagcctaggaggttgaggctgcagtgagccatgattgcaccactgcactctagcctggaaaagagagtaagaccctgtctcaaaaaacaaacaaagaaaagccagcctggccaacatagtgaaaccccatctctattaaaaatataaaaaattaatctggtgtggtggcacacgcctgtagtcctagctactcaggaggctgaggcaggagaattgcttgaacccaggaggcagaggttgtagtgagctgagattgtgccactgggttccagcctgggtgacagagcaagaccctgtctcaaaagaaagaaaaaaaaaaaaaaaaggccaggcagggtggttcacacctgtaatcccagcactttgggaggccgaggcaggtggatcacaaggtcagagttcgagaccagcctgaccaacatggtgaaaccccgtctctactaaaaatacaaaacttagccaggcatggtagtgggcgcctatagtcccagctactcgggaggctgaggcaggagaatgaattgaacctggtacgcgaaggttgcagtgagccaagatcgccccattgcactccagcttgggcgacagagcgagactccgcctcaaagaaaaaaaaagaaaaaaaaaaaaagccaacctggccaacatggtgaaactccatctctagtaaaaatacaaaaaattagccatgcgtcgtggtgggcacctgcagttccagctactcgggaggctgaggcaggagaattgcttgaacctgggaggcagaggttgcagtgagccgagatcacatcactgcactccagtctggacaacagagggagactctgtctctaaaaaaaaaaaaaaaaaatggtatttacgtcttaaggttgttgaaaggattaaatgagttaatgtgtaaagcacttagaacactgctgggatttaataggccctatttacgtggtaggtaggtattgctgttgttataaaaacattctaaatgtatacatcattgaacaattaaaaattttaatgcagtgggtacgtctcaagacataaatgatttcaacttcacattcttatatcaaaataatggcattataccaaaacaaccccccaggattttagtactttaaaacggtaagacaagcaggaatattgcaaactgggagagcaattgtgactgtctcatgtgggctggaagcagagctgtcactcagggactgcaggaaaggtggtggggacgatggggcaggggatcgctgcctccatgcacaggacactccctaaggcccagtacacaacaggttctcatttgatccttgatggatgaagttcaggctcatcccttttttttgtttgttttttgtttttttttttgagacggagcgtcattcttgttgcccaggctggagtgcaatagcgcaatctcagctcactgcaacctctacctcctgggttcaagagattctcctgcctcagcctcccaagtagttggaattacaggcatccaccaccaccccacctggctaattttttgtatttttagtaaagacggggtttcaccatgttggacagactagtctcgaactcctgacctcaggtgatccacctgcctcagcctcccagagtgctgggattacaggtgtgaaccaccatgcccggccttttttttttttttttttttagatggagtctcactctgttgcccaggctagaatgcagtggtgccatctcagctcaatgccacctctgcccccagggttcaagcaattcttgtgtctcagcctccccagtggctgagattataggcacccaccaccacgcctggctaatttttgtatttttagtacagatggggtttcaccatgttggtcaggctggtctccaactcctgacctcaggtgatccgcccacctcagcctcccaaagtattgggattacagacgtgagccaccgtgcccagcctaattttttttctctcttcagatttgccgggcttacctccttcatttgtttattgtgaattccctgaggatggccagagggacaggcactaccctgggcactgggaggtgagggtggacagagcaggcagggagagtggagtggaagcatccaaatcatcactgcctgtctgggtggcacaacctatacaaatctgactggactgtgtgtgtctctcctctgtgtcccccagggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacgtgagtgtgttccctccaaccccaggctgaggctctggccatgggaggtccctactgtccatctctgtgggtcagggtctcccaccccagcggcccagccctgcttctccctttcatcttgacattattcaccagggtcctgcctggtgaagccaatggtctctaccagagagaacccagagggcaccaggactacagtaaagagtctagaccaagaggtgggagtcaggttgatgtgcagccctggccaactctgatcctctgcataggctcagtttgcctctctgtccagtgggacaactgaactcaatattttatatgataatcttttcattgtctttgaaaaagttacacgacatatatttgaaaatatttaaagacagaggaaaagggccaggagaaaacctaacgtgttaacagtggttatggctgggaagtgggattaggagagacatttagttggttcttcacactttgttgagtttgcaagagttgctctaaatggatttggcctattttggagaaaaaagtatttttaaaaaactcaagttttcaggtcagctgtggatttgggaaaaacaattaaaaacaaacaaccaaaagcctcaacttttaaaagtgttagctatatccaccagagagaggaggtcagggagctgggacccactgccagaggtcagggctggaggaggcagggtggcttgccagcactgcctcctccatgaggaatgtctgggaggtggcccccagatgtgagcagctgttgtttacaacagagaaagcagagggtaggaaggggagagcccgggggagagcaaagatagcaaaggggagagaggcatagaaagaaacatgcccactgcgggagggaggcaggcttgagcgaagttgggcgtgggggacaggggagaagcttccggactggtgacagggacagcacagagacagtcagacatgaccaagccagcatgccaaagtcctaggagggagggggccaaatccaaccaccagggccaagaggatttgactccttgcagcccatccctcggccgcccagaaggggaatcgaggtcccagagggggcgtggcctttaccatggatcctcccccttcccgatctgagtccgtgcagcccagggtgaggcaggaacatgaaacgcgcccgccagccggaaggtcgcagtagccgccggctctggcctcggccgcgccgccttcctcctggggccgcgctgcttcccgagcgggctccctggggccggtggccagaggggacaaagaggccaaggcgcggcctcggtggccgacccagtgccaggcgaccaacagacgtcgtgccctgctgtatccccattttacaggggctgactcaaggatcagatccctttcccaacccagctgtaaagccagtgtcccagccctttcccattccgcgggctgggttcctcacccaagatgcccatcactttgcccccttgttgaatccctacagagaaggtatctacttccttctagatgggccattctagggtgtcttgtctactgttgccatctggcagtcctcaatatctagcttgggccaggcgacctggcttatgtctgtaatcccaacactttggtaagccgaggcaggagggtctcctttttttttttttttttttttttttgagatggagtttcactcttgttgcccaggctggagtgcaatggccccatctcgcctcactgcaaccttcgccttctgggttcaagtaattctcctgcctcagcctcccgagtagctgggattacaggcacctgccaccacccccacctcattttttgtatttttagtagagacagtgtttcataccgtgttggctaggctggtctcgaactcctgacctcaggggatccacccgcctcggcctcccaaagtgctggtttacaggcgtgagccactgtgcctggccaggagggtctcttgaggccaggagttggagaccagcctgggcaacatagtgagaccctcgtctctaaaaaattataataaaaaatatttttaaatccaacccgaagcccttttgcccttctgctgctgctgtttcattcagctcaatgcccttggctttggagactgtacactaagagctcagtcagtggccccaacagcttcctctgaatccttcagctttccagagtcactcttccaggaagtcttccctgtctgctttcctcctcacccccaacccccatttcttctgaggcaatggcagggtaggcagtgagatgctgaagccacccagactccccatccctgtccaaccaggagatctgtctggctcctttgtttcttattaaataaaattctgtcttctattgtttcaaatgacttgatgcatgtctagtttctgaatggtaatatcccctagggcagggaccactgatatctgtctttaattcattaattcattcatccatccctttcttctttcttccctttctccctgtcttcccataggcggggagcacccatcacatgctgggtgtcagggtgacgctggcatgtcaggatcctgtgatgggcccagggcccagcacaaagtcagacaaatctctctcagtgcgtactacgtgtcaagcactgtgcaaggatgggcaaggtagacgttgccccctgtagaccctcacagtgtagggagatccagagcctcagggtatagggagagacagccgcaggatggcgtagatgtgggttgaatgagaacagctctggaggggtgggtgatgtttggacaggtggatgaacaaggtggtgtgttcatctggccccccaggtatgcaagggagaaggggctgatctgactgctagggggctccgggctgactgcagatccaccagccagcattctcagctccggcctctttctctcagccaatgggctgactccacaaattacttcctgacctcctacatgggatagagagggcacagggccaggaacagcgtgctgagcctccacatgtctccccagaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaaggtcagtttccccagcaacctctctgggctcatgatactgctcaggaggaatctgagctcctctggcccacacctcaaacttgggcaccaagagtgcaggaggggacacgctgtgccacagttcacatgccacaagccagtgctgccttgggacagtgatggctcctccaccaaatatcagattgaagcatgtggaatatgccaggttctgacctaaaaccccagcattttcatacgatctattgtgcatctactatgtgccaaagccctatcatgctaggcacttggggacacactcaggccctgccttcctggagctgatactgtgatgagggaggtgacaataaacatgtacatgtacacagataaatctataatttcgggtcttgctgggtggtttcggggctgcagcctaacatgtgtcatgggctcatcccttatgttaacacacggaggcccggggacttgcacagggtcacttggcaggtgagtggtggaagggaagttcgaacctaggtcctctgacgcctctccccctctgcagcaccgtcctgcctgccccaccactatctttggctgtgggtgagggcggggctctgttaggtgcagggctgctgagggaagggactgaggtgcgcgtgtctctgcagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggtatggctctcgccccgcccctgacactagtccccaccccgagagaccaccccccctgacccccccccgccccctctccggtcccttataaagccccaccccagtcccagccccagccccgccgcagccctgtgagagcacagtcgctttctcctactctaggctacgccccctatgggccccttccctttgggcacaagcctggccccagtcccatccctatcccataaacccacacctggccaggtaagagtgcagccgccgcccacccgacgccaggcctcgctccccgcctggcctgtccgcttcagtgttccatccgcgtctgtctccccgcaggccccggacggtgacggtgaaggtggaactgagctgcgcacccggggatctcgatgccgtcctcatcctgcagggtcccccctacgtgtcctggctcatcgacgccaaccacaacatgcagatctgggtgagttgtgcgcagctcccgggacacaaaacccaaactcccaacctctggatcagggaagtttcctggaaaggtgaacccccgagctgagctgaaggacaaatcacctatgcccatacgtgagggaaggggccaggcagaagacgcagcaggagtggggacacagcaggaccgaggcctggcataaccctggctggcctgctgtggcacagactgtgtccatggccccctgttctgcctctctccccaccattagaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtgagcacccttcccctgcccctcccttcccttcccctcccttggatcagtggccacactgttggtgaagcacctctgtgtgagcttgggcaaggtacatcagcctctctgagcctcatttttctcatctgcacatgggaacaatgggagtagctaatcatagaagagcctgagaatcgcttgaacctgggagatggaggttgcagtgagccaagatcgtgccactgcactccagcccgggtaacagagcaaaactccgtctcaaaaaaaaaaaaaaaaaaaaaaaaagcctggtgcgggcacacagtgatcacacagtgaccagccgcctggcctgcctctgctaccccacaggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcggtaagggaactcctgcccctctggctcaggatgacatggacatctggttcctcccctagcccaagactcttggggtcctagcccaggcaggggggcaagtcacgtccctctgcaagccttagttttcccacttgtataatggaattgataatggtacctaccacgtggtgagaattaaaggcagtctgacaggccaatcacgtggcacagtaagatgtggtacatagtaagtgcttagtaaataatgccagcactaggtagttgtcattattaatcctaaatgctccctgagctggctggtcacttagcagaatacctacacaggccaggcatggtggttcacgcctgtaatctcagcactttgggaggccaagatgggtggatcacttgaggtcaggagtttgagaccagcctggccaacatggtgaaaccctgtctttactaaaatacaaaaattagccagaggtgatgggacacacctgtagtcgcagctacttgggaggctgaggaacaagaatcgcttgaacccaggaggcagaggctgcagtgagccgagatcacaccactaaacttcagcctgggcaacagagtgagactctgtctcagaaaaaaaaaaaaaaaaaaaaaaaagccggtgcctgtaatcccagcactttgggaggccgaggcgggtggatcacaaggtcaggagatcgagaccatcctggctaacacagtgaaaccctgtccctactaaaaatacaaaaaattaaccgggtgtggtggcaggcgcctgtagtcccagctaatcgggaggctgaggcaggagaatggtgtgaacccgggaggcagagcttgcagtgagctgagatcgcaccactgtactccagcttgggtgacagagagagactccatctcaaagaaaaaaaaaaaagcctatacaatatgatcactgcctggttgacaaacaaatatatttgttataaaaataacacatggtgaatacaaaatattagccaggcatggtggtaggcgcctgtagtcccagctacttgggaggctgaggcaggagaatggcctgaacccgggaggcggagcttgcagtgagccaagatcatgccactgcactccagcctgggcaacagagcaagactcgtctcaaaataaaatgaaagaacacatgctggccaggcacagtggctcacacctgtaaccctagcactttggaggccgaggcaggcagattgccggagctcaagagtttgagaccagcctgggcaacacggtgaaaccctgtctctactaaaatagaaaaaattagccggacgtggtggtgcacgcctgtagtcccagctactcaggaggctgaggcaggagaatcgcttgaacccggtagagggagattgcagtgagctgagattgtgccactgcactccagcctgggcgacagagcgagactccatttcaaacaaacaaacaaaaaacatgctttaaaaaatatgtgaaaattagaaaatcttaaccttctgacacaaagacaatggctgccaacattttggtgtgcttctttctagagcgttttctctgtgtatttcttatattgatgtaatcataagagatgtgttcatttgtctcttactatttcacttaatgtatttttagagctttgacagctgtacctaatatcatgtttaataagcacatattattccatcatattgacatgctataattaactcctcttcccttgttacacatttaggttgttcccaattctgtagtattataaatatgcaaaaaatgtcattgtgcatgaaacatttctttatataggattattttctcaggatagatttccacattagtggaattactgggtcaaaatgaatgaagtttcaatacatgttgccaacccactttcccaaagatgatttgaattttcaccactgatttacgagaacacctcaacctcttcgctgtctccagactataattcaaaaaaagagaaacctttgccagtgtgggaagaggcacatggcgttccattcttgttttagttgtaattctctggttagtagtgagtgtgggcatggttccacgtgagtgatgagaacctcagtctccttatcattgaggcttggtatttttcttgatgatttttataagttttaataaagaaaaaaaggttgcccctttggccaccacttcccttgatttgctgtaattctttcaattttggctacagtggtttttcttttcttttctttttttttctttgagacagtcttgctctgtcacccaggctggagttcagtggtacaatctcggctcactgcaacctccacctcccgggttcaagtgattctcctgcctcagcctcctgagtagttgggaatacaggcgtgcaccaccacgcctggcttttttttttttttttttttttaagacagtctcacactattgcccgggctggagtacaatggcacaatctcggctcactgaaacctctgcctcccgggttcaagcaattctcctgcctcagcctcccgagtagctgggattacaggtgcccaccaccactcttggcttattttttgtatttttttttttttagcagagacggggtttcactatgttggtcaggctggtctcgaactcctgaccttgtgatccgcccacctcggcctcccaaagtgctgggattacaggtgtgaaatcaggcgcctggtccgcagcctagctacttttttgtatttttagtagagacagggtttcaccatattggccaggctggtctcgaacttccgacctcaggtcatctgcctacctcagcctcccaaagtgcggggattacaggcgtgagccactgcaactggccttctttttcttgttttagagacgaggtctcgctctgtcaccaaggctggagtgcaatgatgtgatctcggctcactgcagcctcctcctctcaggttcaagcgattcttgtgcctcagccttcccagtagctgggactatgggtgtctgccaccacacctggctaatttttataattttagtagagtcgggtttcactatgttggctaggcaggtctcgaacttctggcctcctgtgatctgcctgcctctgcctaccaaagtgctgggattacaggcgtgagccaccacgcccagcctgtgctagacttttatatgaccggcagtgcaataagtttgcttacaccagcatcaccacaaacactaggcaatagaaatttttcagcttcgttataattttatgggaccagggaccaccatcatatacacagtccatcaccgaccacaacattgtcccatggtgcatgacagtatttactatctggctctttataggaacacttcgcccacgccaggcctgagactggattatgcttgcagggtttgcatgcccttggggctgtgagtgatgattatatgtggaacttgaaggaatatatatatatatattttttttttttgagacggagtctcgctctgttgcccaggctggagtgcaatggtgcgatctcggctcactgcaaactccgcctcccgggctcacgccattttcctgcctcagcctcccgagtagctgggactacgggagcccgccaccacgcccggctaatttttttgtatttttagtagagacggggtttcatcatgttagccaggatggtctcgatctcctgacctcatgatccacctgcctcagcctcccaaagtgctgggattacaggcgtgagccaccgtacccggcctgaaggaatatttttaatagttctgtatttattttgatagatataagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctatctctactaaaaatacaaaaaagtagccgggcatggtggcacgtgcctgtaatcccagcaactcaggaggccaaggcaggagaatcgcttgaacccaggaggtggaggttgtagtgagccaagatcgagccactgcacctgggcaaaaagagtgagactccatctcaaaaaaaagaacttttaagtggtgtaggatgatgacatctaacaaaaatgaagagggagcagggcaggggaatggctgtgacttgggacccctgggttgtggtcagtccttggtgctggggtgtggcaggccacagagaccccagtgcctcctgatggtgcccctctcttccgacccagcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggtaagagctggggccaaaaaggtatcaggaccagcctggttggtgccccctcaggtgccctccctgatcccccagggtggaggtgtgtttgggagagcaggctgcaggggctcagaacacaagacaagcttggccattggttggcttagtctccccatctgcaaaaatgggcgtattgggtgggataccctctggggtcctttctggctctgaccagctccctggctttatccccgcaggcggtggtcaatatcctgtcgagctcatcaccacagcgggtgagatggacagtcacgtgctaacccacctggcccaggggctgctgctgggccggggcctcttcctggcctgggagggagcaggcctcgggaaactcctggcaagccatgtgtgtctggaatgcctcggtctccccttctgtatgaccggagcaggactgctgagggtgacgctctcggtctctcaagtcagagggcttagcacatactggctgtgtggccttgggcaagtcactttagttttctgggcccaaaggtggcctaagaaaggactctgcgccacagggtgcttctgggcagccaatgaggtgctgtgtggaagctcttcacacagcctggcagctggtgcctccttgataaatattagtttaaaaaaaaaaaaaagggccgggcgcagtggctcacgcctgtaatcgcagcactttgggaggccgaggcgggcagatcacgaggtgaagagattgagaccatcctggctaacatggtgaaaccccgtatctactaaaaatacaaaaaattagccgggcgtggtggcgggcacctgtaatcccagctacttgggaggctgaggtaggagaatggcatgaacccgggaggcggagcttgcagtgagctgagatcgcaccactgcactccagcctgggcgacagagcgagactccgtctcaaaaaaaaaaaaaaagagagtcaggcaactccacagggccatgatgcctgttcctccccacacccctcgccctcctggctggcgccgccagattgaccaagtctccctcccgtcctcccccagaaaaaggtgcactgcctcaacatggacagcctctctttccagctgggcctctacctcagcccacacttcctccaggcctccaacaccatcgagccggggcagcagagctttgtgcaggtacctggcatgcctgtcacccctcgggcctcccagctcctggaacttcctctccgcctttcttcccaccatgactccagaggagatgagactcccagagtcaggagggagacagcctgggtgcacgggagagggagagacagagaaggcattgctcagggacactgacaaggatgtggccctgtcctcctcctctgccccagacaggtccatgtctttctttccactgtgaggactcaggggtgggaactcttaattctagccgatatttgaaggcagcaggtggggtggggtgaagagcagctgcccatgccgcgtggccctacctacccatgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggtgagtggggcctgggccggccccagcttcaagtgggagcttccaggtctgtggtttgcaggaagggacatggcagcccacagggatgtggggccagctggtgaggggcggagccttaatcaggcatgtggcctggcagtctggctgccagcagcactttctgccacccgagagctttctggtgggactgctgtgtctggggcactggcagactatgcagctgccactgtccatctatccatccatccatcctttcacttacccgtccgtccatccatccatccaccctcccacccaggaatctaaccacccgcacatccatgtagtatggtcaccagtgtaatctcaaagaacaggagacctgagggaagagaggcggacaaaggacacacactcctggctttctgtatttgccagtcacaacacttcaccatctggtgacccccactctcaggcaatctatcctggacgcccccagagtcacccccaggcccttgcacagacaggcctccaggattacaaacttctctggtcataggaagctagggaagccttcaactcccctaagtgggcctctccctccagccagagtgagcctgggactctgggctgacctggctcatagctccaaagtgttcacaagggtgagggatgcatagtgcttccacagtgctcctgggcatcaaggcctccaggaactcacaggaaacatttcagcagcagccagggatcgtccactaggcaccctcccacagcacagatcttccaggactcacccagaggcatccagctacgaagcggtggagatgggattcaaagccaaggctctagggtgggctggggtcacggagccagggagtaaacctggaagccgcctcccaaaggtgccacatactgctctctctttctcctccaggaagtccataggactgtcttcatgcgcttgaacatcatcagccctgacctgtctggtgagctccctccaggtctctcgggtttgttctagtggctgaggtcacagtagggcacagcgggcagccctgagaaacggcctgggcacatagcacatggcaagggggaccccagagaaagcggcccagaaggggcaggaggagggcttcccagagccatagcagcctagagcaggggccagagctgcactttgcagatggagagcccttgcccgggaccgccctgtggggtgggagtctaggcctctgcccccactcacggctccactccatccccacagttattggctgaccttgctgggaggatggagtctcctgggtgagacagaggccctttgagggtgggtgctggccttgccttccttgaggcctctccctgcaggacgccccctctagcctctccatcagttccccccaggcccaggcccacaccaggcagaagagtcccgacactggtggcagaggcaggggtgagggatgggggcacctacctctttgccaccccatccaggccaggatggagcctccactcccagcccaggaccaagaaggcagggctgataaccccatgacacagaatcggatgtcagaggctcaaggaaagactgcttggcccatagccacacaggagtcaggaatgtggagggaatgaggcttggagcaatccaagagcagagctgcagggcactcggagctgctctggcccattctctacctgctaaaggcctcagagaggggcagggttgacccaaggtcatgcagcaggtggggcaggctctgtactcccgagcctcagtttcctcacgttaccccatccatcctccctgaaaacgccatctccatcagccttgaggggcagaggcatgacccaaaaggcctggctgggccctctaggtggacagtcctagcaaccatggctcaatgccaggcctggctgtgatgagcccgtttgctgcaagaggagactgaggttcagagaagtcgagggtccatggctgagcagagctggcaccaaagcccacacgggccagcacaacagggtaggggatggggcaggggcagagtggcagtgctgatggcgtcggccctctctaggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggccaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtgatgggttgggctgggagaagggcagtgacattcaaagccagggtggggtgagggcacaggacagggctgcttttgtagttggcccccactgggctggcctggtggcaggggtggcatcctgaacagtagcagcatccagggcacagcaggttttcattcagccagttcccctctgccattcacccactcgacagcacaccccagggtctaggctgcaagaaagcaaacaccaggaggccccatccacactctcactctggggttccgaacacaggccctcgactgctctaagttcaaatcctggacctgccaccttgttggcctgtgactgtaggcaggtcccatggcttttttttttttgagatggagtcttgctctgtcgcccaggctggagtacagtggcactatctatctatctcagctcactgcaacctctgcctcccaggttcaagcaattgtcctgcctcagcctcccgagtagctgggactacaggcatgcgccaccacgtccagctaacaatttttgtatttttagcagagacggggtttcaccatgttggccagatggtctcgacctcttgacctcatgatccgcccgcctcagcctcccaaagtgctgggattacaggcgtgagccaccgtgcccggcctccatggcttcttgaaaccagccacagttccctcgtctgtcaaatgggtataattctccatcacaaggtctctgcaagggggtctgcagaaagcactgcctggcatatggtgaacaggcttcagtctggtcttcttctcatctcacagacaggccacctgaggcgcacagggagggagggacttgttccaggccacacagccaggctccctctacacagtgcaggtccctgaccaccagcagcccctccctccgtctctgctgagggagcagggggtcaagggtcagtcgaaggctttgccatttctttaaaaaacaaaggctttaattcactccagccaccctctgtcccgcagtgtcccaggcagaggccctctcccttcccagaaggcactgggaggaggaaatctaccacccagcacatggcaagacccagggcctggccaggcagcgcacacaataagctgggcctgagccaggaggcaggcggggtgttgggggagacaggctgaacggccaggccactgcaacagtgagagacccggggagcccctctgctatctcagccaagaggaaggagagaccaaggcacagagccttaaaaaagacatcctctcccggcctcccatcccaaagccctggcccctaggccagtctagacagaaccaggaaagccaaaaacaaaaggcacctagtatgtaagttcatggggagaacgcaggcaggtgtgggaagctcccacctccaaccccgggccttggctactgggacagtgcgggctccagcagcttcaggacaccacccaccaggtgcaggctgccagtgactagcacatggatggcagcagcctcacggagtatgctggccccactgtgagccacagggtgggtgaggaggccctttgggggactaggtggctggaagatggggtctcggccttggctgatccattgcaaggcatgtgaaatgcagctgaagacgagggagctggcactgcaggtgtggggtgggtggggcgccagaagcagggatgcggacccaccgggctctgggctgggggcactccagaggtccgggctggcctgctcttcgtccaggtggttccagtgctgctggtgttccaggcagcggagcaggacctggtccagtgtcactgtgaagttctgttggtctgtggggcacagagaaaggcctatcagcgaaggggagagggagtaagggacaggggtggagaaaggggcgggtgcaccgtgagcacctgcttcgcaccaagccttttacgtcatcaggccagcagtctcggctagtggccttctccatgcacacagtgaagaaactgaggctcaggcaggttcagtgacttcaccaaggtcacgagaggcagagccagacagtctgactccaaagcttttgcccactaggcaccccttccccactctggcctcattgtctccatctataaaatgtacatccagctggggaccatcaccaggtgagcatagttatttctggggatgctggttaaaaacgcagattccaggctgggtgcagtggctcacacttgtaatcccagcactttgggaggccgaggcgggcggatcacctgaggtcaagagttcaagatcagcctggccaacatggtgaaaccccgtctctgaaaaaaaaaacacacacacaaaaattagctggacaaaaattagccaggtgtggtggcacacgcctataatcccagctatacttggaaggctgaggcaagagtatcacttgaacccgggaggtggagattgcagtgagctgagatcaagccattgcactccagcctgggcgacagagcaagactccatcttataaacaaacaaaaaacaaaaattagccgggtgtagtggcgtgcacctgtagtcccggctactcacgaggctgaggcaggagaatcatttgaacctgggaggcagaagttgcaatgagccgagatggcaccactgcactccagcctgggcagcctgagtgacagaacgagactgtctcaagaaaaaaaaaaaaaaaatgcagattccagaactctccccaaccagactgatgtgaggactggagattttttatttttagagagggtccagggtcttgctctgtcacccaggctggagtgcagtgatgcaatcacgacttcatgactcactgcagcctccaccttccaggctcaagcgatccttccacttcagcctcctgagtagctaggaccacgggtgtacaccaccacacctggctaattcttctatttttttttatagagatgaggtctggcttttaactcctgagctcaaacgatcctcctgccaaagtgctgggattataggtgtgagccaccaagtccagcctgggatctgtaatttttacactatttcaaactttttttaacatgatacatggtaaaaaacacattttacactgcaactcagtactcacatacttatacatatgcctggaacagactaatcttcaccaaacaggacctacccttactctgtgcaacgtacactggtattttctattctactctatttcatataaaataaaaaatgctggctgggcgtggtggctcacaactgtaatcccagcactttgggaggctgaggtgggtggatcatttgaggccaggagtttgacaccagcctggccaacatggagaaaccctgtctctactaaaaatataaaacttagctgggcatgttggcacacgcctgtaatcccagctattccagaggctgagacatgagaatcatttgaacctaggaggcagaggttgcagtgagctgagattgtgccactatattccagcctgggggacagagtgagactctgtctcaaaaattaattttttttttttttttgagacagtctcgctctgtcgcccagacctagagtgcagtggcgcgatctcggctcactgccagctccgcctcccgagttcacgccattctcctgcctcagcctcctgagtagctgagactacaggcacccaccactacgcctggctaattttttgtattttttttttgtagagacggggtttcaccatgttagccaggatggtctcaatctcctgacctcgtgatctgcctgccttggcctcccaaagtgctgggattacaggcgtgagccaccgtggccagccaaaaattttttaaaataaaattaaataaagtatactttggtgtataaaagagtataagtacactaaagtgttcttacacagtaaaacaaatttatttcctaccccaaacctccagtttggaagcccccactgtctacctcagggacccctgctcatccccaggggccatgcctgtcacctctcacctgcgttgcctgtggatgacacctctgtcaggttagggcagaagacggcatagtcaaactggcagggctagaaggccaagggaaagacttggtgtcagacccccgaaaggatgtccaccaacttccatatggccccctgcgcccacatctctggagatgcagcctccctgacaactagaatgatgctgtataaacctagccaaggtacttcagcaccctgcccccatctgcctcagtataccctgcctggcctgtggcctgagcagcgaagccccaacctactgtacagacaggggaacagtggccacagggcaaggggacttgctgaaggtcactcagatagtgagggggccccaaatccaggctggaaaaaggctgtgggtaaatgggagaggttctggatacagcctcagcctcctggtctgtgaaatgggagatgatacctaggggccacttcagccctgacagcttgggcagcctcagtttccccaagcagagaaaggcccaatgactccttcaaccaaacctgagaagcgggtgcccctagcagcaaccccattttacggagaggcaaactgaggctcggggaaatgccgcttctcgtccagggtgatatgctagtgcctaaaggggcatgacaagcgagtccagagtctacacctttagccacgatctggccctcctcttaagcctggacttgagtctagacacgcgggaatatgagtaatgacctatgactggcctccccacggccctgcagcacctggcagaaccagcacaggcaccttgtcacatctaatcctcaatacaactcaagggggaggggattggcaccccccagggtcacaccgccagacccagggcttcaggactgcctgccgcccacccccaagttggcccctcacctgcagcagcttcagcagggccgccgggtcccggtccccggtagcattgaagagcaagactcgaacctcggggccactgcgacagaggtgaggagctgggtcaaagggcgccgcccgttctccctgcggtaccaatcccgtccccgcccacgaccccgcccctccccatgggcccgcccccgcccttccccacgaccccgccccgcccttccccaagatcccgcccctcctcgtgggccagccccggccccacccccagccccgcccctcacccgctcggcctctcgcggccctgcagcgcctggcggaaccagcgcacgcaggcctgcgcgctgctggcggtgtgcgcaccgtccaggtaccaggtgaggggcccgcgccgcagcacctgcgtccggcccggccactccgtgttccgaagccctgggggagggcagcaaggcagtcctccaggccctctcccacccccgtcctcaattccgcacacacactcctgagcccgttctcccctgcaggctgcgcccgccctcaacactcaggaccccggcagcccaggaactttttactagcaccagtcaatggcttgggcttttcggctgtctcatctggtggaatctttcaggcaaccctgaaagggcctgctattcccgtttgacagcctgagagcccttagctggggccgggatgtgatgcgaggtcggtttgtctccaggaccttgtcacttgcccttgataacaggcgtggcacacagcgggcccaccatttgctgaaggggcttaacagcatgagcacctgctgggtgctgaaagctttgggggaggcaagaagcagatgactggatcaccatcctccagaacctcagggtctgatgatgatgatagtgacagtgacagcagctaccactggctggcactttatcccacattggccaggctctgcactcagcaccttagtgatgtcacctcagcgaatccccaccacagcccgtggcagtggctcctatcatcatctactttggcagatgagaagacaggctcagaaagagttcatgagctcaaggtcagggaggtttgctgacatcagagtcctttctcttaagcaccacttcaaattgtctcttatctcccaaacagaaaaccaaaaaaaaaaaaaaaaaaaatctgaaggggcacagacacacgcagtggtcccagctgggcaggaaggtctaactcaccgagccgcatgtgggatgtgggctggaacacaggtgccaggggcagctgccacaggagccctggcctggatgcctttggctccccagcacctgcggggtgtgtgagaccaagtgtgtccgggaccctcctaggcaggctccacaggtgccacccacctgcctgcccactcagctgcccactcaccatggcggtcctgccgctgcagccagcagtgggccagctgcaaggccaaggcggcgttggaccgctggtgctccccctccaggcccagggtcagcggcggccccccttcctcgagggcctccagcatcggacacaggtatagaggacactaggggagacaggcaggagcgggtcagcagaggccctccctgaccacgtcagcccttgcatctctcccctcccccagccaccaagccctgctcccagaactgagatgtgttccagcaggcctggcagctggcccagcgtcctcactgcacagatgggcaaactgaggccccagaggatgcagtgcctcctcaaacaggagggacacaaacccaccctgccgctgccccattccaatcagacttactgagatctgctgggctcggtccctcagcactgccaggggaccttcaggttggagcacagtgaaggcagggacaccttgctgtggagggaagaaggagagagaaagggctacctagcatcctccacactcctatctctggcccccacatccctgggtctgggctaccactgtctctcatccctcatgtttcttttcttttctttttcgagatgaagtctcactctgtcacccaggctggagtgctgtggcgcaatctcggctcactgcaacgtctgcctcccgggttcgagtgattctcctgcctcagtctcccaagtagctggaactacaggcgtacaccaccacacctggctaatttttgtatttttagtagagacagagtttccccatattggtcaggctggtctcaaactccggatctcaggtgatcctctcacctcgacctcctgaaatgctgggattgcaagcatataagccaccatgcccagccatccctcacgtttcaatggggaaatagtctggagaggagactcaacttgttccagtcacacagtgaagccaggatgaaaacgtagactcccaggccttccatgtctctcccttcccccagtctgcctggtcaccttaaagatgccccctttctgccatgcgatcttctccaccgtatcccccaggaggctggtgtggtcgatgccaagagaggagactccgcacaccacaggcttcctgcaggggaggaaaaggccatgaggccctgccctgagccaccaggcggcaggtgaggctgtgctcctggctgccacccctcgtcccaagcaactgcgctcacctgatgatgttggtgcagtcataagccccgccaatgcccacctccaccactgccaggtccacctgtcaaagaccagagggcatggcaggggatatgagggtgcccagaggccgcatggaagcagggagcccccaggcctgctgaggttcccgttcccaaggcctcagatgcagggttctagggagagggcacacaccttctcttggaggaagacgtggaaggccatgagtgtcaggaagcggaagtaggggggcatggagacacagctgccatcctgtggcacagggacatgtcagggcccagagcccatgcagccccttctctggggagatggggtgctggaacacgtagcacccccaaccatacccacccgccagccctcctgcatgcggcaccttggtctcctccagccggtggtagaggcgccagaagtacttggtgaagagctcaggactgatgggctgcccattgatgcggatccgctcccgaacctgcaccaggtggggagagctgccgggacagctggggtcatcaggactcccttcccgagcgtcctggccttcccccaccctgcagggactgatgctactggcctccgtgcctcatctctcctgtgtccctcggtttgttcctggtgccccatccccccggactatctgtagccccccagtcctccccatcttctatctccaggcctctgcacctggctcaccctattcaccacgttggtctcaactaagacagcctcctcacccaggctggtcttgcacattctatgggctccaacagtcccataccaatcagtcactctgctgacatctgtcccacaatgtcatctgtcttacagctctcagagacaaagcccacaaccaatgttcaagctgcagccctgggctggccctcaaggccatgtgggcccaagttgaaggctaggtttttatcccaaaaatgattgtagtttttatttatttatttttgagacagggtcttgttctgtcgcctaggctggagtgcagtggtgcaatcttggctcactgcaacctctgcctcccaggttcaagcgtttctcatgcctcggcctcccaagtagctgggactacaggcacacaccaccacgcctcgctgattcttgtatttttagtagagacagggttacgccatgttagccaggctggtcttgaactcctgacctctggtgatccacccacctcagcctcccaaagtgctgggattacaggcatgagccaccgtgcccagccaattttttggtatttttagtagagatagggtttcgccatgttggccaggctgctcttgaactcctggcctcaagtgatctgcctgcttcggcctcccaaagtgctgggattacaggcatgagccaccacgcctggcccaaaaagtgattttagaagacaggttggtgccttatgtttcaatcctcaaagctactcaggtagtaagtcctcctctccatctctttatttgaacaagaactgtttagggaaaacatatcggcttgaaatgaccttaggcagctgatttcagaagttcgtggtgatgggcttagaagacatgcgtggcacaggaagagtgatcccggttccacctggccatcctcttgtgtaagtctagacaagtgagaccaagagggggcgctgccccagggcaaagccacagtggagagtggccaagcagaagggctcctatctgcagcccgcctaggagaccttaacgtggatggcacaagccacccttatcgtttaagcccttgcaaggcaattttctccttactctaaagacatactaattgataaatatctctatgtgattttaaagttatatatggactttaaaattttttcttttcattttttttttaatagagatgaagtctcactacgttgcccaagctggtctcaaactcctgagctccagtgatcctcccaccttggcctcccaaagtgctaggattacagttgtgagccaccacactcaacctggactttaagttattaaagagacatctgaccatctgactattccagctatgtaattttcttttttttttttaagatagcagtttgctctgtcgcccaggctgaagtgcaatggcatgatcactgctaactgcagccttgacctccccagactcaggtgatcctcccatgtcagctgcccaaagtgctgggattataggcatgagccaccacactggacctcctgctacatatttagtttatacattaaagttgctgccccttccccaatttttttttaattatgaaaattaaggccaggcaccgtggctcacacctgtaatcccagcactttaggaggccgaggtgggcggatcacttgaggtcaggagttcgagaacagcctggccaacatggtgaaaccccatctctactaaaaatataaaaattagcctggtgtggtggcaggtgcctgtaatccaa

SEQ ID NO: 815 - DNA, 2993 bp, Homo sapiens
cctgggccggccgggctggatgagccaggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 816 - protein, 658 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 817 - DNA, 124289 bp, Mus musculus
  misc_feature (1)...(124289): n = A,T,C or G
gatgtgggttctcttactgtctccattgtactctgaggagcctaaggctcagaagtgaaggacacctgtgcaagggcccattgtgagtgagtggtggagctgggacccaactccatccacctgatccacaactctgacctcatagctcctgactgagagtccctgtcattgtaccagacagagagagccaggagtacagcccctactgggcagacctgtgaaggaatggcagcctccatccttaacacaggtggggttgagttggaacatcttgctccctgcatgtcacgtgggcagtattgatgccacaaggaagcccaaagtaaactaccctgtcctcaggacctgtgggcccgcgggtgtgctcaccctgtcctcaccatgtccttacaaccaaatgtgaaagcatgctcatcatggcactgtccatgatagaacaccagaaacctccagcctgcctgagattcctgagcaacaccagatagctaccagaaatatggtggcaggtctaaggaggtctaaaaggcgttggggtaggcaaggatgactgcatttgcttttaaatgtttgtgaatatttactatatgtatgtgagcatagtcatgtaaaatctctacagtgatatacaagaaactataatcctataattttagagtgcttatttacctgtgagatagacgagcagatagatgcacgaagtctttttcagtggtgctgaggttgagccctgggcctcagacatgctaggtagttggtctgccacagaggtacactcctggcccagcttacttacgtctacacattacatcagcgtcactggccatctctgtgatttgggcccactgccatgtcagggcaacaaggggaacaaggctgaagcttgaacagggtcgctgctgcagcgagatgcattaagaggaagatctggatctcccattccatctcctcagctcttggctccctcaccgtccctgagctttcacagcaaactggagctcaccagccatacataggcagccccagggcctgtgtgcgggagtccacgtggttctaggtcctcctgataggcttgaggtaggcacctggctggaggaacaggacgatctcatccaggagcagcaaggggaggcctgagtgagttcatactcaggaataacagcagccagaaagtgcagcaaactcatgcagcagactggcatgctgtccagaagactcctaagtgggatttcatgcactggccaatacggcacgccaaggcaaagtcctgccatgtggttgtctccagttttcagacctaggggaagaaggattttctttttatgcccttttcttttttatttctaatttacttttcatcaatttgcttttatactgtgatgtataaaacatggggacaacctcaaccccatgtatggggtagaggcttacttaaatcagtcactgtgcacccgagagacagctcaggaatggcacggaaaagggtgttgcagaagtgtgcccttccacatggaatctgtgatgaagactgtttctatttgcacttcttaaaattgttttttttctgacactgaatctatttaagcttatttataatgtatgtgtaagaaacaacagcagtagagctagctgtggcaacactcaggaggctgaggcaggaagatcacggggccagcctggactacaaacaactaaagacaacaacatccaaaaacagcagtagagaaacaccatatacttactttagaaaccctgacaggtcttgagactttccccttccccttaagtcattctcttcctcccccaacttccctcttctcctgatgtgtgttacttccctgtctcattttactgcactcctgaggaggaaacccaggactcagctgctaccactgagctatggcccagccctcatttacaatctaaaaacctctttaataacagagccatgcctgtgtgcgccatcctgccctctgctcctctgcactgtggtcctgaggttgagtgatgcttgcacatgtggcttcaggtcactgcggcgcctctcttctctgtaagctctgcctgtctgtcatctcagagctgactccttattccttgctcccatgagttttgaggctatgaacattcttggaactgcatctttttctgatttctcatttgggtgaaactgacaccaagatggatttgggttggtttactttatgaaatgatgtctaaccataccaactagaacaccaaagtaatgccaagggaggaagttcagagctgggggtctggaggcagctgtgagggcagggaagtactctgacagtggggctggtagcttctgggggaaggtagtggagttcatgatctccccatacttccttctcctgtgccaactccctgccatcccttaagacatcccccaccttctaggctagtttcccctccagagacattcaccctagttcagcagagcctatccttcataccataaacccagttagttgccttggctcaggggatagtggtggcaaatgtctcagccctggctctaactctctgtgtggcctgtacaagtctcagtctcctcatcttcattatggcgacccttccagcgtccacctgatagaggtcaagtgaggactccagaaactgtgcatatgaagtagtcagcgtaatgcctggcacatggtagctactccccagtggcagcagtcattgccgtgctcttccctccccatacttgcatgtccctaactgtaggaactgtcccctatccctttctgtggattgaaactttgacagaagggtgagctttctcttctaggtacctgcaaaccttatgtcctttgaatgagtatctgcaggacttggcgagactgcaaaggcttctgagagcctagactaggtctgtggaggagagcagctctgggcataagctgtgggccaaggcactggagcctcatcgctggactcgaggaatatggccatggcctcacagtcctggatggctccccagtgtgagatccacctgtcaacccacagcaactctcatgaatcattctgcagcagcaccccaccgggtggctgtcagaccccaaactgcgcaccctatgccccctctctgggccatcgtctgtccaccagctgcttttgcatcaggggagcatttgacccatgttgggttctccatgctttctgctgcacacagagtggatggcgttaatcttcgagagggctggaaagcagagacgggctgctggacaggcttgttacaccccaagtgcaccggccactcacccacagggccgcctccgattttgtatacccttaaagcatcctgtgtgtgtgtgcgcgcggtgtgtgtgtgtgagcgagtgagtgtgaacgctctgagaaacatacattttggcacaagacttgtgacatcacacacttattggctttgagtccctgcttgaagctttagttacagccttgtcctctaagaaaagtctgaagggagtccagaagctccgtgttaagggtcccttgagttcttttactgtaaacaaacaatgccttaaatcgtgtcttgttttctgttcctatgggtgctattcatctggatggcctgttccctgggccccaggccctcctgggtcttgttgtcagcccgcctgaggcagaatccatttcaggaccgtgtactgggcactggcctgcttgctccccaccacgagctttcctggtggtcctatgggccctccttatctcgcccactcctgctatgctggtgtgggaagctgggaccttttctcccagcagcgtggaggcccccacagtgaccggtggtcagaagctgtgccaccccgcattctcccacggggcagaattacgctcctttcctcacccttgccaccactgccagggccggccacactgattcctgatcacacagggagctgagtgacaagggggcctaagccccctcagtcttgcccctaaatgcagtcaccagcaagttctcatccaagtccaagggcccagttcttgatgaccaggtgagaagagagccaaaccctagggagtgagatgtccagcctctgcattcatgaacaaggacctatctgtcacctgttgtcataaataaggtgatttttactttgcacattttaattcaagtgtattgccctttgtcatcactgatgctctctgtccttcttcctcttcctcttcctccttgaatctgggtaccctaaccctgagaagaaaaccctcagttttctggaaaaggctgaatgtctgggtccctgtgggtatcatggttttacacagtaacccaatcatgaaaccatcccaacaataatggagaagctgcagacaacaccataaccatgaacttaccaccagaaagcactgtattacaaacaaatggtgacatgtctctaaaacatggatgacttgatggggtgattagttgttgtcatggccgtacgtttgttgtactctgaagctagccttcctgtgggcagagcctggatattttcatgccaagagaaactccacatggtaaagttgatgccatcaaaccttgaccacagctgccttgcacatccacccccaccagtggtccagctgtgtgcactagctgtatgcactggattctatcaacgttgctccagttagaatccagaagatggatgacggtgtcagacacttgaggcacctccaagcagaaccattcgtggtccactttaatctattccaactccaaacctgcctgcctgcctgcctgttaactcctagaaagccagaccatcagctgctagtttcctttaggtgtctgcttttgggctcattgtttggattcttgcatgtgcagtgtcaagacatcaaaaccccagaacttcatcccactcaaataacttcctgccctttacagatttgtcttatgagacacagtgttttcttccaggcctaatctgaaagagcacaatcacaattattttcaaagtgtttaatcttcctaaatgaagccaaactcccctcccacaagcatccttaccatgaactcttgaagacaactgcttgaactttattagtgaaaagccttgtaggacttttgtgagccttgaaggtagtgggaaagccctgtctatggagttaaaagatatttgtctctccaagcagggccttaggccaagcatacaagctcagtgctgatatcctcggcacagcttgtcacacaaggctgcaaggggaggtggccaggtcacatgacagagtcagtggtcctttggtggactcttagccttgaaggaagctgttctgcacttttgctccactgtccatcgtacacaaatactgtgaaactgttggagacagaccatggcaccccaaactgagagctgtagaatgctgtttagaaactgggatgggcagctggtagaattaggaagtcccaagaaaagccttctcactcacaataagagtaaacctctgtcccctttccagtgtacaagttttgcaatacaaggtcagccaagtgtccgctggcaagcaagataccttgtggatgctggacttggtgggaaacactcctacacaagccagcaggagagtccggccttcccctgccctggctgaatgccttggggcacttgatgctgagcaggtagacacatccgtggctcgccaacaggctctctgtatttctcctccttaccaagatggccagtgtttcttccatcagtttactcttgcctctcgagcctaagaaaggtgtggtggttttttgtttgttttgtttattttttaatatcaattttcagatggaaaatgatctgtaaaactgggaagccatttataagccaaggctgctttaatctgcacgtggcatccagagctttgcaacctctattgaatattgccaaaagcacagcttctcttctgtgtgacccttaaactgtccctgtgtcatattgatatgttgggtgatttcatgttataaaacaaacaaaaaacccaccctgcacaaagcccttttgaaagtgtatttattgcataaacattcatatgtcaagtgaatacttcttataccccaggctctactgaaaaaggctagaaacaagacaaatccaattttggcctttgtagaacttaaccagtcaatgaccaaataattaccacctcacaagccaactttggcaagaccctatctctcccctactcctgaatacaatcgtgtgcattggttcttccaggaagaccagattgaatggaaatgttgggagagtaagttgcattgaggacttgctggagtcccgacatgggaggctggctggctctaagcagccagattctgatctgtgttcaagaatggttccagggaagacgccaaaggcaggatgagagagtagggtctgagtgcttgccgtacgcacagccccccaccccgtttactctgtaacttcagtgttaattcatatacagtatgagtgggagctgcgtgtccctgggagccgaggacttggactttggtccatcttgtaagctgctgctgctgcacaagtgtgtgtcccatggacagccccaaattgccactcaccgcagcaaggtgataggtcatctgccattttggaaggactttgaccattcagtaatgaaataatagtaattcatttattagtgaggcatactctttaataaattttgtgccaaaatgcatggtttcccacttagcattcaaaatgttgtataaagagtagttttcaatttcttacatgttcttccaagtaaactgaaaatgagttttcacatcttactttgtttcttgttcaatctgctgcacccccccccttaagctgtctttttttcccagcagaccctgcatgcagttgtgtgaggacttttctctaacatttgtaaattgtctcatctgcaataaccactgaacatcatccctccttgggagtctttagatttttggtgaagtattttgttacctcagtcttgtatcaagttgctgtatttttcagcttgttacactgataataattgtttcactaattaaatactttaatgtacagacatctttgtttactttgaaattaaatgtgttttccaatgaatatcgttctatttattagtgtcacatgcagtcaatttgacaggcagctgctgtgctacatgcctggaggagcccagggctctgctgagagtaactaggatgtaaatatatagggaaagaacagggacaatattgtggatctcttggagaggaaggcagagggtctggggatacctaagaagacagggggccttgagagttttcagatcagaagtcgcagaacattaaggaggctgtaggagtggggggaggggggtcagggagacagagaggacaggatgcacatggggaaaagcaggcaacccgagattactgagggagagttccagtcaaggtgataatctgaaaagatctgtcaggaggaagtcatgatgcataaagcaaacccactccagtttgattagaggtaaaggagagagggagaaagcgagggagggagtaagggagggagggaggcagagagagagcaagcgccagcgagcaggagcgcaggaactagagtagattggggatctcagtggcagctcccaggcatacacacccattcttgctcctgtctctgcttgaatgagaccagaaccttgtgatcgcagtgaaagagccctgctgcacaaattagcacacacctacactttacctgggaagaggaactctcaattgagcagcttcctccatcagattagcctgtagacaggtctgtgagggcttttggtagtggtggtggggtgctgtgaaggatctaagcccactgtaggtggtagtatcccgggcaggtggtacttggctagataagaaaagaaggtgagcaagccagaggaaaatctgttaagtgctgattcagttcttgagttcctcacccttccagctccaaactgttgtacctcgttgtggactccgcttcagccaggaagacccgcatcatccaggcacccctgaagtgaggaagaggcaacgtgggcggggcttgtgtagggcaggggaagctaaagggctcttggggctgaatagccaagggacaagagacgcagaattgctccaagtacagacctcagtttctgcttgggacattgagctcctgctctgacttcccagatgatgggctgtagcctgtaagacaaataaaggctttcttccctaaggtgcttttgatcacagcaacagaaactgaactagaaatagatggcaaagccatccttacttaaactcagatgaatttccacacccaactacagtgcaatgttacagaactcagatgatgcatccgactcggggaggaaatgaggggtggaggttagagctgtcacaaaattggaaggttatgaatgaaaacctgaacccacaactggtagacaaccaaagctcccctcagcctcactgtgtcagaccacaaacagccaccaggagacagtagtacctccttttgctgactggttagatcctgaggtagcgcaaacctcatggtggaccccagttcaggcaggaagacccgcaccatccaggcactcctgaagtgagaaagaggcgacatgggcggggctagataggcgggacttgtaggcggggaagctagagggctcttggggtggaatagccaagggacgagagaacaaaattgctctaagtacagacctcagcttcaagagaaaagaggcggagctccggggttgggggccatgcctgtgggcgggatgtggagaaaggcggcccccaaaagaaggcggtgctacgatagaaaggaccaagaggtgctgaggtgaggagggtcagcagagaatccagcaatcggagctgtggagcggcgggccgatagagcgctctgtgctggaggggtaggtgggaagggcctagatctgtgggaatggtaaggagcgggagtgatgggccgtggacccgacgaagttgaggatccagtgggcattgggagcctgcgtgcgctacacagaagaacggagggagcgcgggtagaagatcttggtgaggccagttcaggaggggcgtggctggagctggtgtagaggcagggtggggcctgcactggtctgagaagggccggagaaacggagatcgttagctcggggcgtggcctgtgcccagactagggagtgaggtgggtttggctaagagatggggcgggcccttggcaaagctgaagggcaaagggactgactggataagggtttggggtggggcctgagcccactgataggtaaggcttggtacttggggcggggcacgggtggagcctgagcagagctgagaggagatctgcgtgattggggcggggcaaaggcggacaggggcgggacctgaacctaattcaaatagactgggttggggcggtgagggggcggggcctaaacccagctgagtggtgagggaggatcttctagattaggggcgaggcagggggagggccaaggcctcaaaaaggaccaaagggagtggattcggtaggagatcagggaggttccggagactagctccggagagatgaggcaaacttcgctaggctaggggcagggcttaaagccagaggttcggaagaggcgtacctgctagaatgggggcggggcagaggtgaggcctaaagccagaggcgtggttaggccgttagagtaggggcggggcctaaagcctcaggcgtgttcaagggacctgattagagtaggggcggggcttggaccccgcgaatagtctgagggcgtggttaggctggagttcggggcggggcctgaggtcccaggctgggctggagtttggggcgggacagaggcggggcttgggtccggtgaggggtgcggggcggggcgtgggctgcggcgcgctagctgagcgtccggccgaacaccgccgaggcccgagcccacccgagtgtgcccgagccgtcggcccccgcccggggcgatggagcaggaacccggcggggctgccgctgcgctcctgcggcagaagagggcggcgctgcggcgcagggggtgcagctttgagagtcccaggtaccgttgccccggaggggtgcagcctctaggggtgggagaggggagtaggccacgtgggggttggcggtgtgaggggacagagtgtggcgaggccgcggcgtgggagggagtcggcgcagagcccagtagagcggccgggccacgctgagggagtgcccagcgggagggctagagacctgtgtccggccggcagatgatgtggacgtccgaagcctcggccctgtgacaggccctgcacactacggctcagggaggtcttgggctgtggagaacgcgacctgcctgcttctaaatgctcaaggacaaggtcggaacccctaagcccccaaaaggacaccctttaggcttctcttgctttctataatccatcctcgcaccccaagtgcctggccacctgctgcctatggccccgcccatctgtggttggggtggggggcaccctgcatagttcctaggtcctttctctttcccaggttgtccgtgcccctcccggacttaccttccttaactggcgccctcctgaggaaccagcctggccgtaggtgaagcttggctgctgccggacacgcccttccctttgcggctcttgcccatgcctatccccggcttactcccacctccaaggaattccttgtaacttgaaatgggtcctgcttccaggtggactcattcctttcagaatgactccagcaccaccatctgggccagattttcatcagtattctgtaataatggccttagggagggtatcctgaagccaacccccttcctcctagcctactgctgcctgcacccctgagtttttaattgccatagcatgggtagggacgaggaagagaaaaaagatgtaggactctaacctccactgaggtggaaaagagagttcatttgctaaggcacaaagcaaaccagccaagatccttaaaggaaggtgtgatgcccttaattggcctttctcagactcagtccttgacacactgctccagcagttctgatgctgtgtggtaaggacagatatcaaggctgctctagccgctgccctagcctcttccccatcaccacagctgcctcaagcctggcccatcacagagcctgaagggcttgggcactcctccctcaggctgtagaactgctcatcaattctttttgaaagtctttcttgaactctaggcttagctttgtgtgatcagcacctgggcatctgccaagaaggttctaaatatttgtgtggtgacctgagtggaacatttcccttccataggagacccaggcagctaacaatctctatggcttgagcatgaagaataggaagaggtataccaagagactggagcaaagagaatctctcaggtctgaggcagcctgcttaggacagtgctgctacagaacttccggacatgaaggaatggttctgtaatgcagcccatgcagtccgggagccacagacacctgtggctgtggaacacctcgccaagacacctgagtgttgagttgtgcttagccttcaatgcaagtaaccacattgatcccagcactaccccctcagccagcattaattagctttctcaggctcagtccttgacacatctgctccagcaattctgataagagccttaggaggactgagaaatgcgtaccatagtggacagtgctggcataaaaattagacttccttcccctttgtcttcatgaccatattcttcaagaactgaaatgacttacaagcctccaggtgtttttgttctctgatacaccatgacattatctagtggcttgtgagataattaggattagcttttttttttctttttttcttctaaaaataatttattgaatgaaatttgaaaatgcaagaagaacataaacaggataattaaattattttgatggtagtattgatgatatatagtctcatatagccctggttggcctgaaattcactatgtaaatcaggctgtcctggaactcacagagacctgcctgcctctgccccttaagtgctgggattaaagaccaccacacccagtggatagtttattgattcataatcccactatagatataattggccttttctccatgaatatttatcattttaattgacttttcactcagcacatcataaaccctggaagcaatccttacatattccttaaaaattttttttcagttgctgtgtgatctcctactatatggatgtctaactatttttagcctatcttttactactttcactcttcctagagatgcagttcatttatgtatagtcacttgtgtgtgaagacatcactggcccataagataagatcatgaaagtgatgggaattatgggtcaggacaaaagagcctcttaaagtcttctgcagcaggattccagagtgctctcctaggcattattattatatttgccaaagtgataccttgtcatttgaatttctttatttagtaatgatgcttttctcataaatcatatttttttacttattttaaggtatttgtatatatgatcatcattttcctttggaatatttatcctttcctagtagaattaaaacttttttttatttattaaggggaattttgcggtaaatatatagcagatttttttttccagttaattatttgccttttcacattctgtgtggtggttttccagtgagtgtgtgtttgtgtgtgtgcgcgcatttgtgtgtgtggtgactattgtcttaaactttagagccactgatttcttcctcttgtttatactcatgtaaaagaatctctttacttaaatagatagtcatctacaatttctccatgtttaatgaaaatttacagttagcatataaagtagttctccattatctttgttgttctaaaaacagcttccttaattcagtaatccaaatgacctcatgattctggctcagtgtcagaccctcttatctacatcttgaccgaatgggtgcatggctccttagaccaagcccattgatccagaggcctgcagctgtctgagagcttctcggctgcttttggaacataactaggaggggaagccttgccacctctgtatgcctcagttacttctcctggccaactgtatcaagtttaaacacccttgcctcatggttagtccctttgagaatgagtgttagccatatttacctactcattttatctttgtgtgtatatgtgtgtgtctacatgagtgtgtacttctgcagcattaacagtttcacggttctctttgctaaatatcctgtgtgagttctgatagctggtgtgcaaacacagcaagctaagaaaaggaagtgaaggagcaagaaatggcctagggactgggcatcaggctggtggtaatgaaaaagactagctctctgtacttggaggcatcagggaagacacccgtgctgttaaacaacttgccctgaatgtgttcactgtgactttatagacaggcagatcagatggtggcaatgcacaaggacctgggctcaagtttctgcctttgtcaatcaagcaagtgaattaggaaagttgcttagccctctgtgaatcttggttaacaaatttttaaccgccctgtattgatgtgagctttaaatgacctagtgtgtgaagtgctgctaccaggagtgtgggaagcactgggactgacagctgtggacagaatgattagctttcggatgaacgttcttagccacatctactctgagtaagacactaataggcaggtccatggtattttaagattctgttgctttttttgcccccatttctaaccatcaagaaagacaagtaatgaacttgtgttattttaaatattcatcacttgctctgtcacttgggctgcaacagttcatggaggctgagcttcaggtgaactacagcgttagcaggttaccttccagggttgagtttacagaatcaatttttttcattaatttttttttattcattgagaacttcatatactgtattttgatcatattctcctccagttcctctcaacaccccttcctgatttgaaagccaagtcctccatggtaatgcaagaaacttcttcagcatcctctgtagctggtcacctagattctcatgttctggatagggtcaaggagtccttagttcattcatttattttttatgtatttattttcattaattaatttgtttattcactttacatcccaattgcagcccctccctcctctcctcccagttccattctcacaacccccctctctcagagaagggtatccacctgccctggcacatcaagtcacagcaggactaggcctcatcctttcccacagaggccaggcaaggcagcccagctaggggaaagggatccaaaggcaaggaacagagtttgagtcagagacaacctccactccaactattaggggacccacatgaagacaaagctagctgcatacctgctatttatgtttaggtccagcccatgtatactctggttggtgattcagtctgtgagtccccatgggcccaggttagtgtgcatgtgtgtgtgtgtgtgtgtgtgtgtgtgtgtgtgtgtgtgtgtgtatttggtgtagtagtaatagtagtagtagtagtagtagtagcagcagcagcagcagccatctacattgttcttttaagtcagagtctctcatttaccaggaggtcaggaagtcaacagtcaggcttgattagctgaccggtgaagcccaggcactttccaccagtctccatcttttcagcactcacaagcacatgctacctcgtccagcttttttacatggattctgagcattgaactacggtcctcatgctaacaacaagcactttaccaattcaagctatttctccaggcccggtttaaagcactttattagtgagcaactttgctttcctaagagcattgttgaagcctgcctcatccttgctgcccatcactcatatttctgtctgtgaagccacttgtggtgccagggtcattgccgtgaattcaaggtgaaagataatagcttagattaggtgcttctcactcccggctattcaactgtaatctccattgaaatcgactccattcaggactagtaacacaccatcctcatttctgataggcttgcatccatgccttatgagtacattttaaaatatcaaaggctgtgaatggcaagcaaagagaagctttggttcatgcagttatgtaatgctaggtaggatagagaaagctttgggagtagatggtccaggtgtttcaataatgtcatccaagtcttcattttctgtattgacttttatcctagtttgctttctattgttgtgataaataccatgacccaaagcaccatgggatagaaatggtttatgtttctataccatagcccatcattgaaagaagttgggataggaacctggaagcaggaactaaagtagagaccatggaaaaatgctgcttactggtgctcacttctaagagcttcttagccttctttttattacagcccagaaccaccttcccagggtttgacaccacccacagtgggctggccctcacacatcaaccattaatcaagaaaacaccccatttgtaggcaaacctgatggaagaatttttttcaactgaggtttctttaaagataacttgtgtcgagccgggcgtggtggcgcacacctttaatcccaagactcgggaggcagaggcaggcagatttctgagttcgaggccagcctagtctacaaagtgagttccaggacagccagggctatacagaggaaccctgtctcgaaaagcccccccccccaaaaaaaaaaaaaagataacgagtcaaattgacaaaagctaaccagctcaactttatcctcaaaataggcaaagagagttaactactatagttttccttttctagtctagaaagatattgctttattctcagtaaatgtctggagtgaccttcactagccagggaacatccttgaaccaaatggtcagacctggatcacgtactcaactcagaagtgatgggtaaatcatttccatccatagagaccagaaggtagtgacttccgagggggaacttacagtgctctttccagaaggaagtgagtattgggttgaccagagtgctcttagatataggaagccttcttaaaatcccggtgtcggggcgttgtccatagccacaatcgggttgatgctatgacttagttcttgtcctaaaggaccgaccatcttaactccgtgattacattacagttgctaatgtagccacagtggacactcttctgcactagacagaagagtttgaattatgagtggaaaacatattttgtccttttccaaatattgctccgtacatgacggcctcctcattagtcatgtagaaaacccacgtcttcaagagcaaatctgatgccaagacaaatgctttcttcttcctgttgctttccaggccaaactgggttctgaatcgagcagttatccattatgcatgcagtcgccttctcttcttccatatgtttcttctgacttttcggtcttgttgtcattttgtaggggccttctgggtttggggtagttttgttaatgaaaacttaaatggtgctgcctttatagtctttagttcctctatattacatcatcattcttttgtttgtgtcaaggccttaagtatttaatcataaataaatctgctactgacaggtttcttttagataaacagcagtcttcgtaggaaagactatgaaaagccatcctgcattgggccaacataattggctctgagggccaacagaagaaaattaattttcatatcagatctgatctcctcctaagggcaggggaagcaaaaccaaccttcattattcactaagattttaaattaatgcaaaccagcttcctttctcggaggaagacaatagttaaattagttttgctgtagaaggttaatatgagaaattaggtttggtcgtctggtttccagaactgaagatctgaaaagagatgaagtctgacaaacagtgctgtaggcggatgggagaactgaggcaacttgctgggagacactaaagccgtgctaattcacatgagagcagcagcgggagtctgatggggtgggggatacatcaacttgtttctaaatcttagggtctgagaggacagagcagataggagcctgactccaaagagacttaagtagaaggctgtcctctgtggggctacttactggaagagactgtttagtgtacattattagtcatttgtagccaacaggagtgtgctctcacagttcccaaggctgtgaaatccagacttaggtcaccacttgatctgtaactggtgagtgcttgtttctcacagacagagccttctagaagtgcggtcacatggcagagacttaactgaagccaacaagctttgcctcttttaggagttgcactgggagagctctggtgcctgactaagcccccaagggtcctctcgcgtactaatcagaccggggttacatttcagcacgtgaattgggaggacttgggagaggcacacaaacattcagacgaacaaaagagagaaaaatgtctaccagaactatgtcacaacactgtgaataagtagaggaaccactgccaacctgtgtttctggtttggaaatctatctagactatgttatttctttcggtgaaaagttttgggttgcttctttggggaacaataagtgtgtaaaattacattcaaaaaattttttttctagtggccatactgttgaaaacaaaattaaacgaaacttatttgactcttttatttgacccaatatgtcaaaaatattactttaacatgtaacaaatatttcaaaataccaagatagtttacttcttttcattcaaagtctaatgtgcattttaacttagagcacatctcagctcagaccagttaaaattcagtgcggttttttaaaacattttgttgatttagtgtggagctgtgtgcacacttgtatttgtatgcttgtatatgcacagcacagggcacatgtacagatcagaggatgactggtgagaggttggttctcccttataccaagtagatcgtagggctcaaattcaggtcattgagcttgacagctgatctctaccacccccacctccatctccctgccctgcccaccagccccttgtgcttggtgtttgccttataagatgatgtagagatgggtctttagattataaatgtttgaaagaatgtagaaaggtgttggttttagtttgacctttcatttgattaggaataattggaataaaggtttaaaaatgtggaactaaaataacagagactgtaagacactattttataaggaatatgtaatatgattggaaagttttcagaagatcttaaggaaaaatatagatatgactgaagatatcattcagtagaaaaagtacttgctatgcaaccgtgaggacccacatttagatctctagtcccccaggtggtgtggtggcctgcttccaacccagaggaggctggctagcccagctagccaaattgtcagtctctgggtcctacctcaatatataaggtggagagcaatcaaagacatccaacatcagtctttttttttaaaagatttattattataaataagtacactgtagctgtcttcagacacaccaaaagagagtgtctgatctcattacaggaggttgtgagccaccatgtggttgctgggatttgaactcaggacctatggaagagcagtcatcttacctgctgagccatctctccagccaacatcagacttgacttccacatacacatgtgtgcacacacccataaaaatacatgtgcccctcaaatgcagacaatatatccatatgcaccatgtttatgtaattaatatactcacataagtaaaaagtcatagtttatgcaaagtggagtgttttgggttttttttaatcaaccaaatcatctaagaagtcaccactaggtgtgacctcctgtgggtcattgctggcctttgacaaagctgcttttggaatggggaggagataatgacagcagatgattggaaacaaccactagacacctctgcaagagtggcatggggtgttagaaaactcatggtttgtttatgttgacttgggtttttgtaaagatgtttatactggatgaaatctatccagtaaagggaaagaacttggggatgggaaagtgtttcatctgttagaaagaagaaagaaagagagagagaaggggagagagagaggaaaagaaagaaagaaagagagagagagagagagagagagagagggagggagggagggagggagnnnnnnnnnnnnnnnnnnnnaaggaaggaaggaaggaaggaaggaagaaagaaagaaagaaagaaagaaagaaagaaagaaagaaagaaagaaagaaagaaagaaggaaagaaaggaaaaagaaaaaggaagaaaaaaagaggggaagaaaagaaaaaaaaggaaaggaaagaaaagaaaaaaagataaaagttcacaaaggagataatggttgcctttccacatttgaaagggtgtcatatgaaggaggaatggggccaactgggtgtgtggccctgagctccatccaccatcacagtgggtgtgaagttaatgaagcagagtgaactcagtgtatgaagggctccctaatacccagcacccactcctctccccaagctagagtggctttaagatgtgcttcagtttctgttgttggacatgttagtacattcccagctagactcggatttctcagccatcttaccttttcagcacactttaggatcacaccgttgtcaccagacaacttaacacaatgtcaggcaagttagcatcactgagagcaaagtgtgctccctcccagtgacctgggaagtctgtcatgtagtgtgctctggttgtcctatagcacttcttcctgctagggaagtacttagtgcttgaagcaaagtttcctcttctacttcagggctgcactcctatgtgttccaataaaagaacaccatctccttcttctgctcatggaatttgaacattgttccaattagaagaaatctaaaccctgtcctaccccacatagagttctgtctgttattaagttgatttgacaaactgtaacaatccctttggacaaacactctaaggccaaaggcacagtaatctgttgcagattacagaatccgcccttctcagtataatcagaggggttaatagggacacaaagaacgaactgtttataatgtccaggaagaagcagagggctggttagtttgtactctcctgatgcttggcaatcattgggaaagaaagattccacttcatgacaagaaaccagtagggaaggaactggtgctggagggcaggatagaaagttctccaagaatgggcagacttctggatttgagttcatagcaccagaaacaccaagggacatagacatagaaagctaaggcaagtggttggaaacttctgctgctgctgctggcactaactacagagcctcactgcccactctgccgtggtctccaccactgttatcacagcttcagtaaactctggaatcaaaaagcagctgagtctagatccacagaacccctttgccctccgcagagcaaaatgatggctgtttctctcgttctgtctggcttcgttccagagcctctccaaaccatctctggtctgtagaatctaaatcatgcctgaactctccccacagaaaagggggatattgcagtttgaactcttgcaggataaggaagagggcatggagcaagccacagcacagtgagttggaggctgtgtctctctttgtctattgcaacaacagcttggaaagccagctgtaccccagcttcagacttgggctctctcggcataaagagtgatggcttagcacagatggaactgagcgcatgagcacaggcttctcaggtcactgagagggaggacactctgttctcactgttgataacttgaatgacattgtattaaattgtctgttgctcttctgaccagagagaggcactgccaggcagtaagcatatcctcacgtctcttccactcatcaagcctggatcagtgttccacgggtggactgtctttgttccatgtatccagctagatcctcacaaagcagctccctgtcaagagacgagtgtgatagtggaggcgcctgaccaacggcatggctaatctcttctgaagagatttgaaaggcccaagcttcctggcatgttttccttcctccgaatggaattttctgtgctcttggcattcacctaggcattgattcattggacaaattgttcccacagtccctctgtgtgttaggtgtgtggaaatgctgtgaacaggcagatagggttcccttccctttatggagctgacatcctagtaccatgagatagaccacatgctggtaagccagtgcatgaccagaacagctcatcatcatgaagtataaaaaggctgtgagctgagtaactctagtgggagtggaggaacttgactgaggtccatggatgctgcagccactgctaccgcagctagctctttagggaatactgctcacttgatggctgtcagcccaaacatcaaaagcttggtttgaagatgggcacagatcctgattgacatggtaaggttttcctcagtcagtggtcatcacaagcagtgtgggagaccacagatgcttatgggtgggtgtgcctccctctaattcctcagactctgtcttagtcagggttctctagagtcacacaacttacagaatatctctatatattaagggaatttattgtgatgacttacagtctgtagtccaactaacccaacaaggggcagctgtgaatgggaagtccaagaatctagtagttgctcagttccatgaggctaggtgttacggctggtcttctgtagaagtagcttccaatagatgtgctggcaggtaaatgcaagcagtcaaaggaagaatcttcttcttccaatgccgttatgtaggcctccagcagaagttgtggcccagattagagatgtgtaccaccatgcctggatcgaaaatttgctttgtcctaggctgaccttgaactcaaagatctgcttgccttagtctcctgaaattaaaggttgtcttagtcagggtttctactcctgcacaaatgtcatgaccaagaaacaagttggggaggaaagggtttattcacctttcacttccacattgctgttcatcaccaaaggaagtcgggactggaactcaagcacgtcaggaagcaggagctgatgcagaggccatggagggatggtctttactggcttgcttcccctggcttgttcagcctgctctcttatagaacccaagactcccagcccagggatagcaccacccacaaggggctctcctctcttgatcactaattgagaaaatgccttacagctgaacctcatggaggcattttctcaactgaaactcctttctttgtgataactccagcctgagtcaagttgacataaaactagccagtacaaaggtgtatactaccttgcctgggcctaagattttaatgctcactatgcctcaagatctccatgtcaagatccaggtcagaaacctatcttctagcctcaagatctggatcacaggtgtgccctccatttctggattgtagttcattccagatgtaatcaagttgacaaactagaagtagccatcacagatttttagtgaagcatggctgacaatcagtgatgagcatggcaaggcatgtgccaggctggagggcagagctgaggttaagcttcctttgtttatgctgtcatgcttgcctcctgccagtggagatgcctcctgtgccgcggctagttttctgtgatgtcaaactgtctacatcatgaggtctcaccaggcctggccatgcctgtctagttgtgaataccatcctgatgaagagagtagtccagaaaaatcactgaataactggtgcaacccagtttgaaaatagcatatctgaccctctgtccagctttattgatatcctccgtcccatacatataaggcagccagccccatcacgggagggtctctggagatttttcataactggcaggtccttttttgggggagttcacatgaacttttacaatctttcaataaattcagatctaacctgtgcttatccttcactcagccttttctcaggtgaagtcctcactagctaggtgggcaatataaagaaaatgcctctttgccagtcttgcctgagtcacctgccagtccttgtccctttaagtcaaatgtgagcaggttaggcccacaaaccactcttgcttatttccctcatattaggtaagacaggaaatttccttgtctctttccctgtgaccacgaataccagcaaacctccagagtagcagtgtggacttcggccattctcttacttctggtaaattttcttttattgaacaattctgcctatttctgtgagttcttcccatttccttagaagttcttaaaaaaaaaagttctttgggtgaatattttatatagacaataaaaacaaattatgcgccagggacaaggaatcctactttttaaaattaaaaagttatgaaaagaaatgaatgagcagatgaaaatgagcagtgacaagacagaattcaaatggtgtggaagagaattgaagcgcaaaagggaacccatgtgggtaaagttaggttgaaatggaaatggtggctttcaaagagatactcttgtcaggtctttaaaataaaatatttaaggagctagaaagtagtatgttggaatgttcccaatattataaaatttaaaagctaagagaatatccatgtagtagtatctctttctgtaacattccatgtctggtccatatttgtattgacgtttaagatcttgggtgtgaacagaagaacaaatacagtaaataaaaacaatagtccccgagtatcagagagtgccagcaaagatcaaagattccagtaaggaaagcaaacttcagataaacagaatgccatcaatattctcagtctttcaagtggccttagcatttctgtgttctccacacctgcctctaccttctcaacacatctccaccatccacagagcacctcctcacactggcagctgccttgcctgcttgccagagagctctgagcactggagtgttacatcactgccagctgtagctgtcctggctagttttatgtcaacttgacacaagctagagtcattagggaaaatatatttttcaattgagaaaatgtctgcataagattgcctgtaggcaagtttgtagtaagttttttagtgattgatgtgggaaggttcaggctgtaggtagtgccatccctaggcaggtgatcttggagtgtataatgaagcagactaagcaagccaatacacagcactcctcccaggcctctgtatcagttcttgccttgattcctgctttgggtgatggattgattataagttataaaataaaccctttacttcccgagttatttttggtcattgtgtttgtcacagaattaagagcaacaacagatacagaaattggtacctggaatagagcattgatataacagaatggccatgtttcaggaaggattgtgaaaaactagaagtttgggatggggaagtataaaatactcccttaaagaaatacaagagaacacaggtattcagagcttttagaaacttaaaagataatgctgagagaaatttcagaggaaagttgaagagttgcttaaagactagagggactatttgatattttgtgttagaaaatatggtgtccagttagttggagattaagagtcagctgtaattaataagagacaagcacaacggaagtgaaaccttcactttgtgggttagctggagctgagaaattagcagtgattaagaagagaccagtgccatctaagattgtatatttgggaatatttgtggtccagacagggcagggctgcttctcatgctggcagctaaacttggtaattgtaagagtctctcagctgatactgcttttgaaggcatgaaagggtcatggagagcagctgaaacttagtgcttagagaggccagttacagatgaagctccagaattgacagtcacggagagaagttgaatcttggcatcatgtaacaggcttagagtcccttacaagaacccacaaggaactattggtgaaaatactacccaattgcagcagagacccccaacattttggagataacagtaccatggtacaaccgaggtacaaagatgacagcagtcctggggtggagctagcctgagtgtactgtggatggcagagctagagaaatggaggtacaccaaggatattggtggcccagaggatcctgagtcagtctcaaacactgataggcacactattcacactgttgaagattgtaactgccctgtttcttcactcttgaaataagaaggtatttaactttttttttaatcatacgggattccacaatttaagagactgaaattttagagattttggagttttggagagactttggagttttaagagagattttagatattttaaagagactacagatattttagagatgcttgaactttaaaagactggatattttaagagactgaactttaaagtatttgttttaaagtatttgtcttgttcttcttttgttttatttttggcatggcctcgctatgtagctctggctgtcctgaaacacactatgtagaccaggctagcctcacattcacagagaccccacctgcctcttcctccaatgtgctaggattaaaagcatgtgccactatgcctggttaaatattaagaatttggaggtgaggaggacacaacatctctcccaacactgggagtaactggaaccaatgggacccaggcacacaggaactccaccagatcagtggcacaagttccttccagtctgggccagtgccctgagcagatcttttgcgcaaactccgaagccagtcctataacacccagaggaaggtccgctcccaggcgctttaatacacccaggatcccaggagcttggtcataccaggatctcagggtctcagaggtagcttgactcccaggagctctgacacacccaggatctcagaatcaaagaattacaggatcactgagacagcttgactctgaggagttctgacacaaccaggatcacaggaaggacaaactccagtcagataaagccagggcaggtagcactagagataaccagatggtgggaggcaagcataagaacatgagcaacagaaaccaaggttacttggcatcatcagaacccaattctcccaccatagcaagtcctggatataccatcataccagaaaagcaagattcagatctaaaatcacttctcatgatgatgatagaggactttaagaagaacataaataactcccttaaaaaatacaggagaacacaggtaaacaactagaagtccttaaaaaggaaacacaaaaatcccttaaagaattacaggaaaacacaatcaaacgggctcaggaagtgaacaaaaccatccaggatctaaaaatggaactagaaacaataaagaaatcacaaagtagacaactctggagttagaaaacctaggaaagagatcaggagtcatagatgcaagcatcaccaacagaatacaagagatagaagagagaatctcaggtgcagaaggtaccatagaaaacattgacacaacagtcaaagaagatgcaaaaagctcctaacccaaaacacccagaaaatccaggatacaatgagaagaccaaactaaggataatagggatagaagagagtgaagattctcaacttaaagggccagtagatctcttcaacaaaattatagaagaaaacttccctaacctaaagaaagatgcccatgaacatacaagaagcctacagaactccaaatagactggaccagaaaagaaattcctcgtgtcacataataatcaaaacaccaaatgcactaaacaaagagagaattttaaaagcagtagggaagaaaggtcaagtaacatataaaggcagacctatcagaattacaccagacttctcaccagagactatgaaagctagaagatcctgggcatatgtcatacagaccctaagagaacacaaatgccagcccagactactatacccagcaaaactctcaaatatgatagacagagaaaaaaagatattccatgacaaaaccaaatttacacagtatctttccacaagtccagccctacaaagaataatagatggaaaacaccagtacaaggagcaaaactataccctagaaaaagcaagaaagtaatcattcaacaagcctacataaacataattccacctctaacaacaaaaataacagaaagtaaaatcacttttccttaatatctcttaatatgaaaattaatattatcaacatatcctaatcgactaaaattaaaaaatatgaggaattagaaatttgttggatgccatccagtgatcgctctaatttggtaattggagaaataggtccaatagtgtacaacccatatacactttctgcttgtttgtacatgacaaggtcttgctgcataccacataatgatcttgaaatcatgcttctcctatctcagcctctcttattagtaggattgtttatttgatgtttttacactatactatggttttcaaaacagcttacatatctcaaaattatttatacagccaaaaaaactgtagacaattaatttgggaggtggcttgtaagagaacaacaaagggtgagactgaatgttttgcttgatatttataattattgtatcaattttgaagaagaggaccttataagttactctttttctgagatgaatacttttcaaaatcatcacagccaatgaaccagaatcttaccctcacctcatgtctatgccaccctccaagcagaatcatggttcattgaaacagttgatgaatggcttcatggatagaccatcttaatacacacaccatttcttaaatgaatgtaacctgttccctgtgggcggagaatgatgacaatcactcaagtccaatagctttgaccatagcaggaaatctgtacccaaataatcgtgcctacaattcattccttggcgcagcagaactgtcaactcttagcttagctactatggaggtaaaatcctttggtgatgtgagagacattgaagtacagccttattacaatgaactccagtgtctaaaaattgttcttattttgggtttgtaccacagtaaaagccaagattttaaagctctactaaaaataaaaataatcaaaccaacaaacaaaaagacattatgttcatttaataacagccaagatttacctgggggctggagagatggctcagcggttaagagcactgattgctttcccgaaggtcctgagttcaaatcccagcaaccatatggtggctcacaaccatctgtaatgaaattggatgccctcttctggtgcatctgaagatagctacagtgtacttacatataataaataaataaatcttaaaaaaaaaagatttacctggaagcaagtctatagtgtatgttcttaattagtgaatggaaagattcagccattgtgggtagagtcatccctgggctggtggtcctgagtgctataagaaagcaggctagcaagccataatgagcaaaccagtaagcagtactcctccatggcctctacatcagctcttgcctgcctttctgtcctgactttcctggacaatgggctgcaacctgtaagaagtagtaaacacttgcctccctaagttgcttttggtcatagtgttctgtcacagatacagaaaccctaataagcaagtggtcctcagccaaggactgatgctgcaggataatgatcccctagcttcttatctcagatagagaaaactttaaggcaccatctctccttgagcagcactgtgtgaaacagacaatgagtcacatatggaattttacattttctactagccacattaaaaagaatcctagggctggggagatggctcagtcagtaatgtatttgatatgcaaaaatgaggactgaggtcagatttccagtacccatgtaagaagccagatgagcacagcagggcatacctataatcctagctctgagaggtagagacaggatgattccagggctttttggctaactagtcttgccaaatcactgaagtccaagttaagtgagagattctgtctcaaaacataaggtagagagcaacagaggaaggcattcaatgttaacctctggactgcacatgtccaccacacacatatatatgtaacacggagattttaacatgtaatcagtgtaagaaattatcagtgagatgtgtgtgtgtcaattgtactaagtcttccagaaacactgaatgcacacattacacctatacagcccccattcgactgtccccatttcagctgtttagtaggcatatgtggtcaaagtggccagcaagatgagcaacacagttccatccagctgtccctttataggactatgcttgaacctgaagcctcactcagtttcctgctgctactccaccccttgttgggcttggagagcatgttgtcagtcttttgcatgcaagtttgatctttgtaatggaaagaaatctcaagtgttgagaagaaaatgcacctcttgttttgaagctctgccttatttatttatttatttatttattcattgttttatcgctaaagtaacaacaaactctggtgacactgagcctcggggacaaagcagactcagagaacttcttgctgtgcaagcatgaggacccaagagcacacatgcagcatccattacagtatgtgcctataatcccagtactgggaaggcagagatgggaggatctttggatcttcctagccatccagtgtaggcattcagtgagctccagactcagtaagagaccctgtcttgaagcatacaatgtagggactggagagatggatcagcagttaagagcgcttactgttttttcagagaacctgggtttggttcccagcatccaggacatggtggctcacaaatgcagtcaccagtcatacacatggtgcccatatctacatgcaggaaatcagtcatgcacataaataactctttaaagaggtggtatagagcaactgaggaagtacctgatgtcaacctctagcctccacacagtcctgtacacatacgaatgcatacacatacatgccacatgcacgcacacacgcacaagaactgttcatgtaccagaatagctctttatcttttgccacaggcgagaggcttgagcctttgtgtctacttagctgctgtaagattaacaggggaggctagcggacttgacggtcagttgtacagcaggtagcttctctagcccagaaaaggtgatgggagagctggatcatcccttacaaagaaggaacaccagagggtcttagcaagagaatggtcaaagggaccggaggggcacagtggatgtggattgcttctgcattaggcatagctctagaatgactttaaaaaaaaaaaaaaaagcatgtctcagtctgggaccttgtactggctggttttgtttgtcaacttgacacaagctggagttatcacagagaaaggagcctcccttgatgaaatgcctccatgagatccagctgtaaggcattttctcaattagtgatcaaggagggagagcccagcccatggtgggtggtgccatccctgggctggtggttctgggttctttaagaaggcaggctgaacaagccagggaaagcaaccaattaagcagcatccctccatggcctctgcatcaactcctgctccaggttcctgccctgtgtgagttccagttctgacttcctttggtgatgaacagcaatgtggaaatataagatgaataaaccttttcctccccaacttgcttcttggtcatgatgttttgtgcaggaatagaaaccctaactaagacagatcttcttagcagtttctggagcagctcagagtggacaatgcctatctgattccaaatacccaaaggcacatagctccctgtgtagacctctcacaagtgacactgcccagaccctctagctctccagcctgctccctcatcacagtttttccaggaaaattcagttaaaaagcacctcttgaccaaatgctattaaagattgcttttttttttttcgaagagactaagaaaatggtttattttgaaccaaatatgagtgaccatagccccagaacaaggcttcaaggtacctgagtgatgagttctcgctccttctttttatttttccatttcccagtaattggactcagttgtcttttacttgaggttgagctgagtgaagatgctactaattgaaatcattccagtcagagagaacatggctgctgccttcctagcagaccagcccctccttcccagaacatcctgtcccacttccctctgggtgctgtatgaagaagaacaggcacatctcaggagtgcccttctcagtgtgtattgttatgcacaatccatttgccaagtcaacaggcttgtgctgcttacatactagatgctgttactcctgaagagggcttcggttccttgtgtctctagttctgttgtcagtcttgagcccttttatggctattcatggcttcaaaactttttaagattaatttaattcatatatacaaatgtttttcctgaatatatgtctgtgcaccatttgtgtgcctgattcagaagagggcactagatttcctaaagtgacaaatggttgtgagccaccatgtgggtgctaggaatagaacccaggtcctctgcaagagtagtgagtgctcttaaccactgagccatttctctattcctcatggctgtttaaacttgacatcagatgaaccaagagtactgctggacaacaggagtggtggcattagaccccaccattgctagtctcataaagcactgtagacatggctttccttcctcagtcagtattgccttttgcataagtgagctggtgattttttttagatataaagtgttcatttccataacaaaatactgttgactgggtcactttataaaagaaatgtggtttattttggttctcagttccaatctgtggtgctctgaataggtatgacccttatagaatcatgtctttgaatgtttggcccatagggagtagcattattaggaggtgagaccatattggaagaagtgtatcattgtaggagcaagccttaaggcctcctatgctcaagctccacccagtgtggaacacaatccccttctgctgccttcagatcaatatgtagaactgtcaaccctttctccagcaccatttctgcctggatactgccatgcttcctgccatgatgataatggactaaacttctgaaactgtaagccattcccagttaaatgttttcttttataaaagttgtcatgcctggcggtggtggcccacgcctttaatcctagcactcgggaggcagaggcaggcaggtttctgagttcgaggccagcctggtctacagagtgagttccaagacagccagggctacacagagaaaccctgtctcaaaaaacaaaaacaaacaaacaaacaaacaaacaacaacagcaacaattgtcatggctatggtatctcttcaccgcaatgggaatgctaagacagaagttggtaccagggactggggtattgttttgatagccctaaccatgcttttgtttggaggaatgtggattttcaaactttaaattaggaaaataatggaatgttttaagtgtggttgaaagggccatactagtaggaagatgaaagacagtggtgctgtgaacttcgcagggctggcttaataggtttcagaggaaaggactctgagtatgttgcctacagatcattcttgcgatattttggtgaagaatgtggctgcttttgcccttgtccaaaaagtttttcctgaggctaaagtgaagagtttttgattaattgaactggcaaagaaaatttcaaaatagcatacaatatactctgtccatagtaactaatgttttagcaaactgagcaaggaaaaatacaaagtgtgtggctcaaggattaaaggggcatcaggaagtagaatggagccaaattttgtattcaaggagataagcagattaaagatattaaatgaaattaaggaagcggtgacctcagggcaagatgtcacccagctaagctttcatcttgtgaaaggggattaaagaaaagtttagatccaggagtggtgactttactcccagcagacggagcttttaaccctagcattcaggagacagaggcatgcagatctctgagttcaaggtcagccttgtctacagagaaagttccaaaacagccaagcttagtcagtgaaggaaaccaccaaaaccaggaagctggtgaagatgtaattgaacaagagggccatgttgcagtcccagcaagcagaactcggcagctttggtcaccaagttctcgctttcgagtcaagaataggagaaaggggttatgaaatctccctctacaactaaagaaagccactggggccaggtgtgcggcaaggtgtccctgaatggaggtccagagaggccatcatatgaagctggaaagcctggattactttggagaccccaagatgttagcgatgccagagctttggtatacttgccaaaacagtgattaacaggggagtagaaacaaccaagagaaagaagtgtgctcagcccacaaagaccaaaggagctggagatctgaagagcactttgacaaaagacttggagatgcagagttttgaatttacccagctggttttggccttgctttgatctagtatttcctcactgtgcttccattatgtttcataacggtaatatatatcctgtctcatgatatgttggaaatatatgagctgcttttttattttgattttatagaaaattatcgtttagagattgcatgaatctcagaagagactttgaactttagattcttaaatattgtcgagattgttatagactgtgggaactttttgaagttggtgtaaatgcattttgcattatgttatgactacaagcctatgggaaccagggagtggatatttgaatgtgtgtttgaatatgtatggctcttatagactcatgtttttgaatgatgacccatagggagtggcactattagaaggtatggctttattggagtacttgtggccttgttggaggaagtgtgttactgtggaggcaggctttgaggtctcctatgctcaaactctgcccagtgtgcaacgcagttcctttctgctgcattcagaccaacatatagaactctcagctccttctccagccccatgtctgcctgcgcactgccgtgcttcctgccatgatgataatggactgaacctcagaaactgtaagacatctccaattaaatggtttcctttataagaattatcatggtcatggtgtctcttcacagcaataaaaccctaagacacaattaaagtaggaggggccactattcttttctttctgaaaaaaaatctgagattatgcaggtgtgtgtgtgtgtgtgtgtgtgtgtgtgtgtgtgtacatatctctgagtctgcctctcctatggcaaccacgattcacttatgagggcccagccaacatcagtgacctcatctaatcctaaccacttcccaaaggttctgcctttgcatgcagtagtgtcacagtggggattaaattctttttttgttttgttttgttttgtttttttttgttttttgttttgttttgttttcgagacagagtttctctgtgtagccctggctgtcctggaacgcactttgtagactaggttggcctggaactcaaaaatccgtctgcctctgccttctgagtgctgggattaaaggtgtgcgccaccacgcctggcgggattaaattcttaatactcacagtggggattacatttcagcactgtaccaacccttcaaggacactcagatcatatacaaggcataggaagatccttttgatttatctttaatgggtgatgtgatcacagttgacgtgtgtgtgtgtgtgtgtgtgtgtgtgtgtgtgtgtgtgtgtgtgtacaggtgggtatgtacccaagcagttcctccatacacaggtggctgagaaacatcacaaacagctcatgcggtagcctcgcttggcacctgagggtttactgtgccttgttgtcctcctgaaccttaaggctgtcgtccttaagctgtggtggggctgcccttattgctgagtctcagcaccataaccctctccttctctcagcacagcacctcagcctccaggcccactgatggatccactgaccaaggggtcctgtgggagtcagctggcacaaaccctcctctggaaagcgaagtcatctctctctttcggcatccagccccttcagacttggccaacaaaagatcctgaactagagtcccaggtcaacctgtaagtaagtaaaagaggagtgtcttgctgtggcccttgttcgccgtctcttcacatggggttgggggtgggggccttgggagaacgttccgcttctgagacgtcgtccttacatattcggcagttttcactgggcatctcctttaaccaaaccttgtattgagcatgaggaggagagtagcccgttcctgccttaggggacttatagctcataggcagatagtcccttacgtgtgttgttgcacagttctaagaggctagggaaaagtgccatgaaacaggttgtcttgattcagtaactatttaggaaatatttctgtgtgtctgcagcatccttgtgtagaggagcagttatcttctctacccatccatatcagattgtgtgtggaaagaaaaaataacttcttcaacacggaagaaatactaatgctaactgtaaaatacctgatacatcaggagacttttaagtgctttagggatgtcccatgttttcttgtatgcttctgtgcccaaggcctttgccataggatgtgatatttttagatgaagattgaatggaggtgttacaggaaagggaagcttagctcttcatgggaatcagtgatgtgacagaggaaatacttggttcatccaacacataattgtcaggtttgctgtacccagtgtttgggcagtcaagagcaggtggaagagcatggatcagaatcatccaggaagcctaagaaacaacttaggtctgagatctaccccaagggactctgtgggcctggaagggatgaaaggggacattttcaggtacctgcctccaaggaactcacagcctagctagaggagtaagctataggagaaacatcagaaaatgttgatggggaagtgagtgttgggggatggggaaggatgagctctgcattgtgggaggagctgggtcaggcaggcgatgggcactaaggctactttgaacattgactaatatccagcaaagtgtgtttcagcattgtcaacaggtgataaatcagccattgtcagcctggcctgttatgatagtcacctatggagaatctacacaagtctccactgtctctccaaagttctgatgtctagaattggtcacaagctccaggtgattctcagctgtgagcaacattgagacaatgtaaccaatgagcaacattgtaaccaccatgatgaaaaacggcatagatcaatcctggagcacttgcatgcctagctgaggaatctagacccattgttaggagccattgatagctttgagaatcttcagaggaaatgggaaaggcattatgcagagagaacttcctgattgcctttttcctagtgtatcccaagggtttgagtcaccactgccattcaaagccattcccatatcacccataatttgcctctttggcaattgaagattcattgtcacctcgattgaagtggaactttaagttgtactttaatacataattcacccagggcctcagctaccaacagtgtccaaagaaatagagctgggcctcctaccccccattgttctataagggcagggaatttggcatacaggttgtaggtaatccaagactgtccagcaacagatttcaggcaagttagttagcaagcagggcctgagaggtctcctttgtagactaaagttccacagtgtgccatgcagtaacatataaaggggtgggtcaaagcgattagacagttagaaaactaaatgaagtagccacctaagctggcagccttgaggtaggggttgggggtggaggctggctaatatggtaagggcttatttagtgttgagatgttggctgctatctggtagaccacatggctagtggggtagctggattcccctgggaaagattgagctcagaagtgttttggaggaatgttaggatggacctgaatatgcatgggtggcaagggggtgagcctcagagttctggctctggcatcagggccctaagatgtgacaacacaaaacctaagatagagccaaactgagagcataaggcaagtgctatcaagctgaagaggttaccatgcatatatagacatagggcctacttaggaaagacttggagaatgaggaatggaccttgaaaagcagtgggacccctccccccattttctctcttcagtagatttaaataggcagaggtgtataggggcgcactaggaggtaatgttagcatgggcaaggctcaggcgggatggtcctggagtgtgtttgaggagtgatttgttctggctagcttagttgttcaaaagtaataggaagcctgcaaagtcagagcagggactcactgggagatggtgactgagttttaggagcactgtgaggctctgagtgggtcttgaggagagcaagtgactgtttaaggtgtgtgtgagagagagagaactagtcacatcccaagtgtgttcaaaagtggaagttggaaggctggcaaaagatggacttgagggggctgtcaactagctaaagtcacggaaacctgactcagattagcttaagcaggagaaggggtagaaagcttcatttagccaggctggtgacagcagtgggtctggcttctaacatgacgggatccagggactgcagtgctgttgtcaggatgttggatgtccttgactcttccgcccctgcctccacccctcatctcagctctacctccttacccaagtgttctcacctgacacctgacacgtgacctcaggcagcccagattatctttatagctcaggggagaacatttctccccagttagaagactctgggaaagggctctagttatccagcctgggccacaggttcttcctggtctcccaaggagtgtccctcatcaagggtcaatgtgatagccttggtaagcagagcagccttggagaagaaaaggagtggccaggagaccagaggacaggatgtaactaggtcatgaaagccagtggttgaagagacgtagtatggttcaccacaagcataactggggaggttttgtcaaaaacatagatcatggtatctgtttactgagaattcctagaggtaggagtggggaatctgggtgaaggtgaaaaatgcatcagaagtcttagcagtgagaactggttgactatgttgactaggaagccatgacacatttctgagaagtaaggcatgctgggaatacaggggtgcaactttctgggattcttcactctcccaatctatgactaatcagaccatgaagtaaaatttctttacagaggtgttatagcacaatctatgaggagacaacaaaggaagttgtcagaaggatggctgcacttcctaaaaggatgtcagtcaggagggatgaagttgtacttggacgcccctcctgtttctagctcttgtttgtcaggtagtcttccccactggggtaatggtgcatgcgcatctaagaagtctgtaattcagactcacttctctcccagggctcagtgacagtttacgtttggtcttttgaggaagattaccatgtatttgaaagtttgtcaccaatgcatactacagagcaatggttttgtttttgtttttaatgcaagcattaaaaacaaaaagctttcaaaagcattgaaagactacacatgttcctaatgaaaagccactttatcttaaaatgcagtgctgggtgataagcttttggtttacaattaggtacattctattccccttcttttgtgtttttatgggaaagatgatataggagatgaccctaaactgagtgactggacagagtctagcaatcctgcagtagaggcaggagagagtccgacttatgtgttatgactggggctgctagggagcccattgaacatgacactcaggaattttagactggagagttgatcacatttaaatccttcccactataggaagggactgagctgcttacgagacccctcgagttgccccactctctcttggatctgctggtgggacttgtactttgcctcctgtttccattcggaaaaacctacctgagccttctggaggttggtatagaggcctgtctagctgtcccctgcgggagcttgacggtcatgagacaaccaatagctctcttggccaccaccagagccaccatctgtcctctacacgtgcatctctcccctagggttgatcagagtctgatcttgaggggaagcagaaggagcctgtttggctgtagagcttggcctattttttaccaggaaaacactaacaacaaggaaatttgtgtttatctatccgcctgactcccgtcactccctttctgactgcagtcatggagaagagaaaggccagggtggtttcaagccagctttctccagtgtcttattcaatagacttatctgcattgagtgcctgcacacgcacgtacctactaatatctgtgaggtgacagttaagaggaagcaaagagaccagttgaggggcatcgtaacaatgcaggtctgtgctaaggaaataaagagacacattggaaataacagagggaaggcaagaagctgggagggactgcaaggtccacaggggtatgctgaggcctcatccacactcctaaaacaccagaagccaaggaaccagaggagtggctggataaaataggacgctttgattcagtggagtactgcacagtcgtgataatgcaaagaccaccaaggtacaccaagccaaactccaacaagggtacgaggagggtcgtgtgcacacttatggcttattttccatgggagacacattctaggatacttgggctccttcagacagcaaaatccttgcatgtatgggcatagtttgcttataacttctgtatctcctcccttattcatcatgtcattccaacaccactcatgaactctatataaatgctgtgtaaatgtgtgctgtgttgtttagagaatgagaaaggggtctttctatgttcagtactgatgctgagaccatttggggcaggaatcatagatattttcagcctacatttggttgaatccacagatgtgaacctgtgcgtgcagaggctggttgtagtgtgctgctgtttgtgttaagggaaggaaatagtgggctggcagatggtttagtgggaaaagcacttgccacacaagtgtagttcagaggtaagcatggtggcttgcctacaaccccatactcatgaagtggaaacagaagattactggaacaaactggctaaaatggccaaactggtgagctctgggttcaactgagaggccttccctcgatatataatatggagagcggttgaagaagatatctgatgtcaacctctggcccccacaggcatgctcacacacatgtgctcacatgtgtgcacgcacccacacacatgtgaacttgtacattacatgtaccacacatgcacacacgtgcagaaaagaggtggaaagacaggtggaattgctcagtgagtaaagcttttgatgtgcaagccttgtagcacatggatcccagcctggacccatcccaatccacagagttttgcctggcttcacacgttgccccctcaaacacaccgaacattcaccccctgatgcattagaaggaagtagaagaaggtggatttgtatttctcttctttgtgaatatggacggcagcatgtctagcaataagatgagaagccatccatgttgctgtgcacagggcaagcggggcaggagaaggggtttcccgattgtgtctgtgtgatgctgagatttgaaggaggcacactgcccctttgaagaacacgatccacatacacagatactgccacatggttttgaaaagctgttgctgtggaggggactagctagatactaagaggaaaggagagacctcagatggcaggacagaggtggcagtctggctcatgagatcacgacagagtctgattcaggggggctgctagggtatgtgttgaactgtatttagcagtttgcagatggaaagatctaagctaggttttgctgtgaggagttctattagcgctgaggtcatatttgtagactcaggggtgatgaagtgcccagggagggaggggggannnnnnnnnnnnnnnnnnnntgaagggggaaggcaaagtcactgacatggagttaaagatgctgctgactgaagcccacagagaggactcagttctgctttgtgtgacctaaaaacaggcaagaagatggccttgctttctgtgaggacagcctggcccctttctggatgcccagagttcaggattgagctctgcagcccctgcaggaataactgccaaaagctaccatttctccctaaggaggttataccactgctaagaatggctctcctttgactattcaagtctcgcccttttcagttttatactccataaggaccagaaacccacttggggtgctcgtcagtacagaaccagaacaccgtaaggacacagtgtgaaggctgatctcacagtagtgtgccctttatgtcagtggctccacccaaaattcacctccacagcactcacttctgtaaatcctgctctgaccttagggagtggctggctctttcttgttatctcttagagtaatgcatgttcttagttctaatacttctgcctcctgtatttctgtgtgatcagcttatctgtttactctgaagagcatcctctcttctctcaaacaccctgtgctgtgagcttcagagtttcattgtcttcggagtccctgagtcagagcagcttagagagcaagcatcatggaaagcattttaggctcatgatgtgacctgtaaaagcaccaagagccacttccccacagtgtgctctgggtgtgcctggagggaaactgcatgtagatcagcatggagtggatctaatccagtctacacactctaaatgcaatacccaaaccattttaaaaggtagtccggggccatctctctcctccattactcaaggcaagcttcatgtcagttcaacaacttatcttttgtttgagactacatttttgacatattggtattgactacaaagggatcacaatacactactctggcataaggaatattttgagctgaaagtaactgagaaaaaaaaaaacacaggaagctctctcccttcctttgctgaaagcagggtcttcatctcctctccccgtgtgacatgacccctcttctctcctgaaccaagaggacagctgttttcaaatggagactgaaggcatctgatgagtctgcttaaacaagcctcaccacagagccgtgcccaccgccagcttctacatgctcaccagagcccaccgtggaaatgtcaaatctctctcgctttggctcctccccacactatgttaaaagtgataagaagccgggcgtggtggcgcacgcctttaataccagcactcgggaggcagaggcaggcggatttctgagttcgaggccagcctggtctacaaagtgagctccaggacagccagggctacacagagaaaccctgtctcgaaaaaccaaaaaaaaaaaaaaaaaaaaaaaaaaagtgataagaggtgcccagatctaattgtttctttgatctttcttcctttcctttcttcaagcctccatctgtataaaattaaaagtggctgtctttgcctcgtctaatcccattactctgtctttgccagttcaatgtgcaggcatcagggagcgagcataaggagtgaggaaggaaattttcctccctgacacctaggaacgttctcaaagtgaccatctctatataaatgtagctttctcctacattttccacaaaccatggcaccatcataagtcctttcatgcgcctcctctcattaaattcaacgggaggtactgtgaccagcactgctgaattagctcattaatcaaatcctgtcgtcattactgatgcccatgaagtggctgtttcttgccaaaggtcgtggcattagttacttgtggacttgacagagataagtaattatcaggcaacctttatgagtatataacttctctaaatgtatacatattagtgcatctaagtcttgtttctaagtctttgtttgcatgactttagatttttcattaaactataatttatatgcatgaaatccaagaacaccctcaccccaccccaccccaccccaagtcagggtttgtctgtgtagccctggctggtctgaaactcgctctgtagaccaagctggccctctaactcagagatccatctacttctgtctcctgagtgctggaactaaaggtgtgcgccaccattgcccaggaaaaacgcaggatcctaaagcagttcagttggggtcattttgatggttgcaggttattgagtttctagcgttgtgtcaatcagcctcaggtgcattgcctcttaggaaagccaccagtcccaacaccaactttggtgaagtgacatttagccactgtgattgctcacactgccttttctttgttcatttacactactggtctggtattaacatctgaaacgctttgttttgattaaccttaggcacttatagtatttttatgtctgattcaaaaacagatttcatgtttacactgtgtaactgagcacacttcagcaatctgtggtgtcatgagcacaggggtgagctctctgggcctgaccctagagagagctctgaatggtctttgggtctgtcctgccccatccttagtcatttctgcagtgtggctgacctatctccagggttactcccaacttcccatgcaggagaaacctccagggcatggcagctctcatgtatgagaaagaatgccacagaagtgaccttaatttgttttgtggaaccccaaagcactggcggtcctgcatgcacacattcactcattgacctacccaaccattattaaaacaaacaagcaagcaaacaagacaaaacaaaatgctataaagggataagcctgccaggtttatgtcaaacaccaaggatccagcctcaaacagaagcaacaagataaaattctggtgaagagacagatgttaatcaaacccctctttgtaatttctagcctagggaaagggggtatgaagaagacaaagtttggagaggacactctaggtcctaaggcaagaagaaattcagcaagttgaagacagggaggaaggctgtgtggctggagggttggagggagaggggagcagagccagactagacaggtggctgggggcgtcagtgatggcgaggaagtttaggaaaaatgaaagggtgtagatttaggaccagctggcggaaattaagctgcattgcatttcaacttgatatagagaaaacctgtttaaccggaagaatagagacccttggggcagaatgtgggcaaggagagccttttgaagtagctggtaagggacactcagtcacagatactgggttggacgccagatggtgcctaagtctgtggacctgggagtctccagaattctccctctgtcccccccacatacacccaaggaaaggagacagagtggggtggtttgtggggttttatagaggaagtgccttgtgctggcatccggtgggtgaaaagggagcctgtcagcgatgcgcgggctgtaatagcatcgtggatggaatatatttttgttaaagttgcaggtgcgtagatcccactcttgaagctgcatatcaaggagttggcagtgcaaagtgggcatttctatatttaggcaaaaatactcttagagcaaactttaaaacttttgcagggaaagagtgagaccgcatattgtggtggtacattttatatgtcagaaaaattaagaccataatggaagagattaaaaatgtctaggtgccacagacactctgggtccctggtctgtgaagaacgggatttcttaggcagatggacaaagagtttggatgaaaatgacagacagatacacgaaagatgtgttgaatctgaatgtaatgttctggttgagcttcagacttatattacaacgaattatcagaggatacaaatcacaaaaagacaagatacactgaaattcaccagttacagcagaaaggaatttacagggactaattaaatgtttacattagggataacaagccctgcctaggatcagcctaatgccaggcaagaatttcacactttaaggttaaaagcatcagggggttgttaactcttgacaggccttaagagtaatgtgctatcacagagctctaaattcttaggtctaataaaacttatcttgtctggagagtttccccttatcagggtagtatatcaacttatacttgacatggaatgaagcctgtagtaaaagatttctatctcagtgagacttttagtctctatctgtaaacagctgagtaaaatggcaagtgcttaattgtttactgaatgggttaagctccttgctgctatctggaatctaagaacactggaaaagggctttagctatgttagaatacaatcttaaaaggcatttactataaggtaatactatatagagtgcacgtggatctatacactagactaatgtgggtttggaaaattaattttatgggttagggaaatagccaaagatccaggagtaagtttccttgaaactttttcctcatgagaaagctttcagactttcatctgtcaagctgactccaccggagtccctggcatctaggttcacttttgagatttttttcaacctgattaatgaagataccaagcacaaatgaaatgattttacttggcttacatgtccaggtcatagtccatcagtgagggacatcagggaaggaacctggaggcaggaaccaaagcagaacccatggaatgctgtgctgttgactggcttgctcactgaatgctcagccatctttctcacacagcccaggccctggtgattgtgctgcccatgtcaggctagcccttccctcatcagttaccaatgaaaacagcctctcacaggcatggccacaggccagtctcactgagataatctttagttgaggtttccccttcccaggtgactctgaattgtgtcaaattgacagtaaaaactaaccaagacagaggtatttcctcaaagattcaggcagttaaaggaggtggttagcaacatagttgtttggctgattatagtttttatattaacacttggtcatagagtttgtagatgccagagtggaacaatgaatgtttcttccaaaaatattatactctgagccaaaagacctccctccggtctcgacctcttgtaagccaacattgtcattgaaaagttgggtctgctagtggcaggcacttggaaagcatctttggaagtcctatgggctgtagactttgagcatgtgtgtgtgtgagtgtgtgtgtgtgtgtgtgtgtgtgtgtgtgtggtatgtatgtgcacgtgggtgtggatgcccaatataagatgtcttcctctgatggtggtggttgtctttttttttttttaaggcagggtctctcactaaacctggctggccagtgagctctgggaatccacctgtctctatccttgcagtgctgggttacagatgtgtgcctctgtgctaggttttcatgtgggtgaacgtaagttctgttgtgcagcaagcactttacccactcagcatgtgccctccagtatcagatgcagggctttggtttgtttcttttgttgttttgttggtgatgatgatctttttttgagacagggtcttactgtgtaaccttgtctggcctagaccttgctatgtagaccaggctgccctcagactcacagagctcctctgtctcccaagtgctggggttaatagtgtgcaccaccactgacttagatacagttttccttcatttttatttgtgtgtgtatgagagagacagagacagagagacacacagagacacacacacagagacacaaagagagacatacacagagagacagactcctggtcttgaattattgaattccagcattctgcttgcccagcctaccaggaagctagagctatgggcaggtcccactgtacccaatagtttaaactgttttgtcgtataatcaaatttgtactcagttgtgagaactaacacagagaatgctgttggagacatcttgcatgactacggaatacagcatcatatagcatctcaggcaggaaacagagatgggatccactggtcttaagtcgccccagttccacatgcagtttgatctcatgggcaaatgactgtgtccagcaccacagagaagaagcaggatagttccatccctagggtggggctgtcataaccagaaccctgccatttcaaggatgctaagtaaaccaggagtggggttatatacctataaaaccagaactctgtagtggagacaggagaatcaagagttcagtgttttccttagctacatagtgagttcaagatatatgaggcactgtaacaaacaaagaaaaatgttatataagtagaattgtattgagtgaaacctttgggagtggctaaatccactcaccacagctcccctaaagagtcatccacattgttgtgcatagtggttttagtcagttacttggtaagtagtattccaaggttggatatgttgccgtttgttttattctttgcccctaggaaaacatctggattgtttctagtttgaggctattattaataagcataaactgaatgtgtttcagacaggtttttgtgggtgtaatattttcgttcttctggaataaatgccccatggtgtaattgcaggatcgtatggtaactgtgtagtttaatcagaaatggcctctctgcaatgagcaagtgtggaagcttcttcacaccttctgcattatttgtggtggtcatcgcttttcattccagagaagcagttttagactggtagagattgttagtgaagagaactgtgcagtgatttatcacaggactctttatgctaaggaaccatgtaggctctgggtatatggccttcctcaaaacttagtggatacataaatattatgtgaagaatgtatttcaaagtgtttaaagaaaaaaaaaaagaggactagcagactggggagatggctcagcagttaagagcatagtctgctcttctagaggaccagagttcaattcccagcacccacctggcaactcacgattatctataacttgagtccagaggaccccatgccgtcttctaacctcttagggaatgcacacatgtgatacacatacatgtatgtgtaaaaacacccaagcacgttaaagataaaaattaaataatcaaagggccctgatttgggggatgcattcactccagaaacctccctccttggttcctacttcctgatttcctccatgccttcactagaagtcttatatgtcatcattagaattaatgtacaatcacatctctgcttttctgtctcttgatatattttagaaagcaagacaactggtctcttgtataccatgctattttggtacctgttgttaggaaaccctggattccttccaagcctcagtctgtagtctggcaccattaaaaagttgatttggccttcagtgggggatcctttccatctgtgtcctgctgtgtgcttgtcagggggctaaggcctgtgttggcactcacattgaactctcctactggagaacttaagaaaactgcatggtgtttctcacaaagtctcttcactgaccagagagagcatttattgatgctgttggttttaaacattaactgggtctgagacccaatgggagcctggccgcatgggtctggccagttgagaggggtggcaccgatctcagggccagcggggtgggaaccacctgtctccccttgtcttcttactcagtcttagcagctcttgactcggcagaggacctgctcctgctttccaggaatcagacttacataatagcagctgctctagcctgtgtgtagagcggaaggctttgattccatcccaggccatatgtagagacttagcatggaggtcctccacactgttcgagcttccaaagtgagagccagcatccttccacaccacttttcagaaacagaaggctttctatttagagcctggacagcacggtacatagggagttggaagtttcctgcttcctgtctgcacctgcctcgctctggtggcccactgcaccagcctcacttgtcttttctcctgtcatggcagcagtaggtctggagtagtttctaactgaagtaccctgctaggccaacactcttaaggagaagatgggtgccagcattggtacgtgccctcagtctggtcccaggaagcccactgcttggaccaggctctctcttgctgatacatgagggaagaaggagtttatttaaaagtctttttaaaggttaattatttatggcaaattcctcttcttggctctctctaaaaacctgagagaaactgagattaataattgaggcaataataatagcaaacactcagatgagctttcatagtgtaacttagcatattggctgcttttccttatggattctttgtaattctcttaaatggaatatctttacccacaattcaaagatgagggaactgatgtccagagaggctaggagcccagggctgtggctgcagcagtgcttggagggaaaacacccacttcctcccatcgacaggagcctaggcctggtacttcttttttttttttttttttttttttttgagacagggtttctctgtgtagccctggctgtcctggaactcactctgtagaccaggctggcctcaaactcagaaatctgcctgcctctgcctcccaagtgctgggattaaaggtgtgcgtcaccacttccccgggtggcttggtgcttccttgtggatatactatagcatggttgccaggttttccagggattccagaagcaccgagagattaatttttcaaagtatcacctgtgaccacctgcagtggaacctccaggctgcttgcttggctggcagatgggctgaacacgattctctgtgttcagagacctggtctctgggactaggaccaggaaatctgcattgttacagagctctccaggggaatcagagtgagtgttttatgggaattaaggccctgaaaccaactgtagggattcatgagaccactacaggggatggcagtgtggtttttgtttgttttcttttgagagccatttagtaaagaacttgagctttataagccatcagggtttctgttggaactactcaagtccactgttgaaatgccaaagcagatggacagtccataatctgtaggtgtggctgtgttccaagaaaactgctttcaaagcagacagtggattgctgtcctgatgtagagtcatcctggtctgggcttcttctgcgtcccctctacagaagttacattacacctcttgctgactacagagcttactcatggtaggaactgggtatgaatcctattgcttaggttgtagtggggcattcaaagcagctatgtaagaaagcctctcctctccaaggcattcagcatgaaacgttacttattatggtgagcctaatggtataggcctgttatccagatattttggaagctgagggaggaggatccaagttcaaaaccagcctccgtaacttagaaaagtgctgctttctattccaaaatagagttatattgcatgctagggatatagctcagtggtagagcactgtacttctatctttacttaaatccattgttctagcttgcctttctgtagctaaggggggaaaaaaaaccactaaaaccacaagcaaattaagggaggaaagggcttatttcagcttacaattccaggtgatggtctatggttgagggaagtcaatacaggaactcaaacagatcaggaacttgaagcagaaatagaggagtgccgcttgctagcttgctaacttgctcatggctgaccctcagctagctggcttatacagcccaggcttcctatgggtggtgcctcctggtctaccttctagattactgtagatctcacttttgccaaatattttgctgtgtgtaaggcagatcactgcctttctagcccccaagattagattcttatttctgtctgtccccttaatctgggccacatagtgcatgattgtggttatagcacccaacataagacactttggtaaatgtgcctttcattccacttctgatgccatccatacaggcacatggaatcctagattctttatcttgaagttcttccctactgcaggccttaagagtctcctgtcccactattccagggaggctactgcacactgcttcttccagggcatgggtcttcaagcagtgtatgccacttctgtcctttcctgtcttgaccagagctagatcacatggtctcatcacaagaaaaagcaaatgtagtccaacagtgagtccagaaaaggaagtaggtttgtgaatctagtacacacagcaatgtctaccttgtaggccaggccttcttaaatggagagactgaaaagaccaatcagcaagaaaggcaccaggcaacctgtcctagtacatatagggaatgctgtcaggcactaggtaggaagatctgtctgatgtgtatatacatcatgaatgcatgcttattgcatatccaccttgggccaggcagtaggtggaacaatgcaggttctttgtagagctttggatgaccactgctactgggaacccttgtatggacaccgggggagggagggatttttgacatagatactttgatgcctcttacagtgcatgatctgtgcctaggcctggttcttaccatgagcaagctcatgcaggtggaacgtgattagagggagggaagggtagcagagagcaggcgttctatagctgtggcttccttggttgttttcatgggacgctgttgcccctctaagagacatctagggaaggtagatagtctagggtgacatagaatgggactgagagctgtcatctttgccatgtttgctgtttacaaagataaggagctggccccatgtctagaaccccttgagtgatcctgaagatggcccagggagaggctcaggacccctatctctgctttcttcgtgttaggagttgttgagtctcacctgctgctgaggttgattccatcatggtcctaactgaaaccacagctggggctgcagtctgggcagagcatttgttctgcctggactttgctgtgcagagacccacatctcaagaacatctgctgtcccctggtgacccagccttacaggaaaggacctcggaaccaaaatgcaggacaacaacagtgcctccaagggtgttttctgaccagagaggccagactagaatagaccacagagtacagttgtgttagtctctcttaaagattttttgtttgtgtattttgagtgaggggtataaatcatgtccatccaagcaggaaggtagcctaggcacccccttccagactgttttcattgctatgccacacactttaagctaaaagagtgagggcgagaaaaggttaaatttctcatataagattaattcagccatttctgtgaaatggtggaggcagaataccattagactctaatctcatttctctcatgctgtctttcttggagcctatcaaacagtgtcctggcagagagtcagctctgtggatgctgaacatcagagtcggtctcttgctgaatgtgccaggagggctgtaatttagaaaatgtagctaccttgtaaggaaggatgaaaaggtaccgagtgcacctgtctctgcatgcgacagtccgaccagttggaattggtgaaacgtgattcttgcagaatcttattttctgttgtattagagctgtttgcatgacatggtcaagccaaacttacaaaaactgttggtactggggggctgtctgtctgtgggcttcatggctactgtgttagagtcctaggtagactgagtagccaattagatatgtgcctttggagaagggagctatgcatgcagtgcaaacgcagtagcaatttgcatccttgttttaattgctcttggaccatggcatgtgagtttgcttatctgatttaagcctgtttgggtggggatggaggggagggtgggaagtattagttgttgccatgtcaaaattaaatatactcagatgttagatttttatattttatgctagtctttctctctctctctctctctctctctctctctctctctctctctctctctctctccacctccccctatgttaacatgtaaaaattttaaattaaaagctgggggaagggagggggcctatgaggatttgggaatttttttctcctccttaaaatacagctttaaatgatgctggttatttttatgttgcatatttgggacaaagagactctactcttttaagcaaaggataattgcaagatctggttcagcagctttgtcccttgcctcaagttcctgcagggctgccatccccttcggtaataccgagtgaaatcacaagccgccaatagctttgggaatttcaattgattccaaatgagctaaatatttaagtcagtcattacctgtacttctagggatgacttgggcattttccttttgactgagggcttcatgaaagcctgattctgcaatggctgctggggacggtgtttgttgcaaggatgctcccctgcagtgaggcgccggagcactgcaaacctgtttcatagcagccgtttctttttctttttctctttctttctttctttctttctttctttctttctttctttctttctttctttttttccttccttccttccttccttccttttttttttctttctcagaaggtgtgtagccagatcgctatgtataatactgatgaagcatttttgttccagctctgtctcagaagacctaggctgtagacgtggggatttcagtaggaagcattatggatctgtggagctggtaagtcaatgctgcctgttcagtagtggtcactggttcagacttagaggccattgccaagcttagcaagcctttgttgtatatttcctaaaagactctgcggtgttgaggtttaatttaagtcagtgatgctgaaaggttatggtcatttggtcacctttatttctttacattgccattgcttttaatctcgtgtctttcagtttgttaaaaatatgttgtgccttggtatttttctctattaaccagtgcatagaatgaaataatttgtaaatgaagaaaggtagcatttcatgtttatgttatcttgttcctgaaagtttacagaaagtgtaatgactgttgacattctgattctatctttgctttctgggtgtgggacaggagttagaacatgtgaggtatattcctattataagcctattagttggaccagatcagtaactgtgacagatgataaatgtctaaaataaaaatatctaattttttataacatgagacattagagtttgtgataatgatttttagagtatatattcctcatgaaagaggggaaataaaatgaaagcattgatagactcaggggtttttttgttgttgttgtttttgtttttgtttttttcgagacagggtttctctgtgtagccctggctgtcctggaactcactttgtagaccaggctagccttgaactcagaaatttgcctgtctctgcctcccaagtgctgggattaaaggcgtgcgccaccacacccgacttagactcaggttttatgataggattgtgatttggttttccaattgcatgggatctgaaccaatttcagaaattgtgcttataagctgcactagttattattggtcattaactccattattctgttgattaaagatgagttgtttctgtccacttgcttagtagccaggttcccactgttgatacaagctgcacctttacagctttagcaggagagcagctgtacctgagtggagtgctagtggccctctgtttgactggactctgtgcctgacccagggctaaagcatcttgcaagtataaaataagtgaagggtttggtccctattcttaggggtttcctgtccttcagctgagcagattcgacgcatcatctaaagattgagtatagccacatcaaagatccatcagttgatttagtgcctgttctgtaagttattgttaaccctgtatgcactaactcagactactgcctctcctcaaggagcccgggcaagagtataattcagagtaggaaggcaagtagagatacagaggtaatatggagctaaagaaagggagggagccacccaccctacaagggaacttcagggaggtcattggaaggcctcctgaaggacgaaggacggtaagatatgagagggcagcaaatgatagatagcatagcagacatgatgttccatgagagcagtgaacaaatggccctgcctgggagaggtaaggccacaggaagtagtggtgactcagcgagcaggctttggttcatctctccacaactccacagtcctctgtcaccagtcatcagtaaagtggcatgacttctcaatgtgtgctctgaagtcttgcttatttcatcacttgctactgacaggatcttgaacatctcttgtcctcagttttctcatccacagaatagggatattaatattttctcctatagctttgccatgaggatgagataaaacaatggcacccagcccttagcacatcccatgttaaattaacctcatacagtagtgaagctgaaattcagtagtagaggtagaacgtccatagtcagatgaagaccagactgggtccaagaagtggtcctgagccctcgtgcacagtgagggtggtgcttagggacataccatgggtgtgatggatgaactctgcagacatgtgcaaagcacagaataccagaatggtctttgagagccgcagatgagctgagcagacttcagagtcagcaggaaaactgaattacaaacgcaacaggtctagcattgacccacagtctgagtttctggcaagttcccagactgcctttgatgctgtgggccccagggccacacgtggagagccgcccacctttcacagctgcggagtcacccgtcatccctgactggatgggtgctgatggacagaaagctcctcatccacttgtccatgactttcctctggacctgtgtgtgtgtcctctacagacactataacacttaagcagggctgagaggtggctcagcaattaagagtatttcctagtattaggatccagatttaagttccagtacccatatggtggctcacagtccactgtaactcttgcttcaggggatctgactccctctgctgacctccacagacacagccatacatacagacaaaacagtcacacacataaaaagaaataaatattttaattaacatttaaatatattttgaaattcagtggatagtctcattaccttgtagcaagtgttttcatttctcttcagcccctctgctctttaaagctatacattttactcttacaaattttgcattacccttttcccacttaactgttttgtaagtatcttcttagcatgtcatcttcagagtcaccattttgatttgaatgtggccatccaacttaattacactgtgcctagtttttccataccagaaaggacatccacactgatggttggaatgactgagaaaggtggaatgaacagaaatccaccttcaggacttacgaagcgtgcctcagggtaatacagtgcagttggcatccatcaatgattggcaccaggtctccactggatactaaactccaaggctgttaaagccccttacataaagtagcatctctgcatatatctgccacctaccctccatatactaagtcacccccaggtacttataatgcctagtacagtgtaaataccatagaaccagcagtttgtatgttagaagaaaacatgaaaacagttcacatgtgttcataaaagacagttttcccctaatattttccatgcagttggctagagctcctgatgtgaaatgaccaagtgtgatgacctactgtgtggttaaaaaaaaaaaaacctgatatgttctgtgttcatcaggaaatgagtctaatttttctaaacctgggatgaggaagactgttgggagccacagaactcaggtttcagagaagagtgccaggaagaaattagcataaatgctgcctttaaaaacatagctatagaagtcgtcgggcagagggaagcatggccattcacctcagtaatgggagtagacttagaacttcattccacaggtgtcgttggccataaatttcctaaaaagtccagatctctgtagcctcgggggcagggttctttagccttctctctggttttggaagacctaccatgtagcaggtaccatgttgggttctcagggggagtggagagagaagtcagtctgtcagctgtccgtggtctagcttcaggaggtagctgcctctctgtgtcctgtccccagcctgcaaaccacctggatctcagcggtgccctctatggtacccagagcttgtttccctccaagaatcatgtgggttgagctgcaggcattcagtccggctccactatggagtaacttgcaggatgtgtctgggcaagtctcactggaaaaaagcacggaatacacacagctgggcctccaaggaccggagcgctgtttctcctcaggcctcatcctcccctctccttttctgccccactcttctctctccaaaccagccacctttgttgcacatcacctctccagtcccctttcttttaagagttttatagttacacatccttgattcatttgagttagcttctatatacgtgtgtgtgagtggagagcttttttttttctcttttacatgtgtgtcctgggctttcccagcaccatttgatgaagactgtcctttcctcccttgataggtcagagtacccttcagaagcatcatttggccatgtatgtgagttgatgtgggggctttctcttctaccctatcttcagcagagtggtggtgtaaaatgttgtgaatgtgcagtcctttccttcttgattgcccttgcggttcattttggactgttgattcttatcatccttatgaccctgtgacccttactctattctctctttctagtctcctgcttcttacccgcatgctttgacttctgacctcactggtctctagaacagcctcagcttttccatgctccagagcctctgaacttgccttgtgcaaggacttccctagtgcttctcatggcctcagcttagtaccaccttcccaagctcacctctcccaatccacaccaacacccgcagttccttaactgggcagcagttgacttacccactgcttgcatccattacaagtgagagaggatcaagtctgtcttctttgctattatatttctagagcctgacactagatggtatatactaatttttcataatatttttattattcaacttggtgttattttcccaatctccttggatcacataggttctaactcttaattcccaccatagtctcttcatttcttgaatttgggtttcaaatttcaaatagaaaattatagattcattcctcttagattgagtatatatgagggtagtgggatcatttgatacaagtgagcctctagaaccactccctcaacagagtttgtggagagggcaggcagtctccgaggaggccagcttacacaagagtagtagtgggctgcggagggagctgagcagggagagacttgcacttaagcatccgagtttagatcctttgcacttcacaacagatgtggcagcacacactgttaacctttgccctgggaaacagctacaggtggggcctgagggctcactagccagccagcttagccaattgatgaaacagatgcagtgagacccccatctcaaaaaatcaggtggtaagaagtacgggaagacaccgatgcccacctctggcttccatgcatgcatgcacacgcacactcacacaccagcggaatctgccctggaaacctccacacacacacaaaatggatccacgacattctctcatgcagtaaattgtttaaaagcatttcctgaacctttcttcccctgctagtggactcttagccctgccacttcaattggtcccgtaagtaaggatacagatcagtaagccttgcccagctaggcatcctagctttttgtttgctcacagaaccctgtactaagcacagcagcagcactagtctcagtgatactagttgaagaatgagagttctagcttgagagaaactggggagcagtctaactcatgaaaaacaaaagagaaaccaagcccccttgactatcaccaacacagactcattagcttgctggccatcctgcctcaacagatgccatttttcttcctgatggattgcaagtccagtttctcctggcaaccgtccaaacaaggcatagctagtaccgcatcaaccatctctcatcactttctatggaaatctgtcaggggcggccaaagattgtttgtagcttttattgatctgttcttggcctttgactggatagacaggaaactgatgtggtagaggagataaatggtgtgagcacaatatagacctctgcccagtgcagtccggctgcagactgtcatgcaccactgtctcttgatgctgctgggaagtcaccatctgcaagtgatttcaaatgagcatgagtctgaatattgcccattccttttgcatcatgtcctagcaagtgagctcacactctctgtatgcatgcagctctgctgtgcaggaaagaagcagagagattcttgcttccaaaggtggcagggttttatggttaggaactcagagtggcctcaaaaaatgtctggcatgtgtgctgtctgaatagttggcaatgaacctgttctgaatctttcatattgaaaaattctctgagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacacaacacacacatgcatatgtacacaacacacacacacaaagggagttcaccttgtgtagactaactattcctaggcctggggcttcccctagagtgtggttgatatatctaatgacactcctatggagagaactgattttcccttttcagcaggtttcaattgcaaatagcttcttggttaagggtgggactttgtgtctgcatccctttctcagtgctgggctttgtctggtttgaacctgtacaggtcttatgcatacagccaccgtctatgtgagatgacatgtgcttcacccaaccctctcaagtctgcaagacagtggttccttggagtcgtccattaccgctgactcttacaatcttcgatccttctccatatagatttctgagccttgaggggagaggtttgacagacatccattcaaggctgcgaagcccctcacccgctgcacattgtgcagttgtagatctcattttatcatgttcctttagacagtaacagtagcaggttttccctaggcccaagacctagccagtctttgcttctcggttctcgactacttggcccgtcaggtgtgagttgcatctcattaagtggccttacttccaatattaaacacacagtgtctgtcaggcccataccatagcccactattgcactgctatatcctgtgcactgcttgctttcgtaggtcagggatcacagctacgtgacactaatgattactgtcccctctccagtagtgtgtaaagcaccttccagtcccacgaatgctgtctacagggatgcagcctctagttgggcaccagctccgtttctccatatttaaagacataactacataatgttttcagcaatagaactttaccaccaggttgaggaggaaaaaaaaaaaccaatacccttgacagtagcctatgatgtttggggtgagagtgtctgtgggacccctttgtccaatgactcatcaagatgtaacccattgccagcactggagattttacttggtgacataagacatctagttgggcgcctagcttttttgaacaccacttctggggagcaaacacagattccccatgcttgcttagcaagcacttttctggccaggctgtcacacagcccaccctcaaattttggtgaggagtcatccgtatttttgctcagacacaaatataaactacagctcagggactgatgtacagagccgatcctttgctaatgagtaacttagctgctggttcagcagcctgacagagcaattttgttctgtgtttgagctgatgatgcctgctctttatagggaaattgtgggaattttatgagcaaaatcatattccacgtagcatgaccaaattgagagattagagaaggtaacggcatatttttatccctcaggaatatcaaaaattaaacattttacaactaaaatccccatctgggcagatgttctccagtgtatctggcttatgtctgagccttatgcagcaggtcagctccctgagggacctcagtttttaaagtagcactggagggggcttcagatgtcttctgttgtggctatgacttgactttgctattattagttctaacatttattagatgctttccatgtgctatgctgaatgttagagatgcagttgcataatggatgttctcagacaactagatgaggtaggtgttgcttggcggtgcctcatctgtggttgacagaaagcaggtgtgagtcctgaatgggtcccatgcactaatggtctgaggctccacagctaacacatggcaaaagtaaattttaaacccaggtctgtgtcttaggctacaggtcgcattctgagggcaacaattgttactccagttcccaaggctctgacgccctcttctggcctttctaggcactgcctgtatgtggtgcatattaagggatttctctctttacagtggcttccattgtcttttgtggcttgcttactatatcacacatgctaaccttaccctcttgtgctgtgtgtctaattttatcctctaactaaaatgtatttccataagctgcctcaaaccccctttaaaacatgagatgagacataaacaaaactgcactttctttatctagccctgagcagcatagtccttctgtctcccactgacacctgtctggtgggcaaaatggctttgactcttgctgcaccaacaaccacactacttttctctacagtacaattcgatgactcgtttttccaggaccaacaaaacgtgagatttagcatgagatttagcatagcacctgagcagccatttggtgaccgtcttgagcaccgaggcctggttagtgacatggatcgctgaggcacaagactataccagtagctgcacacacaccacgtaagaataccagatgatgtcagcctcgagattgttacccccaggacagcagggccaggcttgattgctactcgccctactccctgccttctgttggcctcgtgtcacccacgctcttccccaggccacagatctctcctgtgtgttctggttccctcttcaggtcacgctttctgctctgagcctccttggctcagccctgtctctggctcgttcagcttgtgtggtgttctttggctttgtggcctttccagtggtaggctatggtgccctgctctaccttaagatccactttcaaattgtgatctgtgtgtcaaagcttatatttcataacccgagatagagactgcaaacactttgcttatttggttagttcttcagtataagaagtggaatatattgccgggcgtggtggcgcacgcctttaatcccagcacttgggaggcagaggcaggcggatttctgtgttcgaggccagcctggtctacaaagtgagttccaggacagggcgacacagagaaaccctgtctcgaaaaaccaaaaaaaaaaaaaaaaaaaaaagtggaatataacatctttccacttggattgtctccaaacagtctctcctaatgcctgtttgactgtacccttgggctcccccattgtgtgcctggtgtattctgtccttcatgtgcccacttcatgcctgtgtccacttgcagatctgtggccagagtttagcagtgtggatcaccagttgtgaccataagcaaatttttaaaaattatttttatgtacaggtgtgtgcctacttgtctgtactatatgcatgtagtagcctccagaagccagagagggttccagtgccctgaaactggagttacaggttgtgagctgccccgtgtgggtgctgggactcaagcccaggtcctctgcaagtacagaaagtgcttagtcactgagctgtcagtgcaacccctaaaagcagatctttgacttggcagaaataggtgattgccttgtacacagctctaatgagaagaaagtgttttcagttctgagtgactcagaaaagctccacattctcttctaagtttatgtgtctctgccgtcaaatccgtagaacttgacaatgtgccgcggacatgagaatggcaattgctctcttacttcatatgatgctgttagaaatggctgacagaatatgtcttctttcacatggactctgaaaacagagctgtgggctctcagaagtgcaaatgtatttagtgtattaactggcctttggcaggcatcttgggacctggttcccttaagccaagaccctctcctttcagctttctccagactcagggcacagcatcatcttcacagggcaaacatactcattccacagccccaggagctttgttacctctttgttagagatccccatgccccttttacctactaagtaaatttagcagcaaaaaccgtgacagaaaaaaagcccattgtctcctactgttgactggtggatcagaaaagacccacagtttcacaccccagttactgctggatggaataatagttcacagtgaattactttactctcttaataaaagcaggtactgtggggatcatgtgcttcttggcctgcactttttagttgcttggttgcagttacaactatgtcactgtctctcagacagctcaaactgagctgctccatagactctccggtgtttcagtcagggaatacatttcagccattctcttgaattctcatcctaagccacaccccagttctctcagggaggaggtgacttccctccttgcttcttttgatgtggcccttcttgcccccacccaaactggtcctaacaagagcaccaaaggcctttttgctgttcacttcagtgtacatagccaaagccattggtcttttgggtgctttgtatatgcaaactaattgaaatgtcacaggacccacagcggcatcttccctaccttacagaagagattacttctattctgaaaagctagctaacttgcccaaggtcacatagatagtaaatgacaggctgcccactcccccagacacataatttttctgcagtggattgtattggttttaaatcccatgattttggagctggagagagatggtttactggttaagagtgcttgctgttttcccagaggacccaagttaagttcccagcaatgatgctgggtggcttacagccacctgtgactccaaatccaatatcctcttctggcctttgggagcacctacatgctaatacatagacatgcacatgtacataaataaaataaaaagtaaatctttaataaaaggcaaagtactgtgatcttaccccgtcccagtactccctaaactttacaatacacaacaacaatgtgcttcaaccctgcattccaattcactgtgtctggagtagactggcgttttttttttttttttttttttttttaggagattctgatttgaaagtgacagttattttcttacatgcttcttgcctagtttccagcatagttagggataaggacggagagaggtgtgtttctcacacttcccttttggatgccgtctgtttcatttcctctttctttgacctggccttttttttttttttttttttcctggctcccctgacttaaaagatcccatcaaagttctggataaactgagatctagtttatctgcaccctcagctggaattaacagaagtgtggggctttgatgtccttattgctgtaaggagtacttgccctcacctacagttctagcaatatcctgatgcttttggccaaacagggaccagcatcgggccctcaacatcgtgctcccaggcagtaaagctcacgttccagggcctctaccacctgctcttatccatcattcccagactccagcaaacagccctctacctatgaccatcacagcctctcaggtctcctcataccccaatccttccagaatgctcttctccttgtgcctctgccaagcctcagctcttccatgcacccttccctatctgtcttaatggaccactcatcttctaccctcaggaaccttgcatctctttgcatttctccaggatgccagtcatattttgccttgtaataatttgcagacattctttaacttgcctcgcatggggaccactttttcactgtatccacagcaagctccaggctcactgccagatgcccatgtagtggctagagcatgagttctgctagaaatccagtgtctggagggttctttcagttacgttttatagtatttcttacttttgtatctatgcatgtgggcataaaagtggatatacttcttaatacccttctgtggttcggagaagagtacatgctggctataggagagtttgaaatcactgaaaagtacagaaaggacaatgaagtgcagctttaacttcctagcctgcaggtagtcaccatgaagacttagtgtgtctctttagcaatcacattaacgtacaacataggcttctgtattgtcttcttctttacttaaaaacaaatgtcatcttttgaataatgggcactcttccaccaacagcagcactgtctcctctctagatcgcttatttcttatttatgtctaatttcatttgctggctgtgacctttttagaataagaatcaaggtgccagggaaataactttgtaaagtacttgctgcataattacgaggtcctacattccactcccagcattaaaataaagaagagtgggcatttcccatcactccgtgctcacacaactttccattctcccgacttctggttcactctgtcccctttcaggttctgctcgggcatctaaactgaggcttactcaggcttcatttttcttttattttgtaagaaacgggtctcgctgtattgtccaagctgacctcaaactcccgatcctccagccctgtcttcccatgtggctggaaatgcaggtgagcccaagtgctcctagatttgctatttaggtttttaaaaactgttgtttcctgtcccccaggaacgcccttcattgtccctctgaggttactgggagcctcctgtcctatccacaagcacgggtttttcgtgctgcagagcacgctgctagaaagagagcttgtcctccgtctgcctcggggaacgactgctttgctaccattttatttcagtttcataggaaagagaagttaaggcacacatgcttccgttctacttttgtgactggaggacatgtgttctcatggctgtggtacagggctgttgcattgtttttcttccttcagaaccctcaagcaaaacaaagcagctcttcagaccttgtatcttctgcattcagaatatccacccagcacccagacatccctggcctctggaacggatggagcttctctgatccaagcagctgcacagacagcttctgcaaagcttcctcatagctcccggcatctggctggtgtctgtcttgtagcagtctgcagtgagttggagcaggcagggccttctcctgtgctggtctgatccagtgaatctggaagtcacatagaacaggggctttggttggaagaggagtatggaagtagtgtttgctcagctccttacaaaagcttgaggaaatgccagccatctaaagccacttttctattgttttcttttcagcttgtaagtagccagtgatcattaattgaccatattacagagagaccacatgactccttagttcatctcctaataagcttgttgacctgcacatccttgtcacccttatttgctatttggagcatttttcagcagcatatgcctctagcagttgaccctcatgcaggtggtgctgcacttactaggtgatcaaaccatcaagccattgtgtctcaaggcaattgacccttgaaagagtttgtgatcacacagatagatgatctgtgaatgtgacttcaggagcaagtaccctaagcaataaatgatgttggtcctaggcatattaactgaagatctgttgagcctgacaaagcgccatcgtcgagatggacaaggccatgaagctgacttctgttagacctttgggttcacaccttccctccacaatctgatgccagtttgaattctacaagtacatagagggtgccagggtacactccattcagcctgctgaatctcacgttggcctgcctgctgaatctcctggtggtagtggagctgggttctgcacagagaagcttcctaacaccatcctctgggcaaacttctttcttagtctcttgactcctcagctctgcagaatccctttactgctcctcaaaggtccctttgtgagtggttagaaaagaaccctcccccatcttgcctactgttttcttgaagaaaaatagaggtgctagtaagtaggatccttgccatgaaaagattccccctcccccccaactttgtaagcatttgtgtgtggacacagcaagcatgttgaggcagtcttcatggtttctttgccactgtgctgtgagctccaggctagctgacctgtgagcttcccggtgattctcttgtctccctgcaatctctccatagattcgaggatgccttagtgaaacaccaaagtattgagctccctgcctgccaagcttcccacattggttccttgtctctcgtcccagtggaagagggggcccctccaccccagagcatggcctttatccctccctgcatgcaatgcacacagactggaaataagacaacagaacaggagatgagccccacagcaccacgcacagctgcagcatggctccatctggccaccttcctgcctgctcccacccttttcatttatgtttattgatactgctggagatagcccccaggactgggccacattccacattctacccttctattgatataaagctaaaactttgttcccttctgaatactttctgagcaaggtatgtgttagggtgtttgtgatttgcatataagacttcaaaggagtctgctttcttgactactgtttacagttttataagcctgcgtatattgaaaatcatttctcagaggtcctgtactagaataaattgtattagggctgcagaataaattgcattagagttgcagaataaattgcattatagcactggaaccttccaaagctccctcaggcagaagctggtctccatttcctctgacctcctctagacagcaccctatgctggcttctgttgttgtggcatttaaccaggttgggttgtgatttatctgtttatatgcctttgtccctctcacatacacagtagcattggggtcctctaaagcaagaactgggctgcatttatctttgttaatgtagcagtcagtaaaggtccaaaaaaatgtgctctagccatttctttctgataaatctaccaatgtttaaacagatttcccaagattttgaatggagcattaaagcagtttcatcagtaatacattaattagtgctttagtagcaatcaaatctcatgcttaccattatcacaataacacgtaatgcagtagtacagtgtttgttgcttgcctgctatgtccagggactgttctgggctcattgcattttacatgattaagttctctctacacacttagatgcagatagaagctccatctgttttacccatacatacacagtactttttcttttaaggtctctttaagtaacccaggctggttccaaactctccatgtagcttaggctgaccttgaccttgaatctcctgcctctagcttttattgtcttcactttagagatgtggagcaaagatggatttcccccttccccaccctcaggaacagaaccaacaaataagaaacttggatttgagctggtcagcctgggcaaagaaaggaggtgaaagataaaacactatttttaaagatgttctttacataaccttttggaaatttgtttttttttttctaagtatagtgtgttcctatggttgtattctcgaatgccaagggcacagtgtgggcctaacaggaaccatgagctgctgaggaacagaaccgcagctcagagaattggagtagctaagcagacggagagcggtttgggttttgaggaaatacatatttgcgttaatttttaagaaggttgtcacttaattgcctttaatctgaaactagtaacatttttactaaatggcagttaataacattttccctgttttgttttcctttaaattagttttcttaattttgcaagtggatattgtttagatagactctttttctgaaatcaaacgtaataaatacattgactcactaccctgatgggctagctctttcctaagaaagtggccctgctttctgtgtcattaacatggccctgacccggcagtgtcattgcagtgtgtggcactaggttcctcctcagaagagccaggccacctctgacacctgacaccaggtcacacctgacagctgacgtctttagattttacagttattgacgtatttgaatttctttctcctcttgatgtccactgcttgtgtgcctagataactgtccatctcattaaaatgaccctttctttctggtgattgcatttgcttcactttggtggggcacatctgtcttctttctaagcaggatttcactgtcatcgaggatggtgcctcgatcctcctgcctcagtttccaagctgggatggtaggtgtatcctacctcacctgcctgccctttgctttgtagtggtcacctcaggctgtcacatctattccttctcatcctgcattcttctctctgatccctggcccctggcctccctgccctgcctgtgctgtgtgattccttgtcatatctgctagaagcaaatgcctaagtccctgctctcatccttcttgtttaattgcttcagaatatgagttttctaataattaaaatatctgtggcactacatgttgtggctgccctcattgtcctcactgtttaaataatcctcaggtttgctgttcctcaagtgtagattctgagtttccagttgctttactctgtaaacggaatctctcattcagttgcattatactgaaataggatctatacagtttcatagcagaatccagaattttttttcttatatggcaccttatcggattgttcatgttactgttcaatattagcttcatattttaaagttgaataaatgtgttgagaagttgtgcacttatgagcagcggtggaggtacatgcttgtaaatccagcactcacatgggtgaggcaggaggattataaattcagaggtagcctggactgcacagcaaagcccattgtgctcgttattcttcagatacacctgttctggtgctccaggtcagtttgtaggttttgaatggtgagcttattgcagggaaaatggtttcctcccttgcagatggaagaacagtgaagagagagctaatgagttcactgtccttcacagcccgctagctgccgtgagcgactgctggtcgtgctccccaaatgcaggctcaagatggttccccatccttgtgtggtattctgtggcctctctgatctctggggttattgctagagtcaaggcaagggaccggggaaagaatgtccctcttgagagtgtttctgtacatgtcacccaggacttctgcatacctgctgatagagacaatcaagtcaggtgatcagctacctcatgggaaatgaagtccagccttgtgtccaaatatgactatggcatcgtggaaggaagtggaccttaaagcacatgtctatgcccctgggatgggttggaagagaggacttatgggtttgtgctgtgggcattctgatacattctgggggatatggagtccaggcttttaacaaagtgctttgtgttgattttctgtgccaggttttctgtgcttttaataggccagagcagatgtctgtgaggagtaattagataaggagggctacctggcaacagtgtttcagtgtttcttctgtggtaaaagacttttctgtaatgttgggggttttggtcccttagttatctagggcagtctgcttttcatcatctggtgtgacagtctttgtaggccctagactgctatacaatggggacatggtgggcctcactgggactgccactgtacatccagcctgcatgtcactagtacaacctccttcccagccagtgttccacctcagtctgtctgggaagcccctctaggacatgctcagtggcgttgtttaagttacaagagtgttagtaacgcttcagtctggcttcactctgcacttgttgatttgggctgcttgcctcttccttctctttgctctttcccgtgtgataaaccagtagactgactgacatttctcacatgagtgatgagcctactgtgccttccagggatcaaccccattttccatagaatctcagccttcatctattgattatagatgcccaatgaatccctcctctacagcacacaatgggcttagctctgcagatgctttggtgaccacagataatgcagtcgtcctcgtggagcttattacgggacaaagggtgcgtgcacccaaggagagacccagtgaagtcaaggaatcacagaaaagaacataaagcccagcttggctgagtggccctttgcccaggcaagagggcagggaaggcatcttgaaacaagaggaacttgggtagattggaaggcggggacgaaccatcttagtcaagagcagtagcttataaatgaagaaagaggagagacagcgggagagggggataggggtggggttgtgggtcacaaacacttgggatttaccaggtccaccagacactgcatgaaagtggggctggaaggaagcaggggtgtatgagactaggtgggttaggaggcagctgcagccatgcaggtaggtgtgagggagtcttggtctgagatctgagtcaagtctctctctggatttcatggccctgagttcagagagcacttactctttcccagctatgagatcatgaagtgtgttcttcctttcttctcagacttcccaaactgagacaagctttatgcctcttgttctaatctcagcaaagggaaaggacagggttgcctgtgcttggcagtgttggggatgcagtgggaaacagtgtttctgttcattcttgggtatatgaaggagtcatgaatggcatcagcttttctcccaagtcttccatgaggctcacgtggccaggactttgccaacttagatttcccttcctctacccatgagagatattgtgaattgactgtggtgttctgctcctaccatgtcctgatgtgacctcagacacttcatcccaaggccctgccacagctgtaggagcatctccatattcgtgccctctctgctggtccctgtacttttaacagtgagtgggtgtccactgttcctggagacctacccttgtcttccacttgtacttcattactattttgtgtgtttgtgtgtgggaacacatgtcatagtaagtatatatgtggtcaaaggccagacaacaactctgtagaatctctttttctcctttatgtaccttctgggaatggaccttaggttgccaggctggctcagtaaatgggtctccccactgagccatctcttgggcccttttactcacagttcagaactggcctcagagaaagtcagtgcataagttctcccttccttttgatcccatccacacagtttgtgccctgagtgccctccatttttatagtttgctagaattataaactcattgttagagctgttagcacactgagttttgtgacggccaaaaggacacagtcagcataagtagaattcatgtgagtccccacatagagcttccaaatgtcctctccagtggaaccctggcttgggctggctgtgacacacagagcactggcagaatgaccgactggtttcctggtgggtttgatcacatggctgactttagccctcagtccctccaaagagaagctagcatgtatgacctaaaccccaccaccaattatacattatttggcttaaagctcttaagaagagaaacagacactcaatgtcactcaaaagaggacctctttttggacaaggtcaaatttcattgccccacccccagccttaagacaatgtgagattatatactgccaatttccaggcataaacattgacgcctgccaagtgtgtccagaggttactctgcatgtgggggggtcagtagtaagccctgggcttgtgtggaccttctaggtgaggtgaagcttggaggatggctgccactgacacatctaagctctgctctgtcaactagtcatgtaactacagctgagatactttttaaccttttcttcagtaaaagtgagattaatcctagtacctactttgtgttgttattacataaggtaaatgagaatgtttgtgctaggggctaaaaatacatggtatattgaagcacatgataaaagaaaactggatacaatttcatattttagatgtttatttaatgcatgtgagtgctttgtctgcatgtatgtatgtgcaccacatacatacctggtgcccaccgaagctagaagagggtagatccccttgaactggagttacaggcatttgtgagccaccatgtgtgctggaaactgaacttgggtcatctgcaagagcaacaagtgctctaagcatcagggtatctctcatgtcctctttgtttttaatgtttagattttagtttgtgtattgtgtactgcatgaatacctagtatctgtggaggacaaaggcaggtatcagatcccctgaaaccagaattatatttgattgtgaactaccacatgggtgctaggaattgaacccaggtcctctgcaagaacaacaagtgctcttaactgctgagccatctctccagcataccaccccaccccctttgtgttttgaaacagaatctcactgtatccctggttaacctggaactctctatgtagaccttgaactcaaagatccccctgccttctatattcatatttgccatgagaaaaatattccaatctttttttcagatcctttaatatggtgaaatttgtttgtgtggggtggttctgaaatttattctttatttctcaccttcatgtcttttaaacagaggttaaagtaggaggtagcagtcataagaggttgtattctggtatgggggagagcctgagttagagggagcaaatgtactctgatacatttggatgtggacattgttggcagacctttgctataaattgcagggagattttaatagttggaaaccatatatgcaccattttcccacattgctactgagaagactagagggaggctgtcttgagggtagcttaaagactgccaggccaacctcctgtctcctttctgcccaccacttcctagcagcaagctccctaaaggcagtctactggcaagctgcacatggctggccttaaaagggccacatcagccttccagaaactgtttaaaactgaatgaagcccaagagctttctctgatagttacaccttgagtttgtgccagccactaattgttctctaggctttcctgggaaggtggctgagcttggggcttggctttgaggtctgccatctgtgaactgctatttgtccacatgtgatgtggatcaggactgtttgtccatggatcatagctttaatgtttttcagtttggaaaatgtttcctctaggtaggacttgttctgagactcttaaggcctcaaggttcccagagactctgtttctaggttgggtccaccagctagtgttggtagatgggtctgctttgagaagggagtcacaggaagtttgcaaatggaggcccaactacctaactacatgtttttcccccccagctcatctctagtgatgccgatggagccatccaaagggcaggaagattccgagtggagaatggctctacagatgaggtaaggatgccccagttcctgcatcaccaccaagcactcagcagtagcagtagacaaagaccccatgagtgcagatgagttgcctaaaccgaaccctagaagggacaaataagagttttccagagctttgcacaaagcagacgtgaaagggaaataccattatggggtcatagaaggtctttcaaagatagtcgtaaagtcaagtagacacatgggactggtctgcccacagcagcccggagggggacccacagcctctttaatgaatctctgtttccctaaggaaactcctgcctccatgtcctcagaacactggaattacaggtatgcatacaccaccatgccagttcacgaagtactgggtatcgaactcagggtttcttgtgtgttaagcaagcactctgcctgagctacatctccagtctcacgatgtaaactttgaatacatatatatctcatggagttatcaaataagggtgattagcatatccaaataaaggcattttattttattatagtttagttacagtgctgagaacaatcccagggcctcatttgttctaggaaagtgctataccaccatgctgccctcatgacccagagctttttaaattgaagtccttaatgcagggcactgggtatgctccacagagccatagaagaagcaggctcagctatttcttcctggagatactcagagctatgagcctcctctgtctggcagtccagctcagaagactgttgctgagacgcaaggcagcatcagggtgtggcggagatggctttaggatttaaagctcagtctaccatgtgacttactgtttctgagtcaaatttctgctgagtaggatagagatgggtcctgctctatggcacctggtctcactgcgagttgtttgtgttttatacttaagcacaagattttcataatccactttgagtgtaatctcattaacacatcccacattactaattgtcaggagttttgtgacatcttgattctgtcacctgtcctattagctcccccaccgagcagctttgcggctccttcagatgagcttgtcctgccatctgcgtgcttgttccaattattaattaaaacgagcattgccctgggtggaccacgggggactccctccctgctccctcttatgtcaattagttgatggcaaaacagaggggacagccttccagctcgtcacacatttacctttgtcagcgtgggaaggttgtgtactgtttagggacatgaaaattcaatttgggggaagagcacttagtaataaagagtgtatcatctggctagcagttcctctcggggtattatagcaacatttaaaataggggaggagccagaataaccctaatttccctcctagagactgactgtgagttacagtccagcctcacactggaacgcataattgaagaactgttttctattagaatgaagttggactagagaagtgctcgagggtaagagcactttctctgcaaacatgaagatccacgtcttaatcccaggcacccacaccaaagccgaggctgcatgtgcctgtagctccagccctagaggacagaggttactgggagatcctgggatcacctgtgtcccatgcagtcacctgcacttacatgcatatccccacacacctgcacataactgaaaatagtttttaaaataacctttgaaaaatatgtatttctagagaataacaagaaggtcagaaggtagttgtagggcctcagcatcctaatttatgcatttctatgcaagctatgtattttccgagtctctagtcaatggaattgttgattgaatcttttaaaatttttgtgtttaattttgagatgggggtctcaccatatagctcactcagtttatcctagaactctgtgtagccaatgggagctttgaactcatgagtctcctgcctctgcctcctcacatgtactgggattacagatgtgtggctcaagtgtttaactcaaaaaataaaataaaataaaataaattaagaccttaagcaggaattaacaggaacagatctagctgttctacatagaaatttttttctagctttttttccttttccttccctctacttcttccttcctcctttcttttgctcaaattgtctcagcagagtctcggtctgtctatgtaacctaggatggccttaacctcatcttcctgcttacactccccaaatgtcaggactgcaggcctgtaccactgtgcctgatttccgtgtttctggggatgggatcagggccccggggcatgcttagcaagtactctacccactgagctacagcctcaggccccaaggcattttctttaacgaaaaaacaagtgtcagtatgatatgtaccattaccatgtgtatatgcatgtgtgtgtgtgtgtgtataggtatagtatgtgaatatatgtgtgtgtgtgtgtgtgtataggtatagtatgtgaatatatgtgtgtgtgtatgtgtgtgtataggtatagtatgtgaatatatatatatatatgtgtgtgtgtgtgtgtgtgtgtataggtttagtatgtgaatatgtgtgtgtgtgtgtgtgtataggtatagtatgtgaatatatatatgtgtgtgtgtgtgtgtgtgtgtgtatgcatgtgtgtgtgtataggtatagtatgtgtatatatatgtgtgtgtgtgtgtgtgtgtgtgtgtgcatatgaaagtaaatgcatctttataggagtgtccaagccaattgtgtctcatggttttactgtaggaaagaagcagattgggatgtggagggtggaggaaaaaagattttaagttttgtttggtctcactttttttttttgcaatgagcttatgtttatgtttacaattgtaatgattcagtattcgtcttcttatgttgctgtgctaaagtctcatgaccaaaggcagctcaagggagaaagtttattttggtttatggctcctgagaggaagagtacatcctggtcgggaagcatggtggagagcaataggcaggcagctgggaactcatgtccctactgcaggcaccagacagagctcccagacacagagctcctccagccagactgcaccatctaaccctcccaaacagtgccagtaactgagaagcaagcattcagatacctgggcctggatgtatgtggggatttcctgcagaagtcaaatatttggggacattcaagtagaatcgggtattttgcatgggttttggttaaatttacattgctggtaggagcataaggtggtgagtcttctgtggaaatctgtctatccccactaaaaccgaatgcctgagagtgtgtgtgtccaccaaggagagtcctgttcacagtggcgccagttgcatacggcctaaacatccaacaacaggacaatgagtacatccctcttgggtttgtcctatggaccatatggagatgaagaaaataagtcactgcaccaactacagggtgaatgccacatcctggaggatattgaaggataaaaaacctgacttaaatgaatacacccgagagggtttcattcctgtgtagtcccagcaggtgaaactaactcacctgcgaagtgagagaagcccaggagtctgctgtgtttgggtaatggttgggaaatgaatggcgaggctatgcggaaacattgtgtctccatctaggccgtagttacaaggctgacccaaaatcgcttgatttccacctcctagtcaccctttgctctctgccagtgctgcgcatcatcagaatgggagctcatttcttgggatccttggcagagggttttgcttagttctccatttcttttgtcagttcctatgagcactcttgtctctcctcattgtgtgcatttaataagggagagaaggcttctagttctgtgagacacagctgctggggactggggctccccacacactatttcagttaaggattcagcgaagatacaaatgaaatatcttttttgtccttataagcaacctcacccttaccagctagctcggtagaggtaggtacacagtagtcactgctcacagtcccgcctcttgctggattcttgtgttgtgaagttgcccatgctcacccctgggggagggggcatgtgtggtccagagcaggaacttcaaagattctggcagttaagcctttaagcccctctcagagttttgtttttaaatgcataaaacacactatgatggagggaaaacattttaaacgtaatttatggtacagatacataggatttttactacattagagatctgacccagcatcaggtttcaataagctctgtaatgttaaatccttggcatagaccattgcttttcaaagatcattgttaccagaattacctgcatgcttgtacaaatgcagaaggacatggctttggtgctcagtactaaagggagggaggggagaaagaaggggggaggaggaagagaaaaaagaaaaggaaggaaaagatgagaagaatcgcaggctccacctagagagttctggggaagcaggttcctagcagggccagaagcacacagggcaacacatctgaagagcacttagctaaggctctgctggaaagaaacctctctggtatccgaacctggggcctgcaagctctgaagcctgtgctggggtcacagtgttctctcaaatcttggagctctctagggtctagggccttgaaaccatgacaccaacctctctggagtctgagtgactggggtcagctccctggcctgggtgtccctttgttgggtaggtggagacctgaggctggccagtgtgccccggcatcatgccttagctgcatgtacctggttgcataatggaaagctttgtggagcaggagtgctgccaggactcatggtgaaagacaagtgactgcagataatgaatcacgcagaaatcctccaaggaacagatgccaattcactgctgctcctgagtcaccccaaaaggtcaaaacgaagaggaagcaccgtgaggtgctcatggttaacctttccaacagggagcacataggcagcctacggtttatctagatgagctaaggacacaccttacccacatgctgttctggctggattcgcagaccctggatctgtttgtgaagaagcatcagacagccataagataaagaccgctttactgaaaaagtatgggaggacacgatgtgcttcaaaatgccatcacagaagacagaaatctgaaaatgttctgaagggaatctaaatgagacccggcaacaaaatgatcatgtgctgaagccaggaacgttcatccgcattgagtatgctgacaagtgtggaatacagatgattatatattgtattgatgctaactttaggaaattgataaagctgaactgcaggtctggtgaggtagctcaatggttgagtgcctgcctagcatatagaaggatcaaggttcaaaccccagcaccaggaaaaaggactatgttctagttatgtaagaaaagaccccttttcctgaggagtatatactgaagattttagggataaagagcttttacttgtacaattgagtcttcagtggctcaggaagaaaggtgtgttctgggtggatggctctgttggccagaatatgtgtacaaatgtgaggacctgagctcagggccccagcacccatgtgaaaagccaggcacagcaacagccacttgtaatcccagaagtggtatgggctttagagacagatggatccctggaacttactgtctggaaatccttaccaatctgtgagtgccagattcaatgagagaccaggtaacatcaacctcagacctccacagatacacatacacctgtgcttattcttacagcttctagcttttgaggaaaatcaagaaaaaaaaatcttaagacaaaataagaaactttaactggatggtggtggtacacacctttaatcccagcactcaggaggcagaggcgggctgatttctgagtttgaggcctgcctggtctacacagcaagttccaagatagccagagctatacatagaaaccctgtctctgaaaaaaagaagaaaaaaaactttaacctttagttttactccctagagtgataaaaacccagatcattcttaaaaggacccaaacaataatataataggtaagattttaaaaacaagcaaaacccacgtgtgactggaggagtttcagctggtcagcagcacacacttgggcggcattcggtttcctcataactgttggcagtggttacagacaaaggcagctggaaggttctgcatacaacttggcatttagagcactgggcagatgtcactatgcccagagccatggcacggacagcttcctcattcacctcataaggcagtgtgagccaaaaagaaacacatggagagaagatgcccgcagatcccctcaggaacaaccacggcacacccatccttcttcaaagtccagtggtcagttcagagccggtatcatgacctcatagggaggttcagcaagctaagaaccattcaccatcagaagagctgttgccatgtagccctctctcccttttaatctaatctacaaagacctggcaaagaaaaaatttgaaagcctctttgtaaattcaaaattgaagaaaacttcaacatgatatgaactgatcacaaccatctaaaaagtcactgaggcatgtcacatgtctcacgtcacagaatcacacacatgttctggataatctgttttctacacatggcaccatgtaacctccatagagcttctccccaataacttttaacacagtctcagcctggcatcaagacccacatgttcactgtaagaagatttaatgtctcatgaagataggaaaagaggagctggagagatggctcagaggttaagaacactcactgttcttggtgaggacccaggttcagttcctagtacctacatggcagctcacaactacttataactccagctccgggagatctgatggcctcttctaacatatacaatatacatacatacatacaaaaaaaccaaatggatcttttaaaaaataaaatgagaagtgacaggctgttcaataattagatctgggttagttgacaaagtattagtggaaattgatctttaataatatatatccgactgatgacagtgaagtatgagagaacatgtatagcatggtataacatgagcagcttgattagtaaggatatggggagtctttctaatataacactaacacattatagccacatggtgcaaatctgagacatttagaatatccctgaagacaaaattgccataaaccagtttggagtagaaatttaatttgaagaaatggtttgcactgtgttcaaaggtttcaaaaattgtttttaaaatactacacactgttttgggagacaaaaaatgtaataggtatcccacaaaacaaaaatcataggtgaccaataaatatgaagaaatttgattaaggcaattatcatttgagtaggttaattcttgagggagtaaacaccaataaaggagtgagttcaacctagagaagtgggtcagggagacatcgcagtgggtaaagatgctggctgccaagcctgacaacctgagcctgtcctcagaactcacacagtgtgcagaacaagttgtcatgacttccacacattctcagtggcacgtgcttccacacacatatacacagcacacaataaaaaagagtaggaaaggagggatgactcaatggtttaagcgtatctactgcatgatcatgacaaccagggcttggatctcagcagctactgatcagctaggtgcctgtggatgacaggaggtcactggggcctcctgtcttgcagcctagatgagaaaatgcaagcttaatgtttagtgggagatccttcctcaaaggaatagttagagggtgatcagagagaacttctcttccctaatcttacatacatacatgtgtacacacacacacaaatatcagagttttatttgttttgctttgttttgttttgtttgagacaaggtctctctgcaaagccccggctgacctggaactcactgttgaccaggctggccctgaactcacagagaccctccctcccaaatgctaggattaaaggctacacctggtatatcagtttttaaatggaaataatgtttagtctacctattagataaaggaacacaaatataaacacattaagattacatctttactattaaattgttaagaagaaatgccaaggtatagggacaggagtgtcctcagcccctgctgctgggactgagatgctgtaccagccttctagagttgggttgacgaatccttccagagagcatgcctcttggcaaatgactcagctcctaagaatttattctaaagaagcaattagacaagtaattatgtacatgtggaattagatgcaagccacacattatttattaaatccagtatcattaattatttgtattaaatccacataataaactagtatagagctttaagtataatatcacagaaggggtgtgtgtaaaatattaactggaaaggatatccttcaaactgcatgatttggtatgagtccatgctgttaagaaaaaaaaaaaaaaacagctaggagttggtgcacacctttaatcccagcactctggaggcagaggcaggcagatctctgagttcaaggccagcctggtcgacagaactgccagggctacacaaagaaacccagtcttggaaaaaaagaaaaaagagggggtggagaaaggaagaaaaaatagctgtgtgtgtggatggtgaggagcagttctgctgttatttggagttctctaaagcaagagaagtggtgaaatgagcatctattaaaaggagatctattagctcagcttacacagtgtgatctgagcactccaatgatggctgtcttcacactggaaaggctgagaatccagtagctacctggtccacaaggatggacacctcaagcaatcccagtctgatgctgaaggcctggaggtttcctggagatccactggtcttcagcattctgatatcagcaaagaacagcagcagtggcagcagcagcagggtagttgatccaacagcaaggtataaaaggcctttttcctcagacctccgtttttcaggcctcctccagaatcactcttcccacttcagacaacctaatcaagaaaacctcttacagatgtgcccaatggctttcctcttagttgatttcagatccagtcaagttggcaaccaggattaatcatcattaataatgactgtcttttatagggctattcattctgtttgtccatattttacacgccaactaggtaaggtgcatttccaagttctagaaagcagatgaacttgagtaagacactaaccaatatcctctgggtgagatgtgctggcaagaactggtgcctaggggacaccaatttccaggtatccagatgccatacaccagagaagagaaaactttacatctgttaggactgagttcactcatttttattcctgcaccctgaagatttctggagtgtttctgtgacatgactttacacgggacgtcattgctggtgagagcatgtggtgacagcccttattcgtgtgcttttagtgctgactttttctaccctggctctttggctcctggtttagtgctagcttcgtgttcactctctgagtaaacattttaacgacaccgctctgctttgttctatacagagtgcagctgctctgccaggcacttggcgaaggacagacgtgcacttagaaaacccggagtaccacacccggtggtatttcaagtactttttaggacaaggtaattatgtccttgtggtgactgggggaagagattctgttcaaacctgcataataatttcaagcactgtgtatgagtggaatgcaatcattcaggacgacatcatcagagcacttcacagtgaggtcaggggtgggcttcgtgggctaaaagcttcaactcagagcgttcttgattgtgggttggtctgttgtgaggagtgctgtgggggttggggtttaatgttgttttaatccctggttaagagggaactagctcataggaatgagtcctttgatagataagaattttcaggatggaaaaaaggctttaacttagcaaggtcagtacctatctgcatgagttctaaacatttcacttgagaccatgaaggagaacaattgtttcctgagcaacctcttggccataaaactgtgggctctgccatatttactcaccaatgacaagtatttgtcttgtggaagtatatgtagctatgaggtgccgtgtgaagtgaaccaaaccccctgccctcaaaaagcctatagacaaggtttgcaacttggttctgctcttattagccttgggacttgaacttggcttctctgtctgtaaagtggagctgtttttagtccttccctataggtctaaacaaagcttccaatgagagatgcaagaataacaatacttggtgcctaacacataccaagagctcggttgctcaggttttagactatacatttagagagagagcgcatggaaagatggagagcagatgtgttgctaatgagagaagggctgggaatggagggcaagtaactgatgtgaaatctgaaatggcagagatgtgccatggggcatccattgtggaacttgatgctcaagccaggaaatgagagtgatgtcttaaaaaccagttacagggctcaggcagcaagagcgattgcactgcaacatgacagcctgagttcaaatccccagccccatgtaaaaaatctgggcatgactgagcatgtctgcagtacaacaccggaaagacaaacaggtagatactgggagctcactggccagataacctggccaaaatggagaatatccaattaatagagagatcctatcacaaggcaataaagctgagagcagtgaagaagatacccagtagcctcccttgacttcctaagtgcacagacaggcatacacacccacacatccatgtttgtgcaacacacacacacatacacacacactcatgtgctccacatgaaagacaaggaaaactgttacagtattattctaaaaagctctggtctggccaggccgggttacttgggtgggtgggggatatagaagcatttaccaagaaagcaatgtgccggtcatcttccccatggctgggcaccgagtgccctcagcactggcctcacagcaaaagagttgctgtgagtttgaatgccaccagcatccaaagagctgatgcaaagcctcaaactggattaaacaagaaggaatcaaacaataaagtttgaggccaacatgatctacatagcaagctacagatcagccagggaaggctctatggttggtggcagcaaacagttcagtggtatcagaggactagaacctttcccctttttctgattctcaaccttagtgtgatggctttgccctccttaggaccatacaatggctgcagcagcttcagacatcacctgacactacaacatccagaggagagggtcatctttagaatggggagcctttccataaggctcttggcagatttctcgtccgtctcagccagcattgaatcacaagttcatttctgagccattcgctggccagagggaagtgggtgcacgataagtggtcagtcctacccaagtcagccttgggatagcatgtgagggctggccacttctgtttgaaggaaccagctgcatccttactgaccgtctcttctctagtccatcagaattacattggaaatgatgcagagaagagccccttcttcttgtctgtcaccctttctgaccagaataatcagcgtgtccctcagtatcgtgcaattctttggcggaaaacagtaagtacctgacttgagtttgatgtcgcctgattagcacacgtgctgggagggccttgtagttcaccccatctcagttcagttagcgcctttcaggtgattcctctcactgtagatgattcagagcccactgttctgtgctggggcctccaagctctgcttaccagcagcttctcccatctcaaagtcactctcgaaatcagccacttctaagtcttggcctctgggaaatagtagtatgttttatacaacgtactacttcattaagcttagctattacttttgggttgttgttgttgttgttgtgagactgggtttctctgtgaacattggttgtcctagaaaatacaccctcacagccctccacacatacatgtacacataaatagcaaatcatgtacatgtatagtgataaagtaacaactttaaacttcctagaaagaaaggctgaggatatggctttgttgatagggcatttgcctagcttgcctgaaatcctgtgttcaatccaagcactgcataaaccaggtgagatggtgcatgcctgtgacccccatcacttgggaattggaggcaagagaatcaggagtttcaaggccacttatgtagcaagtttgatgtcatttccccaaatatgagactatctcgcaaagaaaaaaattctagaaactactactattcaacaaattatgattaagtacttctaaaatagtgagctaaaataataagaagaataaaaacaaacatttattatgcacttactatatgctagatcagtggttctcaaccttcctaatgctgtgaccctttaatatggttcctcatattatggttaccccaaccataaaattatttttgtttctacttcataactgtaatgttgctattgttatgatcataacataaacatctgtgttttctgatggtcttagctaatcccacaggttaaaaactactagatgttttcttaactacccaaatctcactcgctgctattgcaatgacagaagttaaaatggcctgacaaaaaagttcctgcacgtagatgacagaccaagtatactccagagctcagagaccaaggtgtcaccactgtacataatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaggccacctgtgtgacaagcagagccatcagtgggtctgggagccctgtgtgagtggcaggggcagggggcatacatgtcagtgggtgcccattgttctcctagtgaaaaactactgtgcctgcatccaaccccttatctactacaccaggcaggcattttctggtttctgattgattgattgattgattgattgatttttgctttatgtttgttcattacaatgttccagacccttctgctctcagggtcctcttcaggaagactgtggttcggggcagataattggactttccctcatgctgtttctctagcaattgatctttaggtatgatttttaggtattgatctttaggctgagacctcatgacagcagaacacatttgagtaagaagttttcatatagaattaattatgtacagtgggatgcatgacccactcccatgacctctagtatagaactggttggtcccttcctgtgtcttaggtcccaggaaagcatgtgttcctgagtctgtcagtcttgctgtttgacccttgtgaagctcctctctggcatagtctcaggtttctgcttgcctctgggcctcagctctacaacttacccagggctcagccctgtaaaccatggccttaggcccatatctatatcttgccagtcatccatgctggtagctactgcctttcaccatgtctccacaggggccacgtggacatcagacccctgtgagaggtcctggccaggaagaagcctctggctccagtactgtgttacctacagggctcacttagggccactacagggagaactgcagtttgccatgccctcatggtctgccatctaaccccatagcccgcctcttttctttatttccttctgacccttctgcctttctggaatgaacttatttgataccctatcttctttcttcttgacatcacttatgtccttatcttagatgcttgctgggtgttcaagaagagcgggcaagacaaatgcaggggaaaactgacttatttccatttctgaagcagttatctactttaatatcaactgtggtcaccaccttgtagggaacaaagctgatgaaggtgctaagaaccctgaaaatgaggtcagggagagcttgcacatggggatccagaggatgaaggctgtaggcactggcaaaggagaaggggagatgggaagtattccaggcaaaaggaagaaggactaacagacaataaataatattttatggggctactcttggccactattaaagaagtattagggtgagattcaagcccccagaccactgtgaaagcagcccagggctggccatcaagaatattagtcccttcactgacaagtgcccataccttcatctaaagcctcctctgggttctaaacttgtgggccagcagcaagataagtgtttgctcctagctacaaatgggtataatgaagggaggtgagaaaaataaggtcgaaatgttgacagaagccagttacaaaattccaggaactggaagtgagcactgggggttggaggaagtacaattacaagtctctgcccagcccagtgcacacaggttcatgctgtcttgggttaaatgcagttagaacagcagaccatataaccctactgtaaacagtcctttctgtgtatctatgcttgggtttttaggtgttgggaatggaaccagggtcaagcacatactaagcaagcactctgccactggcctgcatgcccagcactgagctgggtcccatctaaacacgtggtgatggtttgtatatagaagcaactcaaactcactgtagaaactccatccagacaatacagcaggtggacagaggaggatcaaagtctgtctgctcagtctgtcatagcacacttctgggggtctctagaagcacacacaggtgttggaaggcacgtgcactcacatgttcacatgcaggcaagctgcatgtatacacatgtgcattactacacgaaccaggtgatgtccagctcgcccttctgaatctgcacagtgctcacctctggttgcctgctgtggactgacacaggcttctgtgtatggcatgtgatgtctccaccagaaagtagagtgcttttatttgagtattgactctcaaaagctgaagacaggaaatgggaagggagggctttgccagggtgtagtgaagaaaaccacgaatccagaccttgcaagtcctgggctcctgtcatagttattaatgaaggtgtcactgtcacctaccacaagctgttctgggcttgcctttagagttgcctctggtatgtttgatgagaagagaaggtggtaaggaggaggctaagcagaggcacagagctgagggaacacagagctgagggagcacagagctgagggagcacagacctgagggagcacagacctgagggagcacagagctgagggagcacagagctgagggagcacagagctgagggggccacagagcagagggagcacagacctgagggagcacagacctgagggagcacagagctgagggaggctcagagctgagggagcacagagctgaggccaccttgagcaggttagcctcctgtgtagctaaacatgccacaggaagagctcagctcccagtagtgggacctggcaagtttaaaaagagagctactatcatcatggttttgagtttgacagtgtttccaatctgtaccaaaaaggcaagtttagtccagtgaagaacccaggaagaggactgaggccctgtatggggctaattgttcatggccagtggcaagaccagagagtcaagtctcttgtacattggtttctttactcacagagatcacaggctggaaaaggcaaaggaactctacccccaggcccttgatcctggcttgaacagaaaagctggtagaagtgtcccacacacacaggacaagtatttacttcttcatttcctgcaaagacatcctaaccctcccctggttgttagtgatgccagttttatgatttgccagaattacaaagaagccgttcagtgggttctgtttgatgacctcatctgctctctgtgggccgcctgtgtaagtgctgggaagagaagcttatctggtctgggtgcagcccttcctatgagttagtcacagtaagttctcactaaatgaagaaatgactttaaataagcctgcaatgaacacgttatcaaaaccttgctggaagatttgggtgatttctagttgaaggtctttgacctggtgacatggtacttgagtctcattgaacaaatggagactttgttttgttttgtttaaatctttgacccataactaatttttagctcagagaccaaacaaatcccctttcggcaaatttggatggtgtgtttcgtgggttactgttaagccgagatgatgacagacatgaaaagaggaaaggtctgtgttggctcacagctatggaggctctgaagcctcggccagctgtccatgctcttcacagcaggatccatggagctgaaggacgctgttcacctcatgacagctgggaaccaagagagcagggttctacttccccatttgagagcacatcaccccagtgaccccagacttcccactagatccagctcttaagcttctagcaccttctaatagtgtcacagactaggtgacacagtcttcaacacatgggcagttgtgtgttttgtatccaaactgtagcagatggtttagctgtccaccatggtactaagatgctgaggcctgatatgttgaagagttctgcccagaaccaaaaatgtgtaatcagagcaaggggtgtggtcagccagagcaggatttttttccccatgtagaatgtttgtttagacacccaccctcaaagaagaatgcgagcccacaggcatggtcttactacagtgagcaggtgaggctcttcagaggtgaagggggctggactcatcactcattggtactttgattcttccagggtacgcaaaaaatatgtctcccctacagtcccacaaaaacgctgtctgtgaagtccatcttaaggtgagtattcatggacagaggcccatgcaatttggaagtctgtatggagtgcctgtcctaggatccagtgctttcccttgattgacatgccaggcattcccttctagagtcttcaaggtagccccagatggcaggacagtcattgttacaggtgataagatggaggttcaaagagggaccccacagccaacatcttgtacatctgtctggtcatggctcctgagcatctctctaggctgcattctttacccactgctattttttccttgtgttcacttggatactttgggtttaggggggaaaaaaatcaagaaatggttttcattttatttttatactttgcaatagaaacccagatgtcagcaacggctccctgggggatatgctttattcttcactgaacagcaagtgaaaggattgccacatctggctgctgcccctagcttcctacctccctctcatctccacccagatggagcctgtcactctgtccccagataagatatgacatcctagcaacagtagcttctttgtcagacactacagcattgccagcatttcctcagtgactctaactcagctgcacaatgtcgatctacagttgtctccattcacctatgaggagtcagggcctcagggagcaggaggggttctgcagagctaggaaactacgagatttagacctaggtctctatggctctgggtttggaggtaaagggtatcatagaccttatgaaattgccaatgatggacaataagtaagtcaacaggaatctgggagaacagcgaggagtccctgatggctacctctaactgatgagtgccctgaggggacagttacacatggcaattggtgaagttcgtggattctctcattctccactcactcgctgatctgtttccagtgtgtcaggcccctcagagaatctaccatgatttctttagataagatcgtctatccagagaactatgccttactccctattgcttcagtccctgcctcactggctcactctgtctgctctgtttcagtgccatgaacctggacaagtttgagaaaggacctagggaaatttttcatcccgagatacaaaaggtaaaggaagctgtggggctccatgacttcagaacttgcatagacttgatctcaccttgccaggacagtagggcagggtagtctgcccagggagaaggaggtgtgctgtcataattgggggcaggttatcaggtatatatatgttttacatacatatacacacatatgtatgtgtgtatatatatatatatatatatatatatatatatatatatatatataataaatttagctctgaaaacttaaaactgcagccatcctcactaggatgctagtcaccagagcaaagctaagcctcgaggaggtggcctgcatcagagctagatggcatggaagaagctagagaggcagcctggagttgtgtccaggaggcaatggggcctgtgctgagtgagggaaatgagtccgtttgtggggaaataactcacgtgagctgtggaggactgatcagaacgggtagtgtttttctgtatgccttcaaggtgagctttcaaactgaggccattcattgcctttcgacttagctcaacccaaacatatagaattgaatattctcatgcctttgctttcatttaatttgtaaaatagtttgttcaacgatgggaactggcatggtagaaggggagagctgtctcctgtaagatgtcttctaattgctctctgttctgcaaggcacctgtgtgtgnnnnnnnnnnnnnnnnnnnnacaaaacacaaatagtatttgtaccctgctagaataaagtcaggcaaaatttaatctgttagatttaactaagcaaattaagctgtgctgcacttaaagtgactatggcggccttaaaacaaattagaataataaatatatcagcagcaacgtgcctttagtacttcagaatacaagttggattgtttaaatacaggaccatatggcctgtgttagcctagaactcacttcctaactcagggtggcctcaagctcatgtccttccttcttagcctctggaggatgagcagcattaggctatgagaacagattcttagttcattccctctgatcatcacgactagccccctctaaaggccccgccccagagtcctggagttgctgcccaggggtgcctttctctcacaacagtcacactatcagagttgtcacccagcttctaacacattattgttagaaaccctgtcagtcacaggactcatagggtgagcagaagctggactggtctcagtgtgagcaggaagctgctgtccttctgcctctctttgctagaatgcagtggcatttttcttgacccaaatccttccagaagcaatgtgtgtgattaagttggctttgaataagtgggagaagcgggtatgtgtgtgccaccttcctgaccctcgccaccacctagatagttgtaggtctagatagttgtagctaactttcctgatgaccatggattatataaaaatctacaggacgaaatctcaatgtttaaagcatttcttggctttttaagtacatgtgaaattatgcactcgtttttctttggttggttttgtttttgtttttttgaaacagggtttctctgtgtagccctggctgtcctggaactcactctgtatatcaggctggcctggaactcagagatccaccagcctctgcttcttgagtgctaagattaaaggtgtgccctatcactgcctggaaaatcatgcactcttaaatctaatattttgcttttcttaaacttaatattagcaacaaactaatgatcaaaatcaaaattccattaaaaaaaaaaaaaaacaataccaggagctggcacaagtttgaagactgacttcagatccccagagcccacttaaagcagtagctggcatccatcgtcccagcactcctgcagcaagatgaagggcagagaccggaaaatattcagggcctgcagggcagctagcctgtcacagtggaaaaaaataagacacacagtctcagacaatgtggaacatgagaacaaacaccacagcttatattcttatatcacataggatctgcagcacacacgtgtctacatatgaactcaagtatgtacacaaacatgtataaacagacacaaagaaaaatcatcaataagactatattaagaaacaccattactgacataaaatagaccttccaggttgaaattcaaactggaaaacaataagaagagacctggttggtacccacaaatccagaaataagagttttgttttgttttttaatttttgggtgctgtctagtggggcattggtagaccacaatgcctggcaggagcaccctcttctaagcagatagaatccaaagcaaggattcctgcaaaaggaagtgtggcctggcagcctgtggcgtccctcctgcctccagggctgaatgttgagaccctggggactcttgttgcaaggctgctcccacagcctggctgccaaggaaagccctgtcaccaggccaggggctgtagcaaaatgccccagttctgagacttgctggactaaaggtagtcgggacgtccctcatgttttactcaccgtgactgtgcccttacaggtctcagaggaacgaggccaggtgaccttaacccaggccctgctgaatctccaattccttacctgcaattctggagtaatgggcttgcatggccgggtggttgtgatcaaaggaaattatggaagagagaatattgcagtgaagtgtgtaatgacatgcaaatatgaagtgtgtcccaaagtataagacacagagcaggcttgttttttccctgggattcagatggctgaattctgaacaaaagatctctttttttttttttttcacaaaggaatatgtgtttattgtagatgttatttttttttccattttttattaggtatttagctcatttacatttccaatgctataccaaaaagtccccccatacccacccacccccactcccctacccacccactccccctttttggccctggcattcccctgtactggggcatataaagtttgcgtgtccaatgggcctctttttccagtgatggccgactaggccatcttttgataaaaagatctcttatactacaaaaaaatgaaggattttgtgtgacttgcatacttctttaggaattgtcagctccccagttgacacagaggatgagggtcccttagcctcatccactcctcttttgggcctcttcttctctgttctcattggcagccatggttttccaagatctgccttcccacatgcactcacccagtgacccctatcagagcctttggtatgtgcttcccagcttcttcagaagttttctgtgaagtaactgggcatgagaagggactgtccaaggtcgtatgaaaggcagtccccacgctcacactgtcattttccatagtgacctgcacggggcaaaatagtgattatccttgagtaaggaataagggatagacacagatcaaatactttgaacccacacagttgtaggtagccgagcaaggactcaaagccaggctcagttaggctcctcactgtctcatgctgacctcaggtcaggagtgggtctcttcaggcagctgtcttagtattgggcaagtaatgggctgtgtgtaaactgacatcttgaccctggctatcagcctttggcacccatgttgagctctgtttctcaatcttatctccttactaaagggttattgtgttgaagcaggaagtgtgcttggtttagggagggatgagccctactgcctgtcagagagctccctgagggatgtgtgggccagccagagttttgtcttctgctgtttacttttgtttttgtttcccttaaagagagatcccgtaaccaacttctattatgtccaaaacgtcataacatctaattgtgtgactatgtaacagttggctttcacagaaaaccaaactccactaattaccatgacatataaacataacttctgaatctttgcttgacaggacttgctggttctggaagagcaggaggtaagtggtttatgaactgaacgtatatgtggctcactgtggcacagcctccttcccgagtcagactggtgtgcatttgcagtgggagcttgttcccacaaagaggcttgactaaaggggctttccaaggtctcctgcacaactttccatacagctatttataaatagacaaatatacttaaatctgcatacatctgtgaatatattgtaaagaggctcattgccattcaagtaggatatctgtgcattagccacacactcttactatcccagatgccgaagatgtctgcaggcttcattctgttaaccccattttaagtgggtgtgagtgggtgtgtccacatggctatgtgtgtgtgtgtgtgtgtgtgtgtgagagagagagagagagagagagagagagagagagagagagagagcatgttatcacctgataatgcatagggaaatgatggtttgttcatattacccataacagaaatggaagtatcatttatctagttgcttgggtcaaacttagtaaaatcctaactcctccatttccctgacacccaagtctaatccatcacctccctagttgacatatctttataaaatgtcctaaattcaaatgtgtctcagtgcatctgttatgagcacttgagcgtggtggcagctcccacttcatatctagcctacgctgtacaggtcaaatctctctttctcaatttttttttttttttttactaaagggctgtttgcttgaagaggcaaatgtcccttgctgataacttgggaaggggtgagcagaggtcatcattcatgagagctttctgagagatgagtggcccaagcattcccatttaaccccacagctagaatcagttgggaacattgaccttgactccagtccatcctagtgataaactatgagttgtgatgaacggcaagaccaagaaagcctaggaaggaacagtggtgatgctcctgaaagattagctacttagtgacgtgaagttggtaatgtgatgcccatgctttatgtgttcacgattgcgcagactgttgtccccacaggagatctagtgtcctgtgctgtagtacacaccggggagcagtgaactgtgaataggcagaaccctataaatacagaaggctctctgtcttagtgatagacttaatgaccaagagttgggaaggagccgggcgtggtgacgcacgcctttaatcccagcactcggggaggcagaggcaggcaaatttctgagttcgaggccagcctggtctacaaagtgagtttcaggacagccaaggctacacagagaaaccctgtctcagaaaaaaaaaaaaaaagttgggaaggaaagggtttatttggctcatgcttgcacatcactgtttatcactgaagtgagtcaggacaggaactcagggcaggaacctagaggcaggagctggtgcagaagccatggaagggtgctgtttattactggcttgctcatcatggcttgctcagcctgctttcttatagaacccaggagcaccagcccagggatggccccactcacagtgagatgggccctctcccacaatcactaagaaaatgacttatagccacatcttgtggatgtactttgtcaaagggtccctcctttcaggtggctctggctgtgtcaagttgacataatactagctagaacactgcccaagcaacagtatcaaggaactagccatggtgttttaaataaggcaatccttcctcggttccaatgattcttctggattcattgggactttctgctcagatttcacttttcatagaaggaatataatttggaatattaataccatagataaaattagaactagaggggctagtgatatggctcggtggttaagagcactgactgttcttccggagatcatgagttcaaatcccagcaaccacacggtggctcacaaccatccgtaattccaaacaaacaaacaaacaacctatggaccggagccagtggggatgctggagtgagcagagggctggagcaggcaggctggagcaagaaggagaaagggagtggggattagaactagggactggagaggtgggtcaccagttaagggcactggctgctcttactacagaagacttgagtccacagtttctagcctccacacagtgacttacaaccatctataaatctagttccagggacttcaatgccctcttcagatctccacaggcaccaaacacacagacatgcaggcaaacaaatatacatataaaataaaaataaatagattttttaaatttagaaatattttaacacctaaacaaatagaaatgacaaatgtagcctgtttgtttgtctgagcaggactgtgtcctgagggaatcagtaccttaactctccaaaaggcagctttctccagtggcacagactgaacttgggacctagaaaactccctacatccctccagatccaatgctcatgaaaagctgatgtgtttagtgacttattccaaagtggtccattgtgggttggagctcagtggaagagcatttgtctagcatgcatgatggagccctgggttcagttctcagtgccagaagataacaactcagagtcatctgttaggatcaagtagtcccagatcaaactacctctcctaagctatgagacagcttctgaaaacagatggatattttctgctcatcaagggcatcatctgagaagccttagacagcaggtaacttcagtaaatcctgtcttagttagggtttccattgctatgaagagacaccatgaccaaggcaactcatattgggacatttaattggaactgacttacagtgtcaaaggttcagtccattatcatcatggcaggaagcatggcagtgtgcgggcagacatggtgctggagaaggagctgagagttatatacctttatccagctgcaaccaggagaaaactggatcctcaggcagctaggaggaaggtctcaaagccactcctacagtggacacacttcctccaacaaggtcacacctcctaatagtgccgctccctggaccaagcatattaaaccaccacagagccccaagacaactttcctggaatgtccacctgaagcagaagattctatataatttctcatttaaactggggctctttgggaagtattaataatagctggacagcagaaaaaggagatgcagaccaggttcatcatggcaacctggaatcatgctcttctccctatcagtgaccttgaaggatgaaaatcttctcattccaggatacctagataatcccatcctgcatccactttgcccaatgactttgtagtgcttcatcctggcctgataacgtgtttcacaactccatcccctccaaggcctcagccaggatgctggtagcatgctgccaggctcagaatatcatccccatgaagtttcttaaagttttagccactgacatctctgtctgcactctcagctttgctcagtgcagacctgtcttgtgaatactatgctattgggaagagtcaaaagccaaaagaccttgatcccaggtctgcctgctgtttgcttatgaccagccttggccaaatctcttgttcctggacttctctgtctgtggcctgtgggtcctttctggtcctaatgagctgctagcatacctaatccttctgtcctctgcttactgtctattggctcagttggacccaatgccaggcttcttggaagcctcccagttagttccttttcttcactggttcttagagtctgtttcttggaccagcagcaaggacatctcagggaaatctttttgatgcaaacttccaagccagatgcaagacctactgagcgtggaacactgggctgggagccagccatctcctagcaacccctccagggctaccaatgctgtcaacctggacaccaagtatagagggccactgcttcactgcttcagtcttcctatgactactccagaagggctgtctgctagacacattgttagctgctttttgtgagggtttagaacagaagagatgccaacatcttagagatgtgtggctgctgtcatcactccaaaaacagaagaagaaacatgaaggtcatggaaactcaaaagaggtcgaactcctgacagaaccacagagattggggctgagagatggctcggggttaagagcaaatatgctgtcctcacaagacctgagttatgttcccagcagctcacataacctcctgtaactccagcttcaggggatccaacacctctaaccccacaggcacacctgtgctcatgtgcacatgctgacacacacacacacaatttaaaataataaaaataaacctttaaaagtttaccaaaaaaaatcctgttggaaactggcccactgataaaatgcaagtgtctccgtccagctttgctgttttacttgctgcttatgcacagccatgagtcacacttactcgtcttccccactgtccccagccttttgttctgctctacagattcagtagtaaagtatgtgtgatcttttttttttttaaagatttatttatttattacatgtaagtacactgtagctgtcttcagacacaccagaagagggcgtcagatctccttacagatggttgtgagccaccatgtggttgctgggatttgaactctggaccttcggaagagcagtcgggtgctcttacccactgagccatctcaccagcccagtatgtgtgatcttaatgggaaagagatacatgtacatgttcaagatcagaattccagtggggacgggggtgtaaagagtgagcagtgctgtggtggagggctgcattgagaggtgtcctctctggaagttgctgatggggctgaggcttgcccagcagggaagagcatcacccccaagaactaggaagcattccaggtatacggtcaggtggaaatgccctccctatgtatgtgtctatctagaaagccactgttacagaacagcatgcatctgtctcccaggtgtactggggacagaggagagttcagaagcacaaacctcagacctgggttttcagattcctcttttcctaagtgtgtgcatatgctgtgtgtgcatgtgtgggttcacgtacacacatatacggatgtcttaggttgatgtcaggactctttcactatccatcttctaccttattcattgagacgggatctcctaatcaaatgcaaggctccctggtacgtccacttttgttagccagcttgttctggggagtcccctttctctctgccttcctgaagtaggatggcaggcaccttcacaaacctaccaggcctgtctgtgggttctagggatgtgaagtccagttctttgggcatgtgtggtgagcactttaatcactgagccaccagctcaagctgggctctcaaactcttacttttgccattccacctctgaatcccagcatcttgcattgacctctcacctctggccccactgacccccgacaccttgactgccaacatccagaacccttcacttagtggtgaatcaaacagccttcttgtattgatagtcttccaacaatggactcttttattattaagtaattcagacatacacaaagtatagataataaaatacaaattgcctgcctagattaaaggcaatatcattagaaacctagagttcaagggctggagtgatgcctcagccattaagagcatgtgctgctcttcaaagaacccagacttggactgactcacatccagtagctcataactgcctttaactccagttccaagggatccagtactgaattctagcctccaagggtacctgtacttatgtggtgactataaccaccacataatacagcattataatgaattatggtaatacaaacacataaatgaaactaagtcttcaaaaagtaacagtttgaggccctacttcctgctccctgactccacccctctgtctacctctcttctctaaagcagctaacatctcacattggcacttgtcatttccacagggtcagattgtatcagttgtctgcatagttgagaactataaactcagactgggaatagccactgtttgcttggcttgctttgtctctcattcgaacatctggacttgttcagattaaatatcttcaggaatgggggagtgagcttttcatataaattgcccacaatttccatatctatttctagaagagcctaccagacgtcagcctaagattgttatgtttggctctcagttacaattagctcccctgctcttctgggaactgttgctgttgcatagatcagaacatggtgccaagcccatgggtgcctgtggccatttctcagaagcactacgatgcccctgcatggacctagcatcctcctgatcccatcagtaatgaaattccaaatggattcgctgatgcaagcatggatcacctcgtctctatgctatgttgtaacctacaaaaaaaaaaaaaaaaaagagtgactcttgttaacactggtcagtactggggccaatgggaggaaagaatcccccaagtgtccactctgctgaccacagtgatccttaatggcaaacactgtagcttataactaggtgtgctttagtgatgaaactaactggtgtgtcttttgctgtctcgttgtaagggctctgtgaatttcaaatttggggttctttttgccaaagatgggcagctcacagatgacgagatgttcagcaatggtgagcaagcatcccctctgtacccccgccaagggcaaccctgcctttgactgcctttcccgccgctgaaaccaaatgtctgcttgggctggaatctccaataccaggaggcagtttacggaattttgtaaggtggttcttgatcagcttcagtcatatgcgtacgagtccctgcagtgggcactggagaacatagccaggggtgtggggaacacacacaagtttaggaaatctggttctacagagtgcaagatcttcccttgctgcttctggctgagttactataaagacagtatcatcttcctatatttgtgtctttcatgttacaaccctgtctatcattgggcagagcaacaatagccccttcattcctcaatactgcatgcccaaggtctggttcacctgtctgtttgccttcccttgggttcctgaaaattacaagacttccttatagcccttgggtaaaaagtgatgtgacctcatgctttgatactgtgcacatcaacagcaccattatctgtgacttctttatggttaaaaaatgaggaccagagattgacatctgtgccttttcttgcagaaattggaagtgaagcttttcaaaaatttttaaatctcctcggtgacaccattactctaaagggctggacaggctaccgtggcggtctggacaccaaaagtaagcattccccttgtcaaaattagtaacttgtcaaaataagtaattctgttacttatacccaagagagggaaacgaaagaaccagaaactggagagcctgaggattatcccaggatgacacgatcaaggttactgagtctatttgttggctttataagactaatcagcccttgaaacccataggaagcactaggagacacgatcagccaatacacaaatgaatgacatttccatcaacgaaggactacatctgttgtggaatctcatgaggttatagagcctggtaacatagtcacaagtgcaatttgcctcagtgagagtcacacaggaaagttgccttccaacacaagtctccattgtcccatagctgcatttaccaatgagcaccatctgtatgccagaaccaggctaggctcaacatgacccctgccttgcaaggagcctatagtcccctggatggcacaagcgccagtcacgtgagtgacggttatgaaatagcttggcaatcagtgcttacaggattgagttggcgcagagagtgccacgggcactttgccgactctggggattacagaagacttctctgggggaacttgggagtgatgagtgggaacagttggagagtctggagaaaagaatttcaaacagggagcatctgtggagtccctgaggctgaaagaacatggcgtgctagaaactaagagaatggctttctggctggaaggagcaaagggaccaagaaagttgcaattcgaatgagagacaaagcaagccaagcaagcagtggctattcccagtctgagtttatagttctcaactatgcggacgactgatacaatctgaccctgtggaaatgacaagtgccaatgtgagatgttagctgctttagagaagagaggtagacagggggatggagtcagagaacaggaagtagggcctcaaactgttactttttgaagacttagagaagagaagaggtggccctgcagggagtttgaagtccccttgcatgtcactgaggtccccttagggcagatctgcagggaagataatctagagggaacaggccagaggagcccctagagaaccagatcccacagtctaaatgggggtaaggggacagctgtcgtggccagggaacagctggctggcagggagacaagtgtatgaattccagcactgagaattcaggcacagggttccatgatattagaaagtggagatagggaggaagaaggattctcatagggtccctggatctctggcctgaagtagctggtagagagctgggttggaagggaaagcccgggaagcaacgaggtggatgaaagagactagatggcaagctcaggctctagctgaggagcatttccagcagtttgggtttctgtgttagtcgctttgtttgatcttccgtcaaacctcaaagaaagtcaagcaggtgacacaggctcttgtagcctaaatgtggcagactttcagtccaggcagcctgactacctaacagcttttcttcctagaggtgcacacagattcagagcatgacagccatgtgtgaggagggctgtggaaaggccttggttaccaccttccccctgacatgctttttcatgtgtgtgatgtgttcctgagcaccatggtcagctctctgctcactgtaggggtcctgagtaccatctcctgagccctctgatcaccaggtcttctgccaggttaagcaccttgcaaggactatctcgctgagtcttccctgcatccatttccaaattataaaacaggataagagaaaaatgggatgacttaccaaaagtagcatggggtctggggagatggctcctctggaaaagtgcttgacatgtaagcatgaggactggaggttaattccagcacccctttttaaaggccaggtgtgggggtacatgcttgtaattccagcactaggggagatggagacaggaggattcctggagcttactagacagccactcaagccaaatcagtgacctccaggttcagtgagagactcagctcaaataaataaataaataaacaagcaaatatagaaggggctggagagagagagggctcggtgattaacagcattggctgctcttccagaagacctgggttcaagtcccagcacccacatggcagctcacaactgtctataactccagttctaagtgatctaatgccctcctttggattccatgggcattgcatacacatgatgcacagacatacatgcaggcaaaacactcaaacacataaaatttaaaaaataaatatttttaaaatgtattagtccttggttcagtcctccaagatttgaaataacttgcacaacaatatgtaattaacatattgctttaaatcaaacagccaaactttaagaaaaaataaggtagagagcaattgaagcagatactatatatagacccctagactcaccacacatgtaaacgctaagtaacaaagctttaaaaatcaaattacaaaagaatgataaagcattggggagtggaaaggagtaacccagccagtgaggactcaggctggttcgtctacctccagagcctgcgcctttactcactgtacagttcttcagaacctcaccttgactttttgagccccacagcttgtgtgagctgtacccttaccccacggccacgggaaggggagggactgcagcacgagtaggagcctcgttcgaagtaaagagttaacctcaggcgagcctctcctgctccccacaactgataaaccaggtctttgagagtgtactgggagcatgccttcatctacatgcccgtgtaaaactctgtgcccactgactgtgttcttgtgttttacagataacaccacagggatcaactcagtctatactgtgtaccaagggcatgaggtcatgtttcacgtttccaccatgttgccatattccaaagagaacagacagcaggtatgtgtgatatcgggctctccgaggacacaaacgatcatgtgactgaacgtggatgagcactgcagtgctttatacaattagagacgaggtgtgttaccgtgagctccacttcagttaccagctaccaattcaggcactttttaatgtctgtgtgaactgcaaacaaacaggaagcctattggtactgcctctgtcatcttcaagacaggatcagagatagtagtgagcctgtgagtgtacatgtgtaannnnnnnnnnnnnnnnnnnnnnntgtgagtgtacatgtgtaactatgattttaaagactctacgtctatgctgcattgtcataacaaaatacctggagcctgggaacgttataaagaagtttatgtagctcaatgtcatgttgtttcaagagcactggtattccgagctctagtgagaccctcaaggtggttagtatgtggtacagacaaagaagaaatcacaaggcatagaggaagcatgagaaacccaggttaggttacagacaggcctaactgagcaagaatgaactcccatgagaaacatgttaaccccaaccaagaccttatcacctcacaccaggctcccctctaaaggcccccatctcttagctactccacgcttgcagtcaggcttccagtactgagaggtctgctcaaaccataaggagacaccttgcaggctggtctgtacttaacatgtcttctccctgtgacttctctcagtgtgcctttggccttgtcaaaattgcctctgtgttaactcctgctgtgacgtccttagatggcagagtgtgataattgaagcgtttcctccccatgttgactttggtcagtggcggtttatcacagcaagagaaatcctaagacagatggttgtgtggcattagaagcagttttcaggttgaagttgaaggtaaccatggctgtctacatggtctggccatgctgggttgttccctcagtgttctcctttcccaacccagaggttggccattttcaggagaaaaaaatccaaactgttagaatttagatacaaaaaatatatgggatgctgggtttggtttggtttggtttggtttggtttggtttggtttggtttggtttggtttggtttggtttggtttgcctgcatctatacatgtgatgtatacacagagataagaacaagtagtgtgagtccctggagctgaagcgagggatgttgtgagtcaccatgtgggtgctgggaatcaaacctaggtcctctgtaagagcagtaggtactcgtaactgccgaggcatctccccaggcccagctactaggttttgacaggtgagatttggagagttatgcttagcttgtataagactcttaccacccttttatgcattgagagaaggcatctccatgaataaatgtcactgatgtaaatggacaattgttcagcaaagaaatacaaagttataaggggccagaaaggcttttcagtaagcatgtggaattctgatgctagtaaaagggtaagcaagcagtgggtcagcccctgggtgatgctgcagtcctggcaggtagaggccctcagggagaacatgcaggagggatgaaacagtaagtgctgttctattgtctgactggaagaagtggctgatgggaatctcgtaggctgtggagaccatgaaggcattgaacttgtccttgttttaggaagactctgctcaggtgtattaaaacatgtgtggctctcacatgtgtctgagactagctgtatgtaagatgtcttctctgtttggttgggaagacctatgtctcactgctaggccgcttcattggagaggatagaccacaccatcttctctgctatcctcaatgcttttgaccttttacatgtcaacagcagcatcagaaaactgatgctggggttggggttcgagggtggagcgcttatgtatcgtgtgaggtgctgggttcaagcatcagtgcctgcaccccacatacagcacacacatatgtacaatgggatgccttacaatcctctctccaactcccagaagtttccagtgctgcccacaccatacgacagatggagcagtagctacacatgaataaattatgtgcatgatcttttcaatatttatttaattttatgtgtattcatgtgtgcctgagtgtaagtgtgctatgtgcactaaggagtccacaaaggtcagaagaggcaacagacccactgaactgacgtgacagatggttgtaagccaccatgtgggtgctaggaactgaactgggaaagcagtcagtgcttttatccactgagccatctctctagctccaatgatccttagaaactgacatctagtggtttgcttattttcaagggtttgcattgtagtgtatagctgattctgtttgtttgtttgtttgtttgtttgtttgtttttaattatgtgtgtatgcatatgagtgtattacagagaggccagaagagagcatcagatcccctggagatagaaatacaggtttttataagccacaaatgttggtgctgggaaccaaacttggctcttctgtaacagcagaatgcccactcaacctctgagatatcttctctccatccctgttgttgtttttgtttttgaagacaccacctcaagtaactcagactggccttgaactcccgatcctcctgcccacctccagagtgctcgagtgcttcattactttctaactgtttcatgtgtatgggtatttgcctgcatgtctttgtgcactacatgtatgcagtaccctcagaggcaagaagaaggcatgagatcccctggaactgaagctacaggcagtcatgagctgcctgacgtgagtgctgcaacctcagtaagtcctcttagtcactgagccatttctctgggctgattaatctacatctaaccctttgaggaaccacatcatttccagaggggccacaccatgtcacattcccgtcagtagtgcacagagaggctgctcttcctcactccagccacggatgtgttattttataccgttatcctactggtttgcatggctgcttgtcttggcttgcacgtctctggtaactagtgaacttgggtgtcttctcctgtggttattacagtcgacatgtcgtctctggagaagtatccacttacagtcttcctgtttgtttgagtcacgttcactattgagcagtaggaattctttatgtattctggatcctgccacgcctctccctctcctgacagtatcccttgtccttagaggctctcagttgtggtgtgctctcactttctctttcttctgttgcctgttctttcagtgttacaagaaatcatttgagctgacttgcactcagctgttctctacaccttagcttccttattggtaaatgggaatatacgctatgactcaggcggggaccgactctccaggaatttatgatacagaatatgatacagacaggaagcatagccaagagccagttccacacatagaggactaatccacataagaatgacatcaggggctggagatggctcagcagtgacaagcaactgctactcttccagatgaccagagtttggttcccagcacccacactggacagctcacaaaatgcctctagctccagggaatctggtgtcctcttctggctttggtagacacacacacacactcacacactcacacacacacacacttaaaatttaatggaatcacaaaacttccgtggctgctgagagagaaagaacatgacagctaataaaaatcaaggaggccttcctggagaaggtgccatttgcctaagcttagacagataactacgtgtgagatgcttggccatacaaggctagacaagataagttggcaagtacagaccatgctttgcgtatttattgctatgccacaaaccactccagaatctaccagttaagataattagttgggagccggatgtggtggcacacgcctttaattccagcactcatgaggcagaggcaggtggatttctaagtttgaggccagcctggtctacaaagtgagttccaggacagccagggctacacagagaaaccctgtctcgaaaaaccaaaaaaaaaaaaaaaaaaaaaaagataattacttggtttcttaaggctttatgtgttgatgactcagcagagaagtcttctgctgtctcatggaggttctcatccactgcagtcaccagcagctgagaacagcagcatcctcagtcctccacggcccaacacaagggactcagggatccagggtagcagcagttactcagtttgaccagatagatggtcttgtatggagctagcaaagtggcctgttctgtcctgctgggtgcagtgttactggcatacaccacacccgctcactgctcacacattctttgtggtagctttcctgctttagggaccatgtaggtataaagagtccacacagtctctgtctctgaagctgtctggccttttatacaaaaaaaaagtgtcaaccgcatatctaggaactcattttggaaagacaactagggtcaaattagatagagccatcttggcactaagtatgaacattcaaatgagcagaggagagtcagaggtgtaggtcagtggaggagcactggggtagactgtttgaagcccatgtgcatgtctctccctcagacaccctcgtgactgcttcctgagctcctatgggtcccagaacaggtcagggtataaggaagcaacgggtggagggaacgttgtccttcaagctggtgaggaggtttgcactgggagaggagcccggtggcttgtcaaggccacatgacgtccggctgtgcagtggctgtggtggtttgctacagtgtcttaactgagtgacccttgtcagagcagctcttctcaccatgtcatttctcctcctcacaggtggaaaggaagcgccacattggaaacgatattgtcaccatcgtgttccaggaaggagaggagtcctctcccgcctttaagccttccatgatccgctcccattttacacgtatcctgggtcttcataaatgctcctgcccaccagcctcctggggcctcccaggacatgtaataggcagcgtgacacccacctgagcggctagtctgacacccgccaccgggcagtgtgcccaagtgctgcgtgtttctttcttgcccgcctctgaggcagcggggaggagtcctcggggactgtttcattgtgtttctcaatttatacacacacaagatcccttcaccacaccctccactaccctcccatccttcccctcttctgaccaccccttcttcctaacaaggcccctctgctttctcacctgggtgtgtcccacctgtgtctaaccagggatgcagttaaagcctacgcagatggtcatttatttgagtgagagcagctcatcagtagctacaccactgagaaaatgacttttttttaaattatttatgtatgtgagttcactgaagctgtattcagacacaccagaagagggcatcagatcccattacagatggctgtgagccaccatgtggttgctgggaaatgaacttaggacctctggaagagcagtcatccactgagccatctctccagcccgaaaatggctctttgtaccccagcagccattaactgcctatagctcttcagggaggggcagggcctcaggagcccctccccatccacagtgggatgttgatgggcctaggccagtacaggtaggcactggctgtgagtttgcaggtcagaagacagtgtttcccagctcacttccggcctgctgcctcagacctctgggtgctagggttacaggagcatgcgaccacacccacattgactttcagaatgcctcctctttcctcaggaagtctgtgaagtgaggcaagcttcctattatgaactggtaatgaacaattgtgaaggataagtagtgacccctctgggaagtgacgtcaactataaaatctgttgccgcatgcctgtagttccaacacactgaaggcctgggcctgtgtgtgtgtgtgtgtgtgtgtgtgtgtgtgtgtgtatctgggcatgcagactgacacctgtaattacagcacccgagaggctgaggcaggagttcactgtgagaaattattctaagcctgatactacctgctaagttgaagtatgctgcggcatggtaacattaacaatgttacgcacatcgcctaaccctgcccagctcactgtctgtagatgcccgtggtggggctggccctctcaacattgctcagccagacaaccccagggcatgtgttcgtcctatctgccagacctcagtcacggcccacttaccatggttacaggccaggagagccaatctcaaggcagcggctcagaaggttggccacagtaaggaaaggacatctagtgggcattctcagaatgaagttgagtctcattactcctgttcccagagaccccgggaaaaacaccgggggacagaccactgcgcatcaggtgcctgccaataaaactgacttgtctcaagtcagacaacagagctcacaaggaggtttttaaaagttgaaatggccaaatttctcccacaagggtaggggttataattaaggtgaagacacaccctccttggctcctcctacttacagcataatgtcccccatttattgggctgtggcactaatattccccttttcctggtgacagaaggcttctctgagtgaagcccagaagacaaggtagctagatagctagagacactttagggtgctccctattagacattctgcacactggcctgagcacatatgcaggtggtcggtgtgacctcatcccgcagagtacaggagtggctgcacccgagtgttgctgccttcagccccaggcagcagcagggctggaggtgagatgtgagagcaggccagaggagcactattgggtgcggcagttgtgctctttgatttatttttaaagagttgtattgagattgaagccccatagcatatcatttgtccttttttcttaaacgctggtggaagccaggtctcccacaagtcccgaaagtgctctgccactgacccacagcccgagccgctcgttgagcttcatcccaagcacaggcgcctctgctcagcagctgccagcggctacactggctcggtctgttttgtctgccagaggcaggaggagagggaaagtgtacagcagaaacatttccattgtttccccgtgtggtggaatagatgagtagccggcgccaggagctgctgctctggttccctggctgcttgactgtttcatggatttccttatacactcccatgacagctgtggaggcttcacctaaccttttcccagtataagaccacacagatgctaacactaggcacagggctcccctgtgtgtgtgtgtcccttgtaaaggggtggagttttgtcccaacttcagagcagtaggtacctagccacagggaggcctgctcaagaacacttctgcaggcagggttctcagatccagctctccagtgtgaacatcaagggtattgatgagttgccttgactgtccccacagatatttttgccttagtgaggtatgaccagcaaaatgacaattacaggtaggtaaagaccttgtctctcttcttgctctaattctaaaatttgtgtcaccagtcggtattggccctcaaacgaccctgatgtgcttgcttctggggttcattaggtgcaatctcaccttctagaatattctgtctctctcttcagggaaagattttgctccatgtagtattgctatgcacagtaggcccagggttcagggttagtttggtgtttgtactttacaggagaagttgtctgtctgaccttggtcagagtgccccttgcctgctgtccttctgtttctcagaatgaatttattagaagggtcctgtgaaagtactgtcaagttccaccacttaggagtagagaggtcacacctcagctcagtcacttactgactttgaggatttgtgaagcatgtctgtccccgggcaccttgagcctagtgtagagtaagaacagtcacctctggcctgctcagcaagccgtgaaatccagagcaccctgcctggtatgcagcagccgttcactactggttttcagtctgtccacaggctggtgggttagaccctaaggcacggctgctttcctaggagagagcgctcagaggtgacacaggctcctctggagtgaatcttcctcacgtattacataggtctctgaacatattgacttgcaaaactgttactgacctttgaagaagagagctgactaactctggaatgttctcaacataggctgaaaatattttcagaagaaagtgtgccactttttggcccacccttgccatcccctccggtgtttactgaccaccaggaattcagggactttttgcttgtgaaatgtaagttgtcattttgaaatgtgctgttggttgttacaagaatttgttctctatactctcccaggccactgcatagggaagtgttgttagaccattcacattcgattcatccattacccatgtttagtttctggtaacattgggtaggctttcttctgggttctcatctgctcctcacatcctgcccaaggctttgcaacttatcgcttcaccacgccggtgccacaggcctctggtcagcctgtgtgccctggggttctgataccatcattctgagtctccatcattatatatgtgtgtctttgtgaaggggtaggaagctatggttatgattcacacttaggaacagagagctgctgggctgtacgagtgtgcaggcagatgggttgtgcatggagtgaagagaaccttcccaccctgggccacaagagctggagagccagtgcgcatgcacctcagctcactgctacctcccagggcctgcctctgagctctcctgtctgacagacatgggccacacccagagcgtgcctgggccatcaggacctactgatcagcatcaagtcacttggcttcatccactgcagactcttcatagaagtctagtctgtcagccctggagctctggcagtgccacccagtctgtgccctctgcagccagctccagtctcctgccagacacagcaggggctgcagctgctttgcatctacctgcccctcatacccacacacacactgcctaattctgtcactgttaccatgtagtttgagagaatttggggaagctcctgtcctctcattgaatccatcttggttacctggccccaaggtggcatcagttgagcccagaacgtcacagaatcccacatcagtacacgctactcggcttctagtcttcaattgccttcagaattggccaaaactaatgctgcaggccaggcaggtgctggatgacatattgtcctttctttgtattctcttgtaaagattaacgttatatgtgtatgcttgagtgtgtgtatgtgcttgtgtatgtgggtgcccatggaggccaggagagaaggcactggattcttcccctggaaatgaggttatgagctgcccaatgtgggactgaggataaagcccagatcctctactagagcaggaagtggggtgttttgttgttttgttttgttttgttgttttgttttgttttttagtcaaagtctcattatgtagccctggctagcttgaatttactatataaacaaggctggccttgaactcatagatctgcctgcttctgccacttttgtgctgggattaaatgcttgggccactagcagcaagtgcttctgagcccctgagccctctctccagcctccgtatcttatctgcccatctcagtggcacttgaagggataaaatgttacttaattccggtcaccagatacatcctactctcagccaagatggctgacagtgctcgtccctctgggagcccctgcagaggtctccacatgctttgcaactttctcctggggacgaagccattaaggccgtgtagctgggtgccccccacatcattagctcccagctttgggccacagcaaggtctagggggaaagctctgcccccagcacaagaagcagcagactgcaaaccacttgacaaaggtgatgattctgttcctttctgcattttcaaaacatccagacctagaaattttcatgtgattcaagcccagggcatcaagtaggaagcaaggaacaaacagggagcagtcgttgcctccaaaggagtgaaggagccaggcccagtagacaagtgttcttgtctataccaagtgatagcacagctgggaccccagggcctgtagtgctttgaccccagagtatttagaggacaacattggggacccacttgcaagtggaatccatacatcaagatggaatagcaaaagcaggcctaggagtggcacatcctcagcatcctagggagaaatggaattggattcagttgacctgatggtaaagctttaaatatatcttggctgggaagaataacagtgcttttattcctagtaagctgaaggatctcttgagtttgaaatcagccaggctacattgtgaaatactgactttaaaaattatctaggaagctgggcgtggtggtgcacgcctttaatcccagcactcgagaggcagaggtaggcggatttctgagtttgaggccagcctggtctacaaagtgagttccaggacagccaggaccacacaaagaaaccctgcccctaaaaaccaatatatatatatatgtatgtgtgtgtgtgtgtaggctgcacaggcaacaacacaatagaagcccgagactagaaggctgtttgaattccacagtgggtttaacagaatagaggaagccagctaggttgaaagatccaaaatatctctaaatggttcaaaaaaaaaaaaaaaaccctcaggtctttcccttctgtcaaaattagttacttaaaatgtagttttggggtcaggcaagtcagaagcaagtggaaatttgtgagaacctgtctagaaaaggaaaggaaaggaaaggaaaggaaaggaaaggaaaggaaaggaaaggaaaggaaaggaaaggaaaggaagaaagttttttctgagatacaaatggggaaaatctttttttgtttgtttttttgtttgtttgtttgtttgtttgtttgttttttcgagacagggtttctctgtgtagccctggctgtcctggaactcactttgtagaccaggctggcctcgaactcagaagtccacctgcctctgccctctgcctcccaagtgctgggattaagagcatgtgccaccactgcccagcgaaaacctttaagaaagaaaaagaaaacaacttggcacgcacacttcaaaaacccctaagagaccccgtgtaatatacaagcccagcttggccccagcacacagaatgtatctagggaatgccttgttcccaacaagttctgcttttcagtctgttaacagacctcactggccctctgtatgagacaactaaggtgactacttacccagttcaatgtgcctagcactgtactgtgtgtgtgcattatctcacttgaataacagcacccctctgtaaaaataagatcgtacccattgtgtagggtagaaactgaagccccagaaaggtagaacaaaaatactcaaagactccacagctacagggagtggtgatgtacaccttgaaacccagcatttgggaggcagaggcaggcaggcaggtctctgaatttgaggccagcctggtctacagagtgaattctagaacagccaggactacacagagaaaccctgtctcgagggaaataaaagattagatctgttctctgctctggaagcttactgtgccacaagaacagggaggtaaacatgcctacagtcatataaatccgtacttcagaatttaaactggaagcactctcccatgaaaggaggttagatcaatgacatgctggcaattcctttagtcagttttcatcactgtggcaaagtacctgagaatacgagcttttggagccttcagtcatcacatgggtctgtcactaagagcttaaggtaaggcagagtatggtggccacaggcatgatggagggagacttctcacctcatggtagccaggaaacagggagagcaagagacatgtaggggggggcgggaatctgtccttcaaaggcactactctgtggcctgcttcctcaactagaccccacttccatgtgtctccactgctcaccagtaatcaaagtattatcccaccaggagcctggccactgatgagactagagccttcatggcctacgataactctgagtgattggatcgaccagctgggtccatgcccttgacgtgttgggagacactccatatcccaaccataatgctagtatcataatggctggtggcatacactgtgcagactctgctggcaaagagcactcttcaatagctattaatgacggtaatgtgcctcttttcacttgttttagtaattaacggtgaaaaagccactttggaaaccccaacttttgcccagaaacgccggcgtactctggacatgttgatccgctccttataccaggatttgatgccggatttgcataaggtacctgggtttcctttcctgtgggggttctggagagcacagtctcggccatgagccatgagcccatggtacttgctgcctagactgccctgaagcgaccacagctggcattccccataaagggaggtcgttgagtgtctgtgagagagaacaacgtggtccctacaaagcagtagcctttgaaattgggatagagatgggcagagtgtaggtcagcatcctggaagccaaagctgcgtgctcctggtgctgtccttggtgcttgcggtgctgtccttggtgctggcgccatagagcagatgacctggcagaaatactgattgtgaagagagaagagaggccaggtgccttcctggttttctagaggttttctatctggctctgtaatcaggcactgaaacagttgtctccactgatggaaagccacctcatgctggatattttgtaggcccagagcattgtgttccctgataagactccatctaccttctcttgtcacctccagcatctatactacttgtactatcttaggaggtcttcaacttgtgttttctcccagcacccacatagcaaaaggaagagtcaatcccacaagttgtcttctaacctctatataaatgccatggcatatatgcacacacacacacacacacacacacacacacacgtaatttaatttttaaagttttcctatttaacaagtgaataatgctcttaaaatttgatcattcattcataaagtcaagtaaaagtaattaacttctgatgatgtatgtaaatgagaggtgtcagtcactcacctagggagataggctatgaaaatgaactagaacatactggcccttctctctgcacatgacaccttttatagcatcacttgactcttggtctagttggtaaactctaaaaattcccagggaatgaccaggctagccccaggaccccacagcaaatcttagcagatcagggaggcttcagagaggccaccataatgaatcctcatgtcctcgggcctgagctaaagtattgttacccatagttgaagcaagtcccctattgagtcatctagcctactttctacacttccctttctgtccctggccacagcaaatgtgctaatcttatcaggctttgtggcccacaacgtcaaaggccaggtctgccaagtctggtggagtagtgagcactcagccagggcttgatgaatgctctagagggaaagaccaagtgccaagtaccctctgtgtactacctcactaatccatccctaccacactcctggagagcaggaatcagccacatagagactcagaagttaacactagggccccagggccacacagtcccagtggtaccattcccatggagtggaatgtggtgggttcctggggggccactctgtggaactggaatcctggagctgtgcaatgggtggcctggagctgtggaatgggtggctagtaaaagaagctgtgtttgctttggtctaaaggctgtgttctcagtctttacacagtgctggctgtacttgtctagactctattcctgtgtctgccatagtactgaatgaaacctggggatagaaatagtactctttagacagaggggtgtgtgtgtgtgtgtgtgtgtgtgtgtgtgtgtgtgtgtagacaccaaaagatgagacttgacaacagtctgaggaatcccaaccttgtttcctttttcagaatatgctcaatcggcgatcttttagtgatgttttaccggagtcacccaagtcagcacggaaaaaagaggaggcccggcaggccgagtttgtgagaatagggcaggtacgtttgactccacagcccctgagaagtgtggttggtcccaagtccctccaaaccagacactccaccaccatacttttccttcttttttagtttttttcgagacagggtttctctgtagccctggctgtcctggagctcactctgtagaccaggctggcctctgcctcctgagtgttgggattaaaggcgtgagccgctagtgccggctgaggctgtgttttccttgctatcctgctggccattcttctgctgtggataaacaccatgtccaaaggtgacctggggagaagaggcttcacttcctcttagagcttacagtccatcaccgaaggaagtcagcgcaggagctcaggcaggaacctggagccgggaactgaagcagaggccatggggggcactacttaccgcttcactctccatggcttgctcactctgctttcttacacacatcccttggtgtggcacctctcagtgtgagcgcccacgtcaattgttaatcaaaaaaattgcccacaagccaatctgaaggaggcatttttttcagttgaggttctctcttcccacatgaccccagctagtgtagagctgacaaaaagactgcctacctgca

SEQ ID NO: 818 - DNA, 973 bp, Mus musculus
atggagcaggaacccggcggggctgccgctgcgctcctgcggcagaagagggcggcgctgcggcgcagggggtgcagctttgagagtcccagctctgtctcagaagacctaggctgtagacgtggggatttcagtaggaagcattatggatctgtggagctgctcatctctagtgatgccgatggagccatccaaagggcaggaagattccgagtggagaatggctctacagatgagagtgcagctgctctgccaggcacttggcgaaggacagacgtgcacttagaaaacccggagtaccacacccggtggtatttcaagtactttttaggacaagtccatcagaattacattggaaatgatgcagagaagagccccttcttcttgtctgtcaccctttctgaccagaataatcagcgtgtccctcagtatcgtgcaattctttggcggaaaacaggtacgcaaaaaatatgtctcccctacagtcccacaaaaacgctgtctgtgaagtccatcttaagtgccatgaacctggacaagtttgagaaaggacctagggaaatttttcatcccgagatacaaaagggctctgtgaatttcaaatttggggttctttttgccaaagatgggcagctcacagatgacgagatgttcagcaatgaaattggaagtgaagcttttcaaaaatttttaaatctcctcggtgacaccattactctaaagggctggacaggctaccgtggcggtctggacaccaaaaataacaccacagggatcaactcagtctatactgtgtaccaagggcatgaggtcatgtttcacgtttccaccatgttgccatattccaaagagaacagacagcaggtggaaaggaagcgccacattggaaacgatattgtcaccatcgtgttccaggaaggagaggagtcctctcccgcctttaagccttccatgatccgctcccattttacac

SEQ ID NO: 819 - protein, 325 aa, Mus musculus
  VARIANT (1)...(325): Xaa = Any Amino Acid
MEQEPGGAAAALLRQKRAALRRRGCSFESPSSVSEDLGCRRGDFSRKHYGSVELLISSDADGAIQRAGRFRVENGSTDESAAALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKGSVNFKFGVLFAKDGQLTDDEMFSNEIGSEAFQKFLNLLGDTITLKGWTGYRGGLDTKNNTTGINSVYTVYQGHEVMFHVSTMLPYSKENRQQVERKRHIGNDIVTIVFQEGEESSPAFKPSMIRSHFTX

SEQ ID NO: 820 - DNA, 150130 bp, Homo sapiens
  misc_feature (1)...(150130): n = A,T,C or G
ccattgtgaagcttaaattgtaggtggggaggcggttgttaatcagattccctctttgtaattcctagtttgggagggagagtcaggaagaaggaggagtttggagggagcattctaggtgctaagggcagctcagcaaatgaaagggaataggagaaaggcagtatggctggagtgctgagcggggagtggtgccagactaggcaggtggttgggggtgtgggagtgatggtgaggaagttaagaaaagatgaagggtgtaggtgtaggaccagctggtggagataaaggtgtgatggatttcaattcaatatagaaaaatctgtttaacaggaagaagggaggacctgggttgtgggggtgtttcttatcactgagagtgtgcaagtagagactggatggctatttttcaagtatctggtaaaggatacacaattgcagataaaagattagacactagaaggtccttaagtctctggacctggaagtctctgaagtctcttctaacccagtgaaagagacagagatgagatggcttcatgggattttgtagaaaagatacctttcattggcatctggtgggtgggaaatgagttggtcagcgtctctcagggtaactgtaacaaaatcacctattaaatgtattttagtttaaaatttaggtgcttggatcccattcccgaagattctaattgaggaggtctagggtaggaactggacatttactgatttagatgaaaaaaattataaagcaaactttgaaacttttgcatggaacaatagagactctttaggaaatcatgatggtgaaggatttcttaagtcagaaaaacaaagaccataaaggaaaagattgaaaatgtctgcattagaatttgaaaacttatgcatgatcaaagatatcagaaacaaaatttaaaaagaaaaacaactatctggaagaagacatctgtaatttgttaacaaaaaatgggttggtattcagaatatacaaataatatctaccaattctcacgcctgtaatcccagcactttgggaggccaaggcaggcggatcacttgagatcaggagtttgagaccagcctggccaacatggtgaaaccccgtctctactaaaaatacaaaaattaaccagatgtggtggcacgtgcctgtaatcccagccactcgggagactgaggcaggaaaatcgtttgaacctgggaggtggaggttacaatgagccaagatcgtgccactgcactccagcctgggtgacagagcgagattctgtctcaaaaaaaaaaaaaaactaccaattaattggaaaaagaccaataacatacaaaaaaggagggggacaaaagatttggaataggcaaatcatggaacaggtagcccaaaaggccaataaggaaagaaaaagatgttcaagctcttgagctatcagaggaatgcaaattaaagccgtacctcagtgagacaccatttcatactcttcagactggcaaaaactaatgcctgacaatcccaagtgttagctagactgtggagcaactagaatgcatatgctgctcatgagagggtaaattggcgtactcacttcggaaagcaaatgtgacactatgtagaaaaaataagagtgcacacatcatgaccttgcagcttcactcctgggtatggaatctagggatatgattgcactggtattcaaggtggcatgtaaaaggatgttcattacagcattatttaaacattggaaacaaccaaaatgtccatcaataggagaatggaggatattgatgcagcaggatatcatatagcagctaaagtgggtgggttagagctacaggcatcaccatgaacaaatctcaagagcaaattgttcagccagatgagctagttgcaggaagatatgcatggtatagtatttacttgtgtaaatttttaaaacatgctaaacaatgcagtatattggaaatgagtaagtacatagtataaatataaaactataagcaggcagtataagtccaattagtgattgtttcaggggagggagagatgtaaatggggtcagggagaggtacacaagggttttaagtatatctgtaatgttcattatattattcttcattattctgtatcttgaaatatttgataataaaacaagttagagacaaaattccaggtggttctgatacacaggtaggtttgagaaccaagatctagaatcagtgcttctcagatttcaatgtgcatatgaatcccagggaaatcttgttaaaatgctgattcagtttcttaggtctggggtgggtcctgggacattgcatttctcaccagctcatatcaaaagaccacactgagcagcagaatcacaatgaccttggtgttctctaggaatctcacttcctagggattgcagaaacacctgttccaaatagtaggcatcccttcaaggtctgggcacagctgggggcagatcttgtgaatcccagcagggaaaccttatgaacctggagagatagactttcaagggatttccccaaagaagtagatctgcaggtggttaagggaggtatgccacaacatatgttgcctactgaattattttccttatattaagtttccgtttaatacaatttggtcatgcatttatagatcccacatggagtgatgtttcccataccaaattatactctgggctggaaaaccctcaagtgttgaccttacaggaaaagagaagccaaggttgctgtcactgaagaattaagaaaggagggagcaggtgtgcaaaacatcatacttcataggaaccacttagttagtaatgtttcccaggtttctggatgatgggtcttgagctgagaagagtgtgacagacctccccggcttctgctgtgggcacccacacccgaagactgcatatgctactgacgaaggggataaaaagaggctgttttacagtttgccagatttgctatatacatattgtgctttgcttgcacaatatttttgttcctgtgaagtcctgtgtactttgtgtctttctttcccactgcactgtaagctgtatgagagcagggaccgcatatctcaggttcagcacctggcacagtgcctggtaccttgtaggtactcagtaaccgtttattaagtgagtgaaagaattttcactcagatacagtattttaaattaaactttttattttgagataattatagattcatgtgcagtggtaagaaataacacagagacatctcatgtaccctttaccaggtttcccccaggggcagcatcttgtgtaactatagtaactatagtactgtattgcaagcaggaaattgatgttgatacaatccactgatgtttagatttgcccagttttacatgcagttttattacatgtgtaggttcctgtatttacctgtattcacagacaagatacagaacagttccatccccaaaggctctctcatgttgcccttttataaccacacctccctccatcctccctctataatttggtcatttcaagaatgaatcatacaatttgtaaccttttgggatggacattttccattcagcatagttccctggagattaatccaagttgttggatacattagtagtttgttccttttaattgctcaatagtattctgtggtgtggatgtaccacagtttgtttgagtatttgccctttgaaggacatctaagtggtttccagtttttggctgttatcaataaagctgttttgaacatttttgtgcagggtgttgaccatacattttcatttttctgggataaatgctcaagagtgcagttgctgggtcacatgataactacatatttcacttataagaaactgccaaactgttttctgaagaggcttagcttaaaattttatagtcccacttgcaatggatgactggtccagcttctccacttccttgccagcatttggtatggttactattttttattttagagatacgatagtaaaggcactgatagagatcgttattgaaaggagtcttgcagtggattgccacaagtctttattaatgctagtgaaccacataaatttcaggggcatatgtctgcatcagaaacttagtggacacaccgattctgtaggaggtgtgctttccagaattagagaaaagagaagtagaatgagaaagatgactgaaaaatggtaaacaataacttacaaatgtacttgaaagtatgtctgagaatgtatactggcagttgttggggggtgcagggagaagagaaagggaaaggaacccacctgtgttcaagtagagcaaatgtagtaatttattcacaattaatttattcaataaatatttatgaagtggcctgttatgaaccaggagctctataaggtacatcagggcatggcgatggccaagacaggtaagatccatgacagttagaataactagcatttatttagtggctactgtgtgccatatgatctctttcagtcctcccatggagacagatattgttttaaccccctgttgcaatgaggaaacaggctcagagaggataagtaacttgtttgaggtcacggtggtcatgtgtgatggagccgaaattcaaatccaggagtatctaaccactttatggttggtggatcttgctaagggatggtaaacttaagatcctggtacaaggaacacatggtattgtacccccagaaacaaaacaggggagcagggagctgtctggagagttagaagaatcaaagtgccctgatttcctgggtccccttttgttttggaaatctttctgcttacttcctacttcgtatgtctcaaaggtcttcaagaggacagaattgttccatttcattattagaagttaatgtgggccaggtgcagtggctcacgcctgtaatcccaacactttgggaggccgaagcagatggattgcttgagcccaggagtttgagaccaaccaggacagcatggcaaaatcctatctctacaaaaatatgaaaattagccgggtgtggtggtgtgtgcctgtagtcccagctatttgagaggctaaggtgggaggattgcttgaacctgggagtttgaggctgcagtgagctgtgatgctgccactgcactccatcctgggccaaagagtgagaccctgtctcaaaagaaaaaaagaaaagaaattaatgtcatcgcatccctgcttttctgtggcactttacttatcttcaggaggagagacagctggtcccttctgtgcaagaagctattctagcacctgttgttaggaggccttgggctccctacaagcctaaaactacagtctggcacatggtttagcttctctgtccctcaataaggagaatcccttccatctgtttcttactgtctgcctatcgtggagcaggggctgaggccttttcctagagctcctgactgttggtaggcttctgaacaactgcctgttacttctcacaaattctctctactggtctaggaagagtctcccttgtcgctgttgcccttaactcttctaccaggcctagccactgctgagtcctggccttgtggggtctgttgtgaggtcagcactaatctcagtgtcagttgagtgatgacctggatctctgcgtttggcttccccttgggggctggctgactccttttctttccttatcagttttaacaactcttgactctttggaggaggttgtcctgctttccaggaatgtgacttacatcatggaaatctgtctagcttctacatggagctggaaatctttgctctcatcccaggccatatttagagatttaacatggaggtcctcagctctgttcatgcctgcgaagtgtgattcagcatcctcacatgttaaattgccgaagcagaagggtttatatttagagcctggaccacgttgcctgtgggaaacttgaagttctttttggtacttgccttgttcaggtcactttctctagccaggtttcaaagtctcttccccttgtcatggcaacagggggtcccaggtattttctaggtgaggtcaaactgctaggccaacgcttttagggaggagatgtagtgctgaagcatgatgccatcctcagcgctgccctgggaagcctgctgcttggccctgggtctcccttactgctacctggggataaaaggcaaagcattttatttaaaattattttaaaatttagtaatcatttatgccaactttccaggtccctttctaaaaacctgagagggattcatattactaataagagctggctggatgtggtggctcatacctgtaatcccagcactttggaaactgaggtgggaggatcacttgaggccagagttcgagaccagccatggacacattgtgagacccccccgcccatctctacaaaaaaaaatttttttaaattaaccaggcatgtagtcccatctactcaaggggctaaggtaggaggatcgcttaaacccaggagttcaagcctgcagtgagctatgattacaccactgcactctagcgtgggcaacagacattgtgcttagaaccttgtctgctttttcttgtttattctttataaccctgctaagtagatgatattttcaattgcattgtacagatgaaggaactaattcccagagaggctgagaacccatatctgtgactgaagtgcgtgctctgagggactacattgcatctcctcccatggatagaaacctggattaagttagccttgtccttccttataaagagtgctacagaatggttaacaggttccccaggattcctgagtcatctggaaaaggaatatgtttcaaagcattgtttgtggaccgcctgcatcagaattcccctggctgttggttaaaatcacagattaactgacttacaacctctcggaatagggccagggaatctgcatttttgcaaagctcagactctaaagtctgaggaacatgtcctctgacatggtgtcagaattttcttcactgacacactaatcagtttctgggtaggcctaaaaccaacagtagggatttgggagactatactacagggattgacaaactttttctttaaagggtcagttcgtaaatagtttgggctttgtgggccatatgggtctctgttggagcaattcaactctgctgttgtaatccaaaagcagccatagacagttcataaccactgggcatggctatgctccaataaaactttgctttcaaaaacaagcgctgggctgaattgggctgtagtttgccaacccctgatctagagtcatcctggcccaccagccctctgacaacccctgtttgtggaacttattcttacactactttctattacctatggagagctgtatcaactaagataaaattgcctgatgtaacagataaaccctgaatcctagtgacttaaggcaataaaagttattgctcactcatatcagagcccagtgaggctactcctggttagaatcttctatgtgggccgggtgcagtggctcacgcccgtaattccagcactttgggaggttgaggcaggcagatcacctgaggtcaggagttcgagaccagcctggccaacatggtgaaaccccatctctactaaaaatacaaaaattagctgggcatggtggcgggcacctgtaatcccagctacttgggaggctgaggcatgagaattgcttgaacccaggaggtggaggttgcagtgagctgagactgtgccattgcactccagcctgggcaacaagagcgaaactctgtctcaaaaaaaagaatcttctatgtggtcatttaagacccaggccccttcatattgtggctgtatccctcttgggccccagagtcctctccattgcagctggcagataaggaaagagaccaaggattattcatgggaaggtgttttttttgttggttttttttttttttttttttgagatagagttttgctcttgttgcccaggctggagtgcaatggcacaatctcagcttaccgcaacctctgcctcccaggttcaagtgattctcctgcctcaacctcccaagtaggtgggattacaggcatgcaccaccatgcctggctaattttgtattttttttagtagagacagggtttctccatgttggtcatgctggtctcgaactcccgacctcaggtgatccgcccccttcggcctcccaaagtgctgggattacaggcgtgagccaccgcgcccggccttcatgggaagtttttaagggctgggtctggtagaggtgcccctcatttctacccatatttctttggccagagctgttattgttcgggatccagaaactgatttctcaagtccatgaggcccttggtctctagattcattctgtttttgtctgtctttgcttgaaacgcctccaattctttcctgggattgtctcttcattgtgaagaacctcgctaagttcagccaagaggagacagtgctcaacttcactctgattgtttctagccactttccctagatctgcaggcttgctgagtacatggtccaccttctgaatgactgcaggtgtaagttttaccaaatattttgctaccatctaatatagatttctatctttccagcctctgagatccatttcctcactggctgctgcctgcctactactttagggtgttgctattgcggcaccccactgcaagatacctacttctgtattagttcaggtaaaacagcagctttaactggtagactcaaattctacctgattaacacaactaaatgtttacattttgctcacatcatattctagtacagatgttttttgtggtgtagccttccatacagatgttcttcatggtgtggccttccatgtggtcaatcagagacccatgtttttccatcttgaagctctgccctcctgcaggtctctacagcctctctgtccagctggccaaaggctagaagatcaggcacatttcagaggatgtgctggaagtgatgcatatccatcactttggcctatattgtcttggccagagctcagtctcatggccacacatcctgcaagaggggctaggaaaggtagtccaagtccaagacaaaaggagaacaggttttggcatgcacatagcagtggctgccttataggccaggactctggactgagggaataatggccagcagagaattataatggctcattagtgggggtggcagtgggcagcctgccctggtagaagaggtgctgtcaggcattagctagtatgattcaaaagatatacaaataccttcattaatgcagtaagcatttactgcatgtccactatgtgccaggcagtaggccagacactggggccttgggaggagaacaaagctccccttggagctctgggtgagccattctactcctaacccttgtgctggaggcctagaggccagagagcctgggaaaggaagagggaagtggctaggtctttttaacttggctggtttgaatgcctcctacaacccaagaaatgcagcccatataggtcagcctggttcccactattagcaagcatccctctgcggtatattgaatgaaatgtaatatgggggaagagaaggcaacacatagtggacattctctttatagcttgctccctggttgttttcataggacgttgttttccttctgtgaggcatctaaggaaggtggtgggtctaggatatagggttatgtgtttgtgtctggctgctggtaaagttagggaattggcaccgtgtctcagaaccccctcagcagagctgatggcagcacagggaggacccagtgctctacatccttgcttttttcgtattattggctattcatgttagaagctgttgctgttgttaatttcctagtgggcctggctgaaattgaagcggcgggttgagctctgggcagacacagcatttagtcaacagccattgggcatccgctctctgcccgatctctgtccaagtccaccggcactcctctcactggagcggccagtgatgcgggcttggtaactgatatgtaggggaatggcagtagcctccaggaaggtcttcaaaatgagctaagaaaataggcgtagaggacatatttaatacagattggaatagaccatggagggaaggtttttattcttttttggagatttttgggtagaaaatcatatcactagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaaggtactaaatgcacctttctttgcatgttagatcccaaatgttttgaatatagtaaacatgttattcctatataattttattttctatgttatcgtagagttatttgcatgacatattagaatcaaacttattaaaactgtttatattttgtggatctcatgtggtttcatgagtattgcttgagtgctaaatatactaactaataagatttgtgccttttgagtgtgcaactgtgcattcaggatgaaaacgtagtaacaattttgcccttgttttaattactcttcaacaacatgtgatttttgaaatctgatttaagcctttttggggggtgggtagctgctgctatgtaaaaagctgaatatacttggacattagattttctgttagttctggtcttttttcatattgccacataaaaatcctaaattaaagggggacagagggtggagcctaccacgattgtgaagtttctttctcttacttaaaatatagcattaaataatgctggttatttttatgttgcatatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctggtaagtttatgctgtctgttcagtggtagtacattgatttagatttagagacgattgccaagctcatcagatcttttgttgtatatttactgttagaccatgtgggtacagtgtaaggattggattggaataaataactatacaaaggctatgataatttgatcttctttatctatttgtttttattgttacatactttttaatcttgtcttccagtttgttaaaaatatgttacggcttggtatttttctctgtgtatataattaaataaaacaatttatgaattaagaaaggtggcatttggcttatatatgacctttttcctaaaagtttataaatctagttttcaaggtttaaatattattgaaatacgtattctgattttctgtatgtttgctttctgggtgtgtagtaggagttagaatatttatgagagctgtttttcccattaaaagcatattggttggactagataaatgactattatggatgatcaatatttggaatgaaaatatttacattttccttaatgagaggtgttagtgtttgtgctatgatttttaaaatttgtgtgttttcattttaaaagagccataatgaaagcatataatagtctcaatattttttaaagatagaatgtgattttttccaattacgtgaaaatctgaacaaattttcagaaatgtgctcataaaattatattgattattatttaacactgttaatgacattgcctactatttctatttattaaaaatgagttgcttgtatctatttgtgtagcacccaattttcccctattaatataagctgcatccttgcagagtttaagtagtagaaaaatttatagcggagttgtgtaccagtggcgttctacttgaactcaagcatatgttatggacctgactgtgtacctagcctggagctgggtattcttgaaaatataaaatgagtaaaagatacagtccttgttcttaaggagcttactgtcctctggctgggcagataagacacataaaatatctgaagaatgaatttagccacataaaagatacctcagttgattcagtcaacacctgttctgtctgtcactggtgacaccacactacttagaccaccacctcccctgaaggagcaggtgcatagctataagtcagagtaggaattggtactgtgaaagagatgcatgtagagcaccacgggggttcagagaaggaagggatcacccattctggccaggggtctcagagacacaccatggaagaccttgcagagagctgtgggatgtggattggtggcagagaggatagacagtaggtatgagctaacagtatgattcctggcaatgccgtgtcccaaggcaatgagcaaatggtcctgcctagcaaagagctttgtaattacaaagcaagcaagctttggaatcaggtaggcctgggttcccataccaggtctattacttatctttgtgaccagtcaggttacttctctgaacctcagtaatgctgaagaacatgtgatctgaagtcattcttgtttcatcattcactaattgtatgatcttggacttcctttagcatcagttttctcatctataaaatggggatatttctgttatctaccttagagggttgttatgaggattaaatgagatcatgtacataaagtacttagcacataagcacagtttatgttaaccagctgcagtcataaagacaaaattcagtagcaaaagtagagccttgactgtcaggtgaacactttggacttggcctagcaagtaatatggagcgcttttaaacagtgacaacattacttgggggagataacatgggtgtgaaagatggactctttaaagatgtggggaaatcacagaatatcagaatggaaaagtacttgagagcagtggttctcaaacttgagcagacatcagaactctctggaaggctgattaaaacatagattgctgggccctagtcccagagtttcaaattcagtagatccaaggttaacctacaatttgcaattctaacaagttcccagattgatattgatattgctggtcccaggatcatactttaagaagctctgccttagaggacctcagctaggtcatcagttatccttggcctgatgaggcatccagttgaccaaacgttcttcaatccatttgttcacatttttcctctggggccatgactgtgtgtatgtgtatttgtagttgactttttagaatattataaaatacattttaaatatatttaaaaattccacgtataatcttaccttgcagcaactgttttcatctccttgtggtaccttccagtccttatagctacaaacctcatttttatattgttataatgaaattatgtatttaatttaatttcgcattcttctttttccatttatactgtattttctaaatgtcttcttatatagtcttcagagtcatattttaatgggtacatgataggccaacatagtgataaatgattatctgtgtaaattttgtaaaattaggttgtttctcattttcccgtattaaaaatgacatgtgtgctggtggtcaggaaggttgggaaaagtgaaatgagcagagctccgttcttattatctgaggatctcttgaaattctgactgcagtgttttaagaggagcgtgatgtttcctctcacttctgaacaacagagtattattaaattacaaaccattatgtgttgcagggacttatgaaaaagtgagtttgacttttcttatgcctgctgtgatgaaaattgttgggaacccaataagtgttgggcatcttggaactcaaactttccagaaaggcgtctaagattatataaaattgaaattttagcatgaacttctcctgaccttgaacaagtcacaagtcttgtgaagaatgaagctcggccattcatatcagtaatgagagaagacttagggcttagttctctaggtttccatcctgcattagtttggtgatgagaagatggaaacccagatcttgacagactcatgggagaactacttagcattctttcaacacatatttattgagggtcatccatgtgtcaggctctgtgcaagtgactgagagtcaggggagagaagcaaaaccatttttctgctctcatggagccttcactttagaaactagcagcctcacaccgtgtccccaggctgtgttgtatctggatctcagctgtttccctgccttaaccagggattgttttcttatgaagaacagagatctgttctgtctaggtcaagtataaagcaattcactgaaaggatatgggtgaatctcacgggagggaagtgcagctgcgcctcatgtgatggaaaaccagcaagccactattttctctttctctctggtccatatgctttcttgtcttcacatttctctgtgtctgtatcactctcctctctgcagaacagcttctgatggcacagttgcctctctccagctcatttttcccagcagccagagtggtgttttcttttttagtttattttttattgtggtaaaacagacagaacataaactttgccattttaactatttttaagtgtacagttcaaggagcattaaatacattcatattggtgtacaaccatcactgctatacactttcagaatgttttccgtcatcccaaaatgaaactctttatcaattaaacactggattcctatttggcagttcctcaaaaagctaaaaacagagcttcccagccccaggtaacctctattctactttctgtctctatgaatttgcctattctagatacctcctataagtgaaatcatacaatatttgtccttttgtatctggttttatttctcttagcatgttttcagggttcatccatgtgatagtgtatatcagaatttcattcctttttatggctgaataatattccgttgtattgatacaccacattttgtttatccatttatctgttttgtttgtttgtctgtttgtgaggcaggatctcaccttgtcacccaggctggggtgcagtggcacagtcatggctcactgcagccttgacctcctgggctcaagtaatcctcctacctcagcctcccaagtagctggtattacagatgcatgccaccacaccgggctaatttttttgacttttagtagagacaaggtctctctatgttgtccaggctggtctcgaaatcttgggctcaagcagtcctcctgccttgacctcccaaagtgctgggattacaggcatgagccaccgcacccagcgtgtttattgattcatctgttgatgaacacttgcgttgtttctacattttagctattaaaattaatgctgctatgaacactggtgtacagatacctgttggagtcctgcttttgattgtttggagtttattaactaggagtggaattgccggatcataaggtgattctgtttttagctttttgagaaactgccaaacttgtttccaccatggctatactgttttacatttccaccagcaatgcacaaagtttctatttctccacaatcttgacaacacctgttattttccatttttaaaataatagtcattgtaatagtatgaagtggtatctcattgtggctttgatttgcatttccctagtgattagtgatgttgagcatcttttcatgtgcttattggccatttgtgtatcttctttggagtaatgactattcgaattctttgttcattcttgaattgggtttttgttttgttttgttttttgtgttttttttttttttttgctgtcaagttgtaggagttctttttatattctggttatttgtcccttatcagatgatttccaaatattttcttccattctgtggcttatttactctgttgacagtgcctttaatgcacagaagtttttaattttgatgaagtaaaatttatctattatttattttgttgtctatgcttttggtgtcatatccaagaaattattgctaaattcaatgtccagaagattctcttgtatgttttcttctaaggcttttatggttttagctgtctttgagccattttgagttcattttttctatatggtgtgaggtaagagtccagctgcattctcttgcttgtggacatccagttttcccagcaccagtggttgaaaagactgtcctttccctattgaatggcctggtacccttgtcagaaatcaattgactatagatgtgagggttagtttctgggcttcccttctgtctcattggtccatatgtctgtccttatgacagaatgatgttttaaaatgttgtcaatacaatgtcttttccttcttaaaatgtttcttcagctgttcattgtacttcaaggccagaccatgtaccaagccctacaagaacctatgtgatccttaccctgtctttctctttcaccttctttcatgccgcttcctcactgtggctcaaatgtctggcctttatcctggtctctggaacacactgagctcttccctgtcccaggacccctgcgcttactagtcattcttactgatggattcttggggcttctcacggctgatctcagcttaaataccatcttctcagaggggcctcccctgaccatcccatcaacattagttccttcctctgctattctgtaactcaacatcctatttgttttcttagcagtgcttatcacaatctatattcatttcatttaccacttacttactactctgtattgttcattgttttatttctagaacatggcacagggcctggcacatactaagtttcttataaatgtttttttattactgaattgatttctggccccccagtccccatggtttacatgggttacagctctgttggccaccgtggtctcttcattcttggatcctaatttcaaattccaaatagaatactatggattgtttcctctttgttcaggtatctatccctgattcaaacacttgtgctcagggtagtggggtcatagactataaacctggcttttgaggcccatcccctcagcaatgcttgtggacagggcagattttctctggagatgatatagacaagtcagtttcaaagaagggcatgagctgagctggaactcccaaatgtgtccattaacattccttcatatagcgagaatttaaaagctcaaactaaaagcacttagtgaaaatgtcttcctctgctgatggactcccttatctctgtacttttttaaataccataaataaagatatagattatgaactccctaaaaataggaataatgtttatttgccactgtatctctagaaccaagcacaatgcttagcattagttacttagtaactattgattgaatgaatgaatgatcccatttggttgaaattagagagtggcctaacccatcaaaaataaataaaggaaagagaaaacaagcctctttgattcccccctcaaccaatatacttaggctcattagctggcagtgcatttcatcaaaagcatatgccatttttcttcttgatgaattgcaagtcttgtctctcatggcagcattctaggcaagacacagctatcacaccatcaaccattcttcatcactttgtgttgaaatctgtcagaaaaagcacaagattgtttgtagcttttattgatctttttttggcctttaaactggatggctaggaaattgatacagtatcagtgataaatggtatgggcacaatatagacctctcccctccccagcccagctgctgactctcataaaaccccgtatcttgatacttctgggtaagtaatgatctactggtgatttcaagtcaggataaaacaaggtagtatattgtccattcctttttaagcttgtttcttaatgactcaaacctgcatttagatgagccacgtgcatgctcccctgctatataggaaataaatatatcagtgcttctctatacagatagcatgatttcgttgtcatgaactcagggtagcctcaaagggtatctggctgtaccgtctaataactatcaaaagaacggttgatgatgaacttgcttggcatctgcagattttagcatttgaggttttgactgtttgaggactcttgaagtcttgatatgtagtaatttgtatttttgttcaggcacagattggatttatacctgtgggactgttgtgaagaaagatgatgctttgctaatgagtgatttaactgcctgtccagcacccctaacacaactcagttttgtgctctactcagggttaagtagggtttttactttcaaaggcactttatgggagaaattatattctatctagtattaccaaactgagagattagtgagggtaccagcatatttccctcaggaacatcaaaacatcaagacttcagcgttgtacagctaaaatcataattttgacagatgttctttaaaatttatctggcttatatctgtgtctcacatagcaggccaactctttttttttgaggaggaggaggagtctcactctgttccccaggctggtggctcgatctcggctcactgcaacctctgcctcccaggttcaagcgattctcctgcctcagcctcctgagtagctgggactacaggtgcacaccatcacgcccagctaatttttgtatttttagtagagacaggtttcaccatgttggccaggatggtcttgatctcctgacctcgtgatccacctgcctcagcctcccagtcaactcttgtggatacctccaggtacaacgtatatcagaacattcaccaacaagttaacatgttttgaaactatggatggtgcttttttgatatttttactgcctctgttggtgattgatagtgctcacttttaagctttttcaggccaaaattattgtaaccattttctgtgatgtagaattttgagactttaataattactttttatacattagaatggaatcagaaatcttttattatggttattattttattatttttattattagttttaacattttattgaatgcttaccacgtaccagtctctgttgaatactgtagatgtatttacttatttaatccccacaaaaaaccatatgaggtaggcattatttgattaggccacacactgtagatgctcagaagacatttgtgaatattaaatggattcccatttaactgatgataccagagcggtcccacagctaggaagaagcaggagtgacatttaaacccaggtctatctgcctccgagagcccctgcgcttaatctcttcgcctgcaagcccatgctcttaaagccctgctgtgtatagagtgtttcctgagaaaattaggttgattgttagaacaaataccgctgtccttaatcaaaagcataaagtagctctgctttaggtttccattccaacatataatttcaaactatttttcgtccaaatcttaacaaaagcttgctattaagaatgtccataaggagttatccaaagacatgcccatgccttaaatggtttaaatttaattcctagatcaagcccaaccataagttagctacaaacacttggcctgcctttgttggcccctctcagacttgcttttcttgacttgtaccatggcattatgcctttaacctgcattgatggacagagtggaaagcagccagatagatcttggtggtgtgttgcttgtaggatgctgctaagaattttatgttcgtcatatacagagtctcatttaaaaagacctatgagaaaaaatttttctcaggaccaaaaagtgccatgcttctcctgagaagctggtttgttgttaaccttataagcagtgggaatcctgtaaatgaaagggcttttcctctttgcattggctcctaggaagctccgaactccatttgtggcttatctctaacagtcttaaaggactttataacatgcatcctcatcttattctcttgttttcagtttatttacctacacttgatttttccttgttctgagtgtgctcagtatctcattttatcctttaagtaagatatatttaagtaagctgcttttaaatcctttctaaaaaataagatagagcataaatataaaagtatttctgtatctagccgttaacagcataatccttctgtcctccattgacaggtagaataactttgatgcttgtctcctccctaccctactttttgatacagtatgattttatgacctatttttctaggatcaacaaaacttggggagaattaacaccacctgaccagccatttggtgaccatcttgagctccgagtgctgtgttaatgacatgcataggcgggtcacaaactgtaacaaatccaccagctgaacacatgctgtaataagaataccagacaacttctccaaattttcccagacaaaatcaaccttgggaaccttgataccagacatcagcatgctctctagtttcaaaaccagagttacaggcaccccactccctcctttctgagtcctggcttcctcatgctctccctagaggccacaggagtctcccattcctgtgacactcaaggctctcctcctcagggcaagcctctctgcgcctctgtgctgctctcttgcagccaccttggcttggctcacaatctcaggctcctcaaccttatgctggtatcctgggagtctctgttgtttgactccagtagtcttcaactgatgggatatggtcccctgatgtatataaaaacacttccaaattttgatcaatgtataatagtttatttttcatataaccagaaatacaaactgaacacgccacttacctggttaactcttcagcaaaggaaattgagtacagcagttttctaccttgattgtggtttcatacactcaggaggcaaaatgcacataagtctctaaacacacagactttcttggtgtctgtttggtaacagccgttgcctttcacaccttacttgtaccagatcattctctgccctgcatcatggcttgtcgtgtgcccgcctcaactttcagataagcaagaccaggctcagcagtgtgcatcatctgttgtagcaggaataaattttaaacttgattaaaatatataatgtaatatacctttatgtactgctcttagcaatagaatatattttgttttctcaaagttgcttttttcagtacctatgttttcttctgaactcatgcaggccttccctcaaaactgtggtattcacatgccatgaacatgcatagagtttgaaaaccactcttttacctctttggggctgttaaagatgaagaggaatttggtgtttttgccaatctttccccacatgggctgtggactttaagagctctttttttaggccctcagaggaaagtctagcctattttaacttattaactgccccttggcaggcaacttagaacaagtttccctggggttcaggatccaagagaatttgaggcttcatcaaagtctctcttggtgccttaagatgaaacccttgtctttcagctttctcctgtctcagggcaagtttctgttttcgtagggcacatatccattccatgggttagaagagcttttggccctgtttgttaaggaggggaacatctgtgggttctgaaatttgcttcccttttatatcactaatcaaatttagggagtcatgcaaaaaaatccagtgtagcttgccgtgattggcttaccataaatggctggctcatggtgtcacactgccactgttagttgagctataagtaatatttttatattgaactattttacacatgtaattaaagcagttactttgggttcttttatgtgcaagaaaaggattgtatgctttttggcctcaactttttaattggtctattgcagttatcgttgtgttgcagtcttttaaaatataatctcaaactgtgcgtgcataatagatgtgaaggctctttgattactttgggagtacatttcagctattctctaagttctctttttgctccttgtaatggttccacagtttcccttcttactttctccttttgatgcttcccttccttgtactccactgaaactgctcttgccaaggtcaccaaagatttccttgctaccaaatccagttggcattcctcaactctgcctttttttttttttaacattttgaattgattgattgattgtatagatggggtctcattatgttatccaggctgatctcggactcctggtctcaagttatcctcccaccttagcctcccaaggcaaggctgggattacaggtcagtcttcatgttacatgacaactctgtagccctgttaaaattttctcctctcttgacatctccatactatcagcttttcctcttgcctccctgcttcaccttctcagcatttttttttttttgattccttcttgtctggctggcccttaaattttggtgctcttctagattctgcctccagcattgttcttactatatatgctctttctgggtaatctttccctgtcttaaaattggtgactcccagatccatatattgagtccagatttctatccacagatttctgtgcatgggcgcatttgcctaaatgcccactggcagtctctcctgggatgacccataggcaactaaactgcaatatgccccaagctgaactcaccctgtctctcttgtgccaaaccactgagtgaatgacaccatcttcctttcagttgctaattccagaaaccaagaaatcacacatagccatgtcccagtctcttaccaaatcccattggttctattatatattctcaatggatttcatggccagttgctctttattcatatcactgtgtacagccagtgtcagacagccttttgagtgctttgtatgtgtaaactacttttcacaatgacctaatgaggtgggagtactgttatcatccccatcttacagatgagttaactgagattcagagaggtaaattaacttgtccaaggtcacacaactggtaagttgtagggggtgtcccccaactcccatccacaataggttatatttacttgaaagatccatgatcttgctgctgttacaggctgctccagtgcccctcaaacttgattatgcataaaaatcacttgagcagtttgtttaaaacccgtgttctgatttggcatatctggagtgggctgagtagtgtgcattttttacaagcttacattttgaaagtgacttttaattccttatgtgtttcttatttagactcttgaagaaatacaagtaagaaaagaacaggatgtttgcttctatgtagtccttcttttgtgtgacattggtatcatttcctctttccttgagcttctggcactttctcttgctctccctgacttctcaaaaattccatttaacaaattcttgataagattacatctagtgtgtccgtgtcctcagatgtaattaacctaatcctgggagctttgatttccttaatgctgtaaagagtactttccctaatgtacagctctggcaacatcatctttatgcattcaagcaaacaaattcctgctgtaataacaacagcaaaccttcagcatctcttttttgcttatgaaataaagtaggtagtcttcagcttgacagttaaggctttctgcagtcttgctccaacctatctctgagccttacttagctcatgtggcccatgatccagcaaacggacctttacccaccattgcccaggcctgagacttccttatactttttcatcgttctagaatgccctcttgaaatatgcctctgttgagtgtcattttttccatgcagccttacctgattcccctatgggaaagtcatctttcactatctagaaccccacaattgtttgcatttctctatggtacctgtcatattttacattgtcattatttgtgggcattttttacctgtcctagtaggcagagattatggtgcttttgttattgtatccccagcagtacttggctcagtgccagacatccacaaatcagctagaagatgagttttgccaaaaatctctctaataaattcttttttcttaaattttttatattacttcatagtatttttgtgtgtatgtgcatgtgatgctgatatactttttaatatatttttccgattatgaaaggaatacatagtcattatagaaaatttgaaatatactgaaaagcacagagaagaaaattaaattcatgtgtaatcctacaaataatcactattacgatttagtacacatcgatttagtaattaaatttgtatacaaaatgggtttatgtattttattgggcttctttacttaaaaacaaagtatagtctttttaggcataaagttgtcttccataaatgacttcatctccttatatgcaaatctcttttttcgtcttcatgtgtaattgcattggctatgacctccaaagcaaccataaatagcaatagttgcaggtgtccttgtcctggagtttcaggtaagtttttaaggctgtacatgagggtatcttttcttaatcattacatatctgagcatgtctctgattcatagctttcacaagaacaactttacctgcttttaagtgtctgagtcatcacctttttcctttaaaacttcacaaatgttgatctgttatcgtgttagtttcctaggcctgctgtaagagtttatcacaaactgggtggctgggtcacttaaaacaacagaattctattctcttacagttctggaggctaacagttcaaaatcaagatgtagcagggccatcctccctctgagggccgtggggaagaatccttccttgcctcttctagtttctggggttgcggcggcaatccttaaccccctttggcttgtagctgcgtcactccagtctctgcctctgttatcacatcgccttctctctgtgtctctgtatctgaatcaccctctctttttctcttataaagacatcagtcatgggatttaagtcctacctgaatccagtaggaccttatatcaacaaattacatctgcaaagaccccatttgcaaataagattatattctcaggttccaggtggacctgaatttggggggggacactattcaaccagtacagttaccttttgccctttagtgttctgaagagaaatctgagccagttccaattcagtttctttcttggtgacctttcctggctgggtttttcttacattttttttttcttttcatctttcattttttacatgttttccataatttatctgcacctttgtattttcattaattttccttaaaacattgcacctctgggattcttagatccagtcctttaatcaaggatgaatattttcttctgttatatctttgattattgcttgttttttcccctaaaatggtaaagaccattttctctgtcctccatgactgtcttttctttctttttattttcattttgttttgttcctttccattctataatcagcatctaaaatgatggagatattactgttttagttccctaaaattaacattttgttttcctcctccagtgaagattttaatcctacatttgcattttttcatccttttttatctcacccacttgcacaaggtttctacactattgcaaagagctcatgtcttctgtctccctgaggacagcaatggctattctgaaattttattttggtttcatagtaaagatggttaaaggtatgcttccctcttttagttttcaggattatgtgtagcattttttcatagcccccatttttttttgttttgttttcatttttgttttacttcaaacaaaaacaaagagctattcagacctttttttcaacattcagaatgtataactggctctcagctatcattgttcatttgggactgtagcttctctgagttaaacaactggctggctggagattatacaaagctccttgatcaatttccagggtctagttggtgtttatcttataaagctctgctggagtgagataggatattctcctgtgcttggctttttgctgctctgtaccagcggctctagaatttatacataacaggggcttaggaactaccagtagcagtctggttgaaagaggcgtattgaagtaatgtttgcttagctctttacataagcctgagaaaatgccagctgtctagatcaaaaaacaggatgcagattgtgaagaggttaaatctcccccagccccttggcatgttggggaaactaaactccctgggatgctctgccctcaggactctccatgtctcgctccctacctggggcacttggtttatgaggaccacattctctaagatggactcactctccctccctacttcttgcccagtgttttcttgtcatgaaaaagaggtgcttgtacgagtgaggctacctcaaaatgcagtgtccatgcagtaaaaagatgattcctagtgttttattcttactcttctgaaagacccaatgtctcttagctaaaattagatggtgtggggaagattaaagtgccttccaaccttccataattaccacagatttgttctgttccaagcaacaaagccagacaccaaatacgtttctcgattcttctccattggccgtatagtaagtagaaaatgtcttgatattttggacgtagaattgccaatcattccttcttaatattcaaaggagttgtcatcatttgtggtgaattttcacaagtcttttactgggaaatggagtatcagggactactgttcagatatgattttaattagaaagccaagacaggtatattttgagctggaaagctacatgacagtgcttatcctgaattgcctcatgtttctcagtaaaatagcagaaaggtcatctgttaggagaaagggtgtttctgtagtggtaacatgtgacagataaggtggaggatgtgatgggaagtacaaaaataatggctcagaagattggatggtggtgaggatctagccataatcaaatagcatgagcatgttgtaggcctggtcagatggaaactcttctttgaacacagaaaaagagtgagagttcagttggcagggtgtgagcgagtgacttgacttggtggcacgaggaggagtgagcagcatgccagatatgtggggtggtaagtgcagcctgattaaccacagatccccagatagaacccatgccaaaaagagcccgagtgggttatgaggtaaggtaggtcccatgatgccacagctgtgccagtgagaaggagaggatgctgttggagttaggaatggatggcagagccatggagttgggaggtattcgatttgaaaagacagaagaatatgagctcaggctgtcagatcaatcatagcgatgggtgttgagtttgctgaggacaggggccagggacaaggatgataagaaaagtctgagtccagatccagggccttggtggctctcctccagccaacatttatcctcttggctggggaatctgcctgccacctggttggttctatatgcgccatggtgctctcagcacccagctgcccagctgcccagtcacccggatctccctgtcccccggcacaggcagaataggatcaaggtgaggagtgggaggaggagaaaaaaacctaccccttccccctactctggtcctcacactggctccttctcccttgcctttccctgcaggcacagaagtggactaaaagagaccaggagacaggccccagggcagcactcagcagtgaggggatggctcattctacccatgtttatgccttttctcaccccctctttttgatgcagacatttaaacttttctttcttcctttctgaatagtagtactttctaagtcagggatgtgtctgtgtctgtgtctgtctgtaatttgcatgtgcagggtcaaatggatctgctttcttgaccagtatttgcagtttaaataaaccagcttatgttggaaatcatttctcaaagatcctatacatcttccagaataaattgcattatagcaatgcaaccttccccagttcccccaggcagagttggtctctccagtgtctgtcccctgttcttttgtctgttgttatggcatttaaccaggttgtgttgtgatttatctgattatatgtatgtgtgtctcttactccctctaggatttgcagtcctctagggcagggatcatgttggatttatctttgtccagcagttagtacaggccctgaaaaaaatggtttcagtaatgtttgctaaatggacaaatatttaaacagatcttccaagagtttaaatgtagcataaagtggcttaatcatgctaatcagagcattttatattaatcactatcatattactacaatatatattatagcattataacatttattgagcacttattatgtccaggtactattctaggctcgttatacattttacattattaaatcctcaccacaagcctagaagtaggtacagtcattgtccccattttagacataaggaaactaaaatttagagaggaaaaattcagtgattttcccaaggtcacatggctaacaagtatggaagtgagatttgaacctggtcagttgagccccaaaacccatactcataagccctcattttaaagaaaggggatctaggagaaaatattacatattatgcttaaggatgtactttacataatctttttgagttttttttctaagtaaaaatattgttcctgtgatttatatacctgaatgccaagtacacagtgcatgctgaacagagatcatagggaataccagcactgatttagaatggaaacaagcaccaacccagtgaaacaaagcagtaaaataaatgaggaagtgctttttgtttttgaaaaattacatatttgtattaatctaagaaagatcctcatttaataattgcctacaatttgaaactaataatgtttttatttatagttaataacattttatgctttctatttaaaaaaattaatttgttaagttctacaaacaagtattcttgcttggatcttattttttttcctgagataaaacatctaatatattgaacactgttcagtgttaaatgaaacagttagttttgctgagattagaccaaggcctccactcaggatgttaaatcacatgaattttcactacttaactaactgaatgggaaaccaatttgatttgggtcacccagagctgcatgaatgtccagcatgtcattatacataaaaatatgtataattggacagggttgtggccctgtccaatagaactttctacaattatggaaatatttttatctgtgctgtccagtgtagtagtcacacatagccactgagcacttgaaatgtgactagtgcactcaggaactgaatgttttttatgttaattaaaattaaatctaggctgggcacagtggctcacgcctgtaatcccagcactttggaagaccttagcaggaggatcacttgagactaagagttcgagaccagtctgggcaacatagtgagaccctgtctttacaaaaaataaaaaagtagccaagcgtggtggcatgtgcctgtggtcccagctacttgggaggctgaagcaggaagattgcttgagcccaggaggtcaaagctgcagtgagccataattgtgccactacaccccagcttgggagacagagcaagaccctgtctcaaaaaataaaaaataaaatttaatttaatttaaacaaggctggtggccacagtattggacagtgcaagaactcagaagtaatcactcacagtgcctggcagatcctagccaaatgatcacttaagtcgttttgttgttgttgttgtttgtttgtttgtttcctttttctccctcctggacacggtcttcctcagaatctgagtatttggtgtatgaccatagcagagatataagaccaaataaagtttaaaaaatcctgtcctcttttcttagcattagtgatgttacacatacatgttaatacccttttcctaaacatatccatcaaaatgaatgcaaaagatctggtgtctcttctcaaaggaaactgccccacttttctgtgagtgtgtggctcttatgtggctctcatgtggctctcgtgtagctccggtgtggagcatcagatccttcacctcctcagaagatgctctgggccagggctgcctttgtggggcagtgttgtgacaagatcttcagttttgcaactagcttttggtctactcagatttctttcttaaaatatttttcattgtgtatgttttcctagaaaatttgccatttcattgaactttttgatgatattggcataatttcatatagaatgaatgaatataatttcattctcttaatcttttagaaatctctttcttcttagtggttctattttctttattatcactatatgtatttgtctttgttctttgctttttaaaatcagacttgccttggagtatcttggatatgttaatcaattatactatctttctagttttataatttctgctctgatcttttattgattcctttcccctgctttccttgggtttatttcattgttctttttttatcttctagtggttaatgcttagttcattgtttttatccttttttgtttgataataaaagcattgaaaatgtgaatttttctgtaaatatagcacctatcacattatgtgttttcatatgtactgttcttattgttgttcacatctgaatagtatctaattttactattcctatttgactcaagaatttatataaatatatgcatataaataaatttatacatgcatatatacatatataaattcttgagtcaaataggaatagtaaaataaatttatatatgcatatatttaaagagatgggatatcactgtgttgccgaggctggagtgcagtggctattgataggtgtgatcatggcacactatatcactgaactcctggtctcaagcgatcctcctgtttcagcctcccaagtagctgggacaataggcacaataggctgagatgcatattttctgattttcagtttttaaaatccttttgatactaatttcttattcagttgcattatgctaaaaatgacctgtacaattttatagaatattttagaagttttttattttatattgttctgtagaactttttcttccttttctgggccagacatggtggctcatgcctcggcactttgggaggccgaggtgggcggatcacctgaggtcgggagtttgagaccagcctgaccaacatggagaaaccccgtctctactaaaaatacaaaattagctgggcatgatggtgcatgcctgtaatcgcaggagactgaggcaggagaatcgctcgaactcgggaggcagaggttgcagtgagttgagatcacgccattgcactccagcctggacaacaagagtgaaactcgcttttctttcttttcaatattaggtcggtttttttaaagtttactagatatttttaaaggtgtgtattctctgtaccttgatacagtccatatatgtctattaaatcatgtttattaaatttatgatttgattccgctataaatccatactcatttttgccttgacctatcagagagaaatgtactaaaatttcccattacaattataatttcataaactcttctttctagttataatagtttttgttttatagtgatatgttgttactcattacataaatgtttatagttatattttggagatgggtggttctaattatccatataaaataacattttttatttgatgtctttttctcctaagttctactttgtgatttcattattcccttactttctttttgtcccaatttgcctagaatattttttactttgcctttctttttcatgattgctttattgtatttaatatatttcatttatgttaccgatcaagtcttttttgttttagtagggaaatgtaaccaattcatatttattaaaacatctgtgctgttctgtttacctttaggagaagttccaggctcctctttatccacttctcattttatccctccctctcactccatccttcaggagtgcagatctggattgatcagattagataacatcttactaagtactaaactcctggatagacagagctatatttgcaaaggtcagagcacacatgcaaacatgcaaaagtctcttttctggactcttctcccagaagaataacaaagggctggatgcattccagtgtgagaggagacctaaccaactccctcctctttgctggctttggaggggtaagatctcagactgccttcctgtcttctttctttctacaccatgtaggctgatctaccttcactagtagttctcctttagtcttggtctcactcattagtagagaaccttgctagagagggtggttagtgtaggagatgatttgtttattcctgtgttctgttctctgcccaaggaccactttcgtaacaccccagtccattctttacagtttttcccagatatgttctctgtttttcataatcattttcctctatttgtctcaaactgatattctgatttactctttacgggcattttcttctcagttctagtttttggttcaccatggtcactacattttgaaattcagtaattacacttttcatctgaaagctgattatagattgtcccattttcatagattcaatatgctcccaaattattaccataattggaaattttcaaaaaattccttggactttttgtagtaaatctgtcttgtagaacattttctctgatatttcagattttacattttatactatcaacttatcataggatcaatgattattctcttgattcttccttattgggtgtattagttggcttagaacgtcacagtgcggtaaaaaacaacaagtttatttctctctcatatgcagccaggaactctaagtgggtggtgggtctgcaccacacattcaggctcaagaaaatctgctgtcttcaacatgaatttccagatccctctggtcattggggttctagccagtggagaaggaaaaagtgcatggaagaggtacctcccctctcctaaagggcctgggtccatatatgtacccaggtgagctttggcccaccttcaagtggaattaattcagtcaaatggccacctctagggaaatggggtctagctttgtgtccagctatgattctgcactgtgacaaatggcgagagtggattttggtggcagctggagctctgtaccatcttaatgaattgagggagagggcttctaggttgtgcagttttgacatttagatgggttctgatagagattgtgtcattcctgagccaaatcttctcccaaaaaaagaaagtgtagattttttatagttgtaattggccagatcaaaggtttgtgaggacaatagaaagaaaatggacagagacagctacctgataatcagcttctgtactgcgttaaaaagattttcttcctgaagtgttagttttttcattccccagtttgctggggcactttctcctttcacagcagctgacgtactggtcttcatcaggccccagccaccacagccccctctgctttagttagcaagctgtgtgagccagccgggcttgggggacactgagactgccactctgtgctggccctgagtgtgaccagtaggatctcctgcccacctactgccctcccacccatgctctcctcaggcaggtcctgccagcatgagctcagggtgttggtgtgaacctgcatggtttgattaagttactgcccaaccgactttccccagcctgtggtgcttccggttatctggcctgcccttcactttggcctttccttcatgatagagctggtagaatttctttgacatttcttgcatgattaatgaaccttctctgctttccagggccagtataggtcttacccctgtttttatatccctttggccatttgcaatagaaatttggcattcatctattcccatatttcttgtttatgaatatttaatgagaccgatactgtgtcaggtgttatgcttagctctggagatgcagtggtgagaacaagtaaatgtagttgctgtcttttgaagtttgctggagagcggagagagcgcctgaggaaagacaggtgggaaccaaataatcatgcagagaaatgtaaatcacaactctgcagagtgccccaaaaactgacaacagggtcatcttcccaggcagtgggtcagggaaggtatacagaaggagggggactttggtagaactgaaggatgagtagtagggttttttaggggaaggtgagaaaggagggccttccaagccaggaagtcccaagcatgtgtccttcggtgagaagaagtggggatgctggaatagaggtgggattgtggcacagtcatatttgcagtttgcataatcacccaggctgcaggcttcgttgtgaggagccgcttggagaggagcagtggtagatgggtgtatagactcagtaggaggtggttgtggtcatcaaggtgacagatgatggtgacttgaatgaagatggggatggtgaaatggtaacggtgatagtcaaacccattagcatgagctctgtctttatggatttcatgagttcaaagggagctgaatttctttttaccatcaaatcgttaaatttgttcttcctttttttcttgaactttttaagcaagacaagcaatatgcttcctgttctaaactcaacaaatgaaaagagcattattacgtatgcctgtgtctaaaatatagtgttttatgatgtttaatttatatttttatatgaatgaatgactatcagctcttctcccaagccttcgactcctagatgagactagttatagtcaggactgtctctagcaacctctattttaagggtaacaagtaaggggagggtgtgtcccacgtctttatagacctatgtcagacattattaattgatcatagtgctcttttcttgccaagtccagatgtcatctcagaatgcttctcccaaagcccttgaggcagcctataccagtaacactctacctgaaatctacttgcttttccctctattttaacagtgagtagaaacccacaaagaagctgttgatgctgaatcctctatacttcccctgtgaaaacggcagtgaccctatgatatctaaatttatctttctcttgtactttaaaattggcctctgtaaagttagagacagtccaccagattaccctcacttctgacaccaactactacagcgttcaggagtccccaagaccactctcaggtttgatagtttgctagaaggactcacagaattcactaaaagcttctaagctcacttatgatttattacaacaaaaggatacacattaagattagccaagggaagaggtgcatgggacagagttcgggagagttccattgcagagcttcccattgtcctctcctgatggagttgtagacagcattaactcctcctggcgatgatgtgtgacaacatcagcaccgagtggaatgttgctcatcaaagaagctcacctgaattgcggtatccagagtttttagcagggcttgatcccatagatgtggttgaccacccacgtggctgacctgagccttcacccctcagaggtagagctgatactgtgtgacccaaagccctcactataaatcagtgtggctcagagcccctaagtaatcagacactaacacaggtcattcccaggtcttagagatcacctcccagaagctgagggcaaaggctagacctctgtttggacaagttgaaattcatgactacacagcctcttgggctcatcctcagtttagcgaatagtgtaatgatctgatgtcatcaaaaaaacatttgcttttagaaattattttgcaggagaaagatgaaatataaaaactgaacctaatcacggacattctctggaagatggttagggagggtggtggttagatgaggacaatgggtttctggggtctggctacctctgttcacatcccagctctacctgtactaactagttaagtgactgtagcccgttattttacccttctctgcctcagtttcctcgttcataaatgagaataataataatacctaccttgtgttattatgagaattaaacgagataatacatattaagagcaaaagaatgcatggcattcaacaaataccagatactgtttctatatttatcgtaggaaaaatttatcaatctcttttaagtaattttccttgagaaaattcattgcagtttttccctaaattttttctattaatttttataccatcgtatctcttaagcactagtgaaaacgtgaggtaaccatctttcctgagaaatcacatttctgttttgctgagtgagctctgagttagagaggtgagaagtgcccctcagggcagatgcgttctgatgagtctgctgcagatctttgttgcaaattgtgggtagatttaaaggctaaaaaaagatgtgttgctttcccaagtcactactgagaaaatctagaaggagaaaataagttaaatcttgagtcagtaattttggactcaagtgccaagccctggtgtgttcactcacctctttcgaacattgggccccttggagactgtctatttgcaagcatcaccttgccagagctaaaacacagtctgcctgcctggggagggactaattggccttttggaaactgtttaaaactgaatgaagcacaggcgctttctccgatggtagtagagccttgagttcttgccagccactaattgttctttaggctttcctgtgaaggaggctgaacttgagagctggcttttggtcttgccatctgtgaactgccacttgtccacatgtggtgtgtattaagattgtttttgctgggagcatcagtattggaatgtgttccaattaaaatgtgatgctcttgttttccactcttgcaggttaggcattccttactcttgggttcccaaggacagtgggagccaactgtatgagtacctgcctgatagagctttaaaaaaactgttagcttctaggctgggcactccagcctgtgtccttagatgtggcttacttataggataattacatacagatagaagagacattgtaaatgcttcctaattgaatgctttttcccccctagcttatttccagtgatgctgatggagccatccaaagggctggaagattcagagtggaaaatggctcttcagatgaggtaaggaagcctccccacttcctgtaatgccaccaagcacatgattatagtgcctgggatatagcagtgaaagagttctggaagaggtaaatagagcttttcagagctttgcttgaagcaaatggaagggaaatgtcagtattctggcatggaaggtgctattcatagggtgacacataccctttaaaagatctatgttaaaaccaggtagacacaggaagttgttctgccagcagtgggaccaaagacaattctgccaccctctgtgaatggtcccgagtcccagtacttcctctgccaggctgatcagcttggcacagccatccgagcagtgccagggtccaggagggagatgccaaaaattactgcaatgacaaaatgtcaccaggaaaagaggctggtactgcctactgctccttgggccacgcctactttctgggctctctgggtcttccttgctgcaggccacagggactcaccttgcttttttttttttttttttttttgccactaccctctctatcccacggggtctaccctttaaactgcagagtatggcaaaaactcgccagcctttttcttctttgctgcctttttacacggtagctcatcatagctctagttccctgaccctgaccctgggcaaggaccccagccaccctgagcctcatttttttttcatctgtaaattagaaactgtctcaagattattgcaagaattcagtgagctatgtttgtgaaactcctagcactatgcctggcacatagtaagcttcagaagtgctagttatgatgctattgatggttattgttattgtcatcactgccacattgccggttttctcctgaccacctcctaatgcaaattctcggtaaagagctatgaatttaacttgaaagcccatgacatttgggaagtgattgcatgttttcactcttggccttagccatgtacatttacctgacccttgccattgacatgttagccaaatggaggctgaatacccctgaataggtacccacatacttcttgttcagaatgatgttagctgacccacatagaagaaggaactcatggagaattttgcttctgaaccttagaaacatccctctccaaatggcctggcccctgggactagatagcctcaccaccacaagctcaggcagccaagggttctcaggagctaagccaggcacagaggcattgagttattgctctccagtgcttggaaagctagcggccaccatgccgagtttctactttgagagcccatggaggctgtataccttgagacatctttctgctaccaaaattttgcagaacttcagcccagcctgaaatggacaaaccaaactggactttgccaccctacgtaagcacaactctggcccctgccgcatccagtgtctggaggaaatacatacctcccaggaaagacatcaatggggccttcatgtgatccttaatcaccatacacttggcagtcaaacactgctcacctggccctgccatacaccagaggataggttctgggacccagtcaggggttagaaataacctgtgcttgggtcatgatcaggagtggcttaagagtcagacttcccagggttcaaatcatggccctacaactcaccagcaatgtggccttgggcagttcagttgacatcttgggaacaatttgggggagttactgatttcacaagtcattgcagtctgttgtgttcaaaacacagtccgtctcaaattgcttctctggaaatataatatcaaggatcgaatactgttttaggttttatttccaccgaaactactgagcatgatgctccattggagcaccttggctgttttgtattggtggtcttcagttaaaagtttctggccaatggtactttctagcctgataaaagaccttgtgggcacttgacttccagagggaaaaaacagctggctttctctgaattaggtaaagcagttagtgcagtaaaggactcactatatatagttgcttaaaaattctcaaacctctgaacaaacaaattgcaaattttgtttttgggttatttgtgcttttattattcaattgtaagagttttttatatagtctggataattagacacttatcagatatatgattgggaaaagttttctcctattctgtgggttatcttttcactttcttggttgtgtcctttgaagcacaaaagctttaagattagatcatgtctagtttgtctgttttttttctttcattgctggcacttccgttgtcatgtccgagaaaccattgcctaatccaaggttgcttggtcactttttatagtttactgttcccttgagataatgtcaaatttgtcttttatttctttaaacatagtgtaatggttttatcatctgcgaccgagaattccaatatgtgaagtttttgtggctgttgtttcattgttttcctctggcctatgctcctcatgtaatgtgcttctgcgtgtgctaggctgcctgattgtgtgctacttattgttcctgaaaatttttaggaataatataaagcctaagatgagttgctttttggtagggaggacttatgtttgcttttgccagatagatacctttaaaccaaatacccatcttgagaccttttaaactaccaaagtgctgcagattacaactacagatttatgtgaaagctggcttgtggtcaccacacctcagagacactcccctgctcagctctgctcggtgctgtgacaacttccttgtagtttttggtggtggaggtggtttcttctgattccctcttccttcagtgtgcagccctttgggatcctagcataatgtggggcagggctcctattggacttgcctaccccagtgggtcttgggatttgactctttgtccccaacaaggtcaccaaaatccaaattcaattttgctgggattgacaaacatcctcaagccaaaaaggactttcatgctgcatttacctctgtgcgttcccacttgcctttcagttttaattggcaattcctacaatctggtaagcactccagtgcttttttcccacccctccccccggccaagacagagtcttgctgtgtcacccaggctggagtgcagtgacactatctcggctcactgcacctccgcctcctgggttcaagcaattcttctgcctcagcctcccaagtagctgggattacaggtgtgagccaccatgcctagctaatttttgtatttttagtagagatgggatttcaccatgttggctaggctggtctcgaactcctgacctcatgatctgccagccttggcctcccaatgtgctgggattacaggcatgagccgctgcgcccggcctccagtgcttttaaggagatgattttaatatttttctagtacttttagttttttcagtgggagggttgatctgaataacctagcctgccattaccaaaaacataagttatatcgggagtgcttttcatataatgtgacaaaacattcattcaactggcattcatagggtcatttcctagtgccagacaggctgagccctggatgtaggattgaataagcctgctgaagtccctgctcctaggggcctgcagatggcagggagagccatcagtaaccaatacaaacacatagaaggattgcaaattttggtaactactgtggcaaaaacagaggaccatggtgcaaagaaacaggaagagccctatttaagatggggtcgtcagaaagcccttaccagcgacagccagtgaggccaagcctctgaacagtgcttctcagactgtccatcttttcaatttccggtcagttgcaggaaattaaatatgtgatcctactctgcataactagtacacagaacccaccttatgcaactcatcaaggaattggatatcatccagattggtctggacagtttcatgagatgaatccactgaacatgtacttacatgccacaggcatgtcagaacactgtaaaggtttcttgtacaccttgtcatggactagtaaacagtttgcagattggcatccatcagaatggaccatactttcctgccttagagttcatctgggccaatccccttcccaatgcatgagttcctgcatcagctttgccagcagttagctgatctgttcctgcttgagtgtatctccagtaatgggaaacttgatacctcctttataggacttttttcctcctgacaccaatcaattctgacaccaactgagtgtcctacaattcaattctcacaccgactacctggagttagcgtcagactccacaggtttaagggctcagtcccacaagactgtcctcatttcagaagccagtcacaagcattgggtccccagattacctacattccacatttcttaccaacttggctacaaagtcaggtagccgttaccacagcctcctcctcagcttccataactccctaaaatcactcacagaattcatgaaagcacttttttttttttactattactgatatattataaagcatcagtccccaacctttttagcaccagggaccagttttgtggaagacaagtttttccacggaccaggcagtgggagatggtttcaggatgattcaagcacattacacttattgtgccctttacttctattattattacattgtaatatataatgaaataattatactactcatcataaggtagaatcagtgggagccctgagcttgttttcctgcaaatagacggttccatctgggagttataggagacagtgacaaatcatcaggcattggattctcatgaggagcacacaacctagatccctcgcatgtgcatttcacaatagggttcatgctcctgcgaggatctaatgctgctgctgatctgacaggagacggagctcaggtggtaatataagtgatgggagtggctgcaaatatagatgaagctttgctcacccaccactcacctcctgctgtgtagcccagttcctaagaggctatggaccaataccaggggttggtctgttataaagagtacaactcaggaagaaccaaatggaagagatgcatagggcaaggtatgggggtggtggcatggagcttcaataccttctccagttgtatccatattttcagtacctcaatatgttccccaacatggaagctccctaagccccatgatttaggggtttatatagaggtttcatcaggtaggcatgacttttttttttttttttttttttttgagacggagttttgctcttgttgcccaggctggagtgcaatggcgcgatcttggctcactgtaacctccacctcctgggttgaaacaattctcctgcctcagcctcccaagtagctgagattacaggcacccaccattgtatcccgcaaatttttatatttttagtagagacagggtttcacatgttggccaggctggtctcgaactcctgacctcaggtgatctgcccacctcggcctcccaaagtgctgggattacaggcatgaaccaccacgcctggccaggtaggcatgattaattaaatcattggccatggatgactgcctcaatcttcaaaccctctctcaccctggaggttggggtatggagctgaaagttccaagtttccaatcaaggcttagtctttctggcagccacccccgatcctgcagctatctaggagccccctgtgagtcccctccttagaacaaaagatgttcctgtcacccttatcactcaggagctctgtgctaggaaccactaacaaagaccaaatacgtattcccattataccacaaccctaaagcagttaattccatttttcagaatctcttaatttctagaaaggtctttttattgaacataattcacctgtctactgtattttctttttcttttcttttttgagacacggtctccctccctctgtcacctaggctggagtgcagtggtgcagtgatggctcaatgaagcctcgacctccatggctcaggtgatcctccaacctcagcctcctgtgcagctgggcctacaggcgcaggccaccacgtctggctaatatttgtattttttgtagagatggggttttgccatgttgcccaggctgatcttaaactcctgggctgaagtaattcgcccacctcagcctcccaaagttttgggatttcagctgtgagccactgagcccagcctatattttcttttttcttttttttcttttttaacacaaggacaattttaatcctacattttcctatagtataacagcatccattgctagctatctatgaattgaaactgcatttgctaagaactgtgaacattaagaagctttacatgaagtcacatgtgttgatataggcacatagacatcttctagcaccaacagaatacatacgtaacacataccgaatgatcttgatggatatatttgctccaccaggtaattctatttagtaaaattcagttaatgcagaatcccatttttaaaatttacatctttattacacatttttttatttttaaaaagtcattccagattgtaatttgcatggcaataaacagtggcttcatggattcttagtttcttaaagctgtctatagcaatttaaaacacaagtcttcttttcaatttgcagcacctgacttaaagtttaaattcatcgaatgtactcattaaaactgttcagtttctcttatgagaaagacatgtttcaattgctatttcccaaactatctgttgagcatgggtgtgtattgtttttatttggttaatagaattactcacacaatttatagccggaacaaaaacctctagcctctctgaatggccttccactcaaaacagcgatgataataaatgtctaaaatgtatctggggtctgccccaacttgatatcaccaaacgtgtttccaagtttttgtttttggttttttgggttttttttgagacgaagtcttggctcttattgcccaggctggagtgcaatggcgtaatctcagctcattgcaacctctgccttctgggttcaagcgagtctcctgcctcagcctcccaaatagctgggattacaggcacctgccaccatgcccggctaatttttgtatttttagtagagacggggtttcaccatgttggccaagctggtctcaaactcctgacatcaggtgatccacccacttcagcctcccaaagcactaggattacaggcatgagccaccacgcccggcctgcttccaggttttcttggaaaatatggtttttaactctatgcataatactctaccacgtgatacaccatcacttctttatttcccagttgttcatttctaccattttatacttgtaattttttatattataaataagattgtaatgaacaccttcatccataagttttatgcgagactggttatttctttagaataatatcaaagaagtggcttactggttcaaacagtacatgtggttttaaggcttttaatataatttactgaataatctccagagtagctcaaaaaagtcctaccgacagtatgttattatgcctccagagtcgacttgctaacagtgaagcaaattcaaccacaaatttattagattctcacctatctcaagattatcacatcaaagaagcaagaagatgtattactggtgaggaagccaaattcaaattctttcagaaaattcactcaactttagatctgtaaaatagtcaacagaaatgcttcccacaaaaagtctacagggcttttccaaaaataaaaagagagaaagagaaaagtcaggccaggcacggtggctcacgcctataatcccagcactttaggaggctgaggcgggtggatcacgaggccaggagactgagaccatcctggctaacatggtgaaaccccgtctctactaaaaatacaaaaaaagtagccgggtgtgctggcgggtgcctgtagatccagctactcgggaagctgaggcaggagaatggcatgaacccgggaggtggagcttgcagtcagcaccactgcactccagcctgggcaacagtgcgagactccgtctcaaaaaaaaaaaaaaaaagagaaaagttagtaccaaatgaccagaattttttatttgactaaattctattccatgcataagcgtgacagtctcctgtgtttatctgactttggcaataaaaaaacaagcagccttgtgcaatggtgccatcttggctcactgcaaactctgcctcccaggttcaagcgattctcccacctcagcttcctgagtaactgggattacaggcgcctggctaatttttttgtttttgtttttgtttttgttttttttgagatggagtctcgctctgtcacccaggctggagtgcaatggcgtgatctcagctcactgcaagctccgcctcccgggttcatgccattctcctgcctcagcctcccaagtagctgggactacaggcaccagccaccacacctggctaatttttgtattcttagtagagaccggtttcaccatagccagaatggtctcgatctcctgaccttgtgatccgcccacctcggcctcccaaagtgctgggattacaggtgtgagccaccgtgcccagccaatttttttttgtatttttagtagagatggggtttcaccatattggccaggctggtattgaactcctgacctcaggtgatccacctgcatcggcctcccaaagtgctgggattacaggcgtgagccaccatgtccggcctatatatacattttttttaaaggcctgtctccctttggccatatcgagattaagctcaggtcattaaaaacagacagattttcaaaatcacttctttacttctccaagatcttcagtgctgtcatcatttacctctggccagttttcctgaataacatcaattatgtcatctgtaaagtcttcctgaatgataatttcttcctcttctgttactgaggcaccacacaatttttgagcaaaaaatctttgtgcttttttaagatcaatttcaaaagttagaggccacacattcatgttacatgtttcttctctgttgtgggaattttggctgtgtaaccttttctggtatggccttcttttctttgttttatttgacccctttcacctctcttttgtattttattcttctcttctgcccctgctgttccttgaccctcattaattccagcttcttgtttgggtgaattttcttttttttgttgttttttgagacgtaggctggagtgcagtggtgggatcttggctcactgcaacctccacctcccaggttcaagcgattctcctgcctcagcctccagagtagctgggactacaggcatgcgccaccacgcttggctaatttttgtattgttagtagagatagggtttcaccatgttggccaggctggtcttgaactcctgacctcaagtgatctgtccccctcggcctcccaaagtgctgggattacaggcgcgagccaccgcgcctggccctatttgggtaaattttctacagtaagttttgcagattcatttggaaaattcttctctaaccattatctacatttagcaacattaggcatgtatttacagtagcctgttggtaatgaacagactccacaataaaggactcacagtgggtaatcagcatctaactcggccctgttccttaggtctcctttgcacttggccccataggattcagaaatgtctgcagccatttcacaaacccaggtggttccctctgctattgccagttgaagcgacacatggaactatcatctgtattttccactcagtgtttctatttatattctccatagccccagactgtaagtctgagccctcttcaatgtgacatctgttgttttcctcctaagacacaggatcagttccatcattgtcatccttattgctgttccttggacacatgtgaggttgttattgaaccttttggaccaaagtgctcagaaccgaacacagggctctgggcatgctccacacagccacagagtggagcaggctcatcccctttcttgctgtagacactctacctctttttatggaccctaatgactcattatgaacctacaatatgctactttgcccaccccccatctttttcacatgtgctggtgtttagctgtggagcagcactatgatataatggagactattttggagtcaaacaaacctgggttcaaacctcagctctaccactctctagtttacaattcagtgtctctgtgcctcaatttcctaatgggtaaaaagggaggggaaatccttccttataccatctgagcttgtccttcagtaatttgtattttgtatctaagtgtaggatcttgcattgtctacattgaatttaatctcattagtgtgtctcataattcctaattgtcaagactttttggtgacatcttgattctgtcacctgtcctgttagctaacccactaagcagctttattttaccttcagatgtgcttgtcttgccatgtgtgtgcttattcagattattaattaaaatgagtgtgacccctgggtggatcactggggacctcccttacagctcacttgtatgtatcaattagtagatggtgcagcagaggggacaatctttcagctttttacaaatctatcttccttagcattgggaggacttttttttttttttttttttttttttttttgagacagagtctcgctctgtcgcccaggctggagtgtgcagtggcgtgatctcggctcactgcaagctccgcctcctgggttcacgccattctcctgcctcagcctccagagtagctgggactacaggcgcctgccaccacacctggctagttttttctatttttagtagagacagggtttcaccgtgtcagccaggatggtctcgatctcctgacctcatgatccacccacctcggcctcccaaagtgcttggattacaggcttgagccaccgcgctcggccgggagaactgttatacactgttggaggatatgaaaattaccacaatcttttgggaaggcaattagcaataattaaaaatgtgtataccatttggcaagaccttctattgctaggatgtatattgtagcattatttaaaataggaaaaaaactggaaacagcatcaatttctttcagtagaggaattatcatgtaaactatggtccatttacacaatgaactggttagtggccattagaatgaggtagacacatatgtactactacacaaaaaatgtttaagatacatgttagacataaaggcaagttccagaatgacttgtttaatatcatgccatttttcttaaaaacaaaaaaatgggaaatatgctcgtcaagatgcgagaaaatttctgaaaagatactgaagaatataatagtaattgtttctggagaatggaaatgggagctcagtaaagaagctggagctggaggaccttaactttccacttgatgccctcatatactgtttacatattttacaagcttatattcattcaactgaagagttgaattttttaaaagaagaatctatgtagttgttaaaaagaacaaaatagatctatatgtattgacatagaaatattcccgggctgggcatggtggctcacgcctgtaatcccagcactttgggaggccgaggtgggcggatcacgaggtcaggagatcgagaccatcctggctaacatggtgaaaccccgtctcaactaaaaatagaaaaaattagccaggcgtggtagtgggtgcctgtagtcccagctactccagagactgaggcaggagaatggcgtgaacccgggaggcagagcttgcagtgagccaagatggcaccactgtactccagcctgggcgacagagcaagactccatctcaaaaaaaataaaaataaaaataaatattcccaagatattttctttagcagagaaaaatttttcagtgtaatatctatactactgtcccatttatgaaaacaaattatgtatatgtatatataggcttatgtatgtatatatatttttgtatgtatatatgtatgtgaatgtgtgatatgtgtgtatgtgtgtataaagtaaacacatctttgtaaatgcataaaaagatctgggattattcagaccaatctagtagcatggttattagagggaaaagaagtaggttgggtcatggaggatgggggaaagaaaaagattttaacctttgtgtagtttcacatttttataatcagctttcatgcttacatttgtaattttttaaaagttttagtttgttttttaaaagaatccattttccctactgccatgttatctcagcagtttaacctaggaactgaagtaaaatcagcgtaactgcattcattcatgtattgaactcactctggaatagactctatgaaaaatcaaaggaattattttaaaactgtggataccatttgtattctgagtttctgtattttgtggattccctgcttaaagtcaaatatttgagaacattcaaataaaatcagggtgtcatatatggattttgattacattatcctcaaaatatcctggccagattcagtcttcctccgtcacatcccacaagtataagtagggggtgggggaagataatgaagacagtgagaagctttggtgggctttggatctgatgcagaaatgattcaggacttttgggtctctgtgggcatgtacaggcctgaatgcagcatggagcaacttgagttcatttccctctgttgtagcctttcacaaatgtttacctaaagggcataaaataagcatgagtgtttgcaatgttaaacttcagttatctggaaagtgtactcatcagcctattttctcctaactttctagttgatgtcaaatgaataatgtgttcctgtttcattgtcaccttaaactcctatagacagagtttctatatctccaagatcttttgtaaaataggtgacacttaaattagttaggatttattgtaggttaaaaccacaattaggtactacttcaccaactccagaactgcaaggactgaaaagctaaaagtttggtcagagaacatggaacaactagagctctcatatatcttgctaataggagtttaaattggtgtgtgtatcctctttggaaaattttttggcagtatctgctaaaactgaacacacatacgtctgtgtcaccggatgtatacccaacagaaatgagtacttgtatccaccaaaagacagactcaaaatggtcatagtggctttattcttttttttttttttttttttttttgagacagagtctcactctgtcacccaggctggagtgcagtggtgtgatctcagctcactgcaacctccgtctcttggattctagtgattcttgtgcctcagcctcccgagtagctgggactacaggcatgcgccaccacacctggctaattttttgtattttttgtagagacagggtttagctttgttggccagactggtctcgaactcctgacctcaggtgatccacccacctcggcttcccaaagtgctaggattacaagcgtgagccaccaagcccggccagtggctttattcttaatagccaaaaaccagaaacaatccaaatgtccatcaatagaagaatgaatgcgtaaattgtggtattcttccagtggactactacatggccatgagaaagagtgaaccactgccacaccagtaacacaggtgaatgttgcagaccgaatgacaaaggataaacgcctgactcaaatacacatcatatgatttcattttcgtaacgctcaagagcaggtaaaacgaatccatggtgatagaagttaggacagtggttctcttttggcatgtggttgagtaatgactggggaaatgaacaagggagccttctggaatactgaaaatattttctatattgatctaggtaatggttatgagggtgtataaatgtaaaaaaaaattatttggctgtacacttctttgtgccctttactgtccactagtactacacatcatcggaacctggagcttgtgttcagagttcttcttcagggtcctgggaaaagtgggattttttttgttgttgttttttgttgcctagtctccattgcttttgtcagttcctgcatgtatttttgtctttacacctcatcaaatgtggttttagcaagggatgggaagtgtcttgctctgtaagactcacaacatttttggagttgggttatttcccctgtgttttggttaagtattcagtgaagaggaaagtgaaataggtaacttttattttaattttttttaatttttaattttttttcttaagaaacagggtcttgctctgttgcccaggctggagtgcagtatcactatcatggctcactgcagcctcagccttctgggttcaagtgatcctcccacctcagccttccaagtagctgggactacaggcacacactaccatacctggctactttttattttttaattttatttatttatttatttatttcttgtaaagacaggatctaactatgttacccaggctagtcttgaactcctggcctcaaataatcctcccaactcggcctctcaaaatgctgggattataggcatgaaccactatgcccagcccagtaattttttaatcattaaagaaaactcctcatattgacagttggtattcagcatgccagtgcctctggagtcccatctctccctctgcgatgctgagcagcaccttgcgcctccctgtggtgttccattctacacttggcagtgttcaaatctctgggaggcagacagttgcaagtgcttcagaagcctagggcatgcaggtcattttccatgcctttgaatccccttggaaatctgctaaaacccctagaccccttctcagaataatgtttttaaatacatgaaattaaatactaggattacaaaggaaaacagttgtattgaaataattatcaacatgatttttgaaacctaatttatgatacagtaatatatatgattttaaaatacattaaataggccagatgtagtggctcacgcctgtaatcccagcactttgggaggctgaggtgtgtggatgactcgaggtcaggagttcgagaccagcctggccaacgtgacgaaaccccgtctgtactaaaaatacaaaatgcagtcaagtgtggccgggcgcggtggctcacgcctgtaatcccaacactttgggaggccgaggcgggcggatcacgaggtcaggagatcaagaccatcctggctaacacggtgaaaccccgtctctactaaaaatacaaaaaattagccgggcgtggtggcaggcgcctgtagtcccagctactcaggaggctgaggcaggagaatggcgtgaacccgggaggtggagctttcagtgagtctagatcgcgccactctactccagcctggatgacagagggaaattctgtctcaaaaaaaaaaaaaaagctggtgtggtggcacacacctgtaatcctatctactcgggaggctgaggtagtagaattgtttgaacctcagaaacaggttgcagtgagccaagatcacgccgctgcactccagcatgggcaacagagcaagactccgtctcaacaaaaaataaatacattaattaattaattataatacattaaataatgaatctagcagcaggcctcataaatactgtaattttgaaaagtgaagagtgtaaacagtattttaagatatcagcaatcactataatgaattctgaaaatatctttgattttttttttgtcggcatggttaccagaactgtccattctatagtttttttgcatatattcataactgaatgaaacactaaattttagttagaacttagggaaaataaagttatatttgttttgccccatccaagtttatgccccgctctctgtgctgaattcttttagaactggcatagagcattgtttctcaaagttcagttttcatcagaaccacttgtaaaacagttgctggttccccactcatagagatcttaaggaagaagtttacgatgggcccaagagtgcacattttaacaaatttgagaagcacagaactaagatctgttgctgctacctgaaagaagcttgtctgtgccatccacgcatctcttggaggccccagaagtttaaacgtcctgatgacagcttaggagtttactctctaggcgagagagaaagacgttcatgacagtgttgcttttagtagaacaaagaaaaataactgtgataggcaactgatcaagcacaataatgtgcaattatgcagtgaatacatggagttgttatgatgtaaatacatatttattaatagtcatagtgggaaaatgtgataccaaatagtatgcctattgtgatctctgtatatgcaaatgaaaaattgtggaacaatacacgaaaatgttaatttgaaaattcaggtgatttttgtttaacctttgttttctaatagggctaacaagttttttttaatgtgtcaagtaaataaaagttttagaaatactaaaaaataaaaaaataaaaagataaaaagtttactctctaggctctgctctagctttgtaggatccaaggccttgggaccatgacaccaaccactgtggagtctggctgaggccagcttccttggctggactccccctatgtctggtcagctgatgcctgaggctggctggtgggtcatgccatcgctgcatgccctgcagtgtcatagtggaaagacctggagaccaggagtactgccagtagttcatggttataaagtaaataactgttgataatgaatcatgcgaaagtcctacaaggaacaaaatccaatgatatgctttcaccaaaaggtaaaaactaagaggtaatatcttgaataggtaatcaaaattaacatcaccactgaggaacagatgggtattttgaaatatgataagctgaggacaaacctcacttacatggtattccagccaagtctgcataccctgaatctaactggggaaatatcagacaaacccaaaatgaggagggaagatgctgcattcttcaaaaatgtcaaaatcagacacaaagaagggaactatagacactggggcctacttgggggtggaaggtaaggaatgaaaaattacctattgggtattatgctgattacctgagtgacaaagttatctgtttaccaaacccctgcaacacacaatttgcccatgtaacaagcctgcacatgtaccccttcaacctaaaatacaaaatggaaacaaaaaaaaaaatagtgacagtcaaaaaatgtcaatgtcataaagacaaagagtcagtggaaatgttgcagatgaagggagtctaaagaaacacaatgaaatgatcctgtactgaagagagaaaatgcttaaaatgacattgttgactcaactgacaacattagaatacagatggcatcaatgttagacttagaaaagttgataaagctctactgtggttacgtaagaacatagccctactcttgcgaaatacacactgaagtatttagggatgaagcctattattttacatctgagtcttaaatggttcagaaaaaatattgtatatgtgtgtatgtttgtgtgtgtgttgggggttgtgaacaaatgagccagtggggtaaaacattaacagtaggtaaatctggtaagtaaaaggtaaacatgcttttttacactgctcttattcttgcagcttttatataaatttaaaattatttccaaataaaaattcatatgtatgtagcaatagctagttttttaaaattccagaaaatctgataaaagcaaaataatactaaaattttcacctacgtttttactccttaataggcttaaaaggcaggacataaaaaaggacacagaagatgatgtaatggttaagataaaaaaagaaaaaagaagaaacctctggaattggaactggtttcagttccagctccactacttattatctctgtagccttgggcaacatgtttaaactctctcagtctcaatttcctcatctgaaagtagggggataaaatagaatctatctcataaggttgatgggtggttctggagataatgcatataaaatgcttagcctaatacttggcatttagcactctctcaatgcatgtcagtatttccagagcaatgacaaggacagagagcttcccgtttcattttataaggtaacataaccctgaaagcatgacagaaatacaaatagaaaggaagcctatagatctatcacacaaatatgatacataaatcatttgttaaagtcaagcagtatattaaaagaatactataccatgacctagtagggtggattccagaaatgtaagaacctttcaatgccagaagagctattactatattcattattcattcattacattacatactgtgattccccccatttaacctgttctctcaacagttgccccccaaaaaaagcttttggtaaatttaattttcattcctgagaaaagcctctttgtaaacttccaattgaaggaaacatctttagcatgataaagaaactgaccacagacatctagtaaatcgctagaggcatgtcaaagtcagagagtatgttccagtagtctgtcttacatacgtggcacgatggagatatcaacaaagctgcaatagagtgacatcagtcatgcgggaaaactgacatctaacacagtctcagcccagaccatgcaagattcagacatttactgtaaacagtaatttaatgccttataaggattgagaatgatagagtgttcaataagtagaactgagttaattgataaatgatttggggaaaattgatccttcagagcatacatcaaaataaatgataaggaatgaactataaaaatgaagcatctaaaagaatatagaggtaaacagtttcgttaatgctgggatgggggaattttttatagtaattaagcaaaagccataaagggaaaaaaatgaaaaatttgcttatgtaaacattttgaaacatctatgtggccaaaaataccatagaacaagtttaaaagcaaaaatttgatcagaagaaattatttgcaatctatttcaaagatttcacaaaagaatacaataatcagaaaactggcaaaggacataaacaggtaacccaaaaaataattgtaaatgaccaataaaaatatgaagaaaagcttcaatctaaatgttatacaggccaggcgtagtggctcacacctgtaatcccagcactttgggagaccaataatcacttgaggccaggagttcgagaccagcctggccaacatggtaaaccgcatctctactaaaaatacaaaaattagccgggcaagggggcatgtgcctgtgatccctgctactcaggaggctgagacaggcaaatcacttgagcccaggaggtggaggttgcagtgagccaagatggcaccactgcactccagcctgtgcaacagagtaagactctgtctcaaaaaaaaaaaaaaaaaaaatacattttgccattaaattgtaaggaggcaatgttgacagtatagggaagatggtaccctcagccattgctggtggaactataattttgtatcagtcctcctagatgtcagattggcattgtgttgcagatcctcgacaacatgcataccctttgacaaagaaatttaacttctaagaattatcctaaagaaataattgaataagtaagtatgcaaacgtggaattagaagatgataaattttatttacaataacaaaaattggaagcagcctaattgtccagtattattagttgtatctatataataaaagagtatagagccaataacacaggattatatttattgacatgtaaaatagttattggcaaagcaagccacaaaactgtatattcaatataatttcatcttattaagaaaaatacgtatgtatatgcatggggaaaaaaaaaaacagaaaaaacctaccaaaacatggattaattctagatgaattgtgcctgttacaggggtaacaaaaagaagggggttcctctagggggcaccaactcccaaatactgtggaagtttcagcccagaaaggagaggtacttggtacccattttaggaatagctgaactcaccggttcactggttatttttcctacaccccaaaggcctcctggatgcttccacgatgtgaatttagactgggtgtcttttctaatgagaacatgcagccacagcccttgggtgtatgcttttaacaatgatttttctggttctttggccgctggttcattgccaggttcatgtttactttctgaataagcctcttaatgtcacaactttgttccattacagaatgcaactgccctgcctggtacttggcgaagaacagacgtgcacttagagaacccagaataccacaccagatggtatttcaaatattttttaggacaaggtaattatgctattgtggtggtagggaagaaagggtattcaaaatggaagttagtgttcatataacttctggtatcctatatgagtgaaactagccattttaggaacactaacatcagggcatttcacttcaaggtcagtagtaagctttgtaggctaaaagattcagagtctcagccctaagagtttttgctcatagtttcctttttttatggacagtcatttttatccctggagagctaaagattagatcatctgaaaaagtgatttgagagataagacgaattttccagggtggaaaaacaactttagacctaacaaggcaattgccctgtctatattgggttttgaatacttagttcaaggcaatgagggaaataattggttccctgagctccagggcctgtatagaactagagagacattagactgtagactctggcatcattcatacattcaaccatgacaagtatttatcacctactacatgccaggcaatgtgcagagcaatggggatacaggggcaaagacactcatgatatgggtttggatcctgatcctgccattattaatcaaaggaccttacactagctactctccatttctctgagacgcagttttcctttctgtaaagtggagatattacgagtgcatatctagtaggtttgaatggaagtttcaatgagatatgcaggaataatactaagcccagtgcctggcacataccaacagctcagtcattaatagctatgtacatttaaagtgaagggctcaagtgaaaatatacagaaaggtggaaaacaggagtgtggttaatgacaaaagatttggagaatggaagaataatcactattttgagattcaaaatgagttagagaaattgcttctcaggctaatgtattcatttgtagatatgatgcttgaatgatgaaatgagagtgagcagacctaaatgatgcctttaaagaaacctgactgtgtattattgtaagaagttcctttatttggccaggcaaagtttattggtgtgtgggggatacagaagcagttattttaaaaaaggaaatcagcaggaaaaccgtcatcttcccaaacgcttgcaagtagtgctcagagcagtgaggactttagagaaaaatggcgccatgagtttggatgccttcaggtgcagtaacagaaaacctgactcaaactggcacaaacagtaaaggatataacaaaaaacccagaggcagggcaagccccaggcttgggggattcagaggcccagtaatgtcaaggacccaggccttttccgtttttctgcttccccatccttagtgtggcagcttggcccttgggctggccctgttcagggtcacaagatggattcaggaattccaggcatcacttctagactccaccaggtccagaggaagaagaagacggtatttaggagtgaggaagcctctctagaagccccttggcagatttctccagtctcattggccagaatttggtcacatgttcattcctgaaccagtcactagcaaggggcagaggaatacatgatcccccgagagagatcagggtccatcccaagctggctttgggattattgttccctgagcatgtgggaagggctggacaccacctgcagtgtcctctaccatctgtggttggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacagtaagtatatggctcacacttgaagcaaaatttatgcatcagtttcaggagataacccctgtgctgtggaactgtgtgccagtttcttccagggcatgcctcatagtcttctcgtgattcacctctgagaagttgacagtgcctttgcccaaagcaccttattttctgcaccaggagactgttttctggccttttgaaaaaaaaaaacttatttattttatgtttgctaattaccgcattctagtctcttctggtttaaatattttctttgggatgactttgtctcttttgggcaaagaatcaagcctttacaatttttttgcctcctcctgctcctcttgtggttggtatttgtgcacatggggagagggcttatgagacctaatggtcacagaagagaactgtggatccacatgggccctctgtctgacttccgttgtggagtgactgatccaacctctgaactcgtgaccacggaagtatagttgattcctctggctcttttgggtcattggaaagcatttgcccctgaaacccacagtgccagctatttgccttttgttgtaaagtcactccttgtcctgatcccaggtctccgctagtctctgaatctcttagaagctctccatcccttcctggggcacatccgctatgagctataggtcagatgtgaggaggcaggaccattgccataggcctgtgtgtgtcatacttctggtcattaacatttgcagccactgagttgctacccttctccaagttcaaaccaggtgctgcctggacttaagattcccgtgcaaggccatgcccgggaaggggcctctggttcaaatgctctgaggtgcctccaggtcttcccttgacagatttacagcatcccacaatgccttcaaagcctgtccttggcatgggggcatcaagagccctggcatccacctcttggctggcctttcttccttcaccccttccttcctccctccctccccctccttcaccctcccgctccctccctccctccaaggcaggagagggtgggtttcccccttcttctacttttctggaatggactttctcaatgtccatatcttcttcctccaggaagtagcaatcacatcctcactgagatggctgccatgtatgaggagagacagagtgggacaaatgcagggggaacatttgcttattttaatttccaaagatactgtctatatgacattataagttgtgataagcactctgaagacagagaatgacagagcatgctacaggagccccacttagatgagacagtttagggaaagcctcctgaggcggcgcccaggaaacagaggcctgaagatggaagggagccagtcatttgacgagtagaaggggaatcagagagtgttccaggtagaaggagcaacaaatgtgagacaaacaagggttactcatacctggtattagagaagccaaggaggtggaatttaaatcccaggactgctgtgaaggcagcataggggcagggcatgatgagaagtgccagtgccttcacccaacacctcttcccttggccttcagttatgtgccaaggacaatgagagggttctcagctgttgatggaagtgctgaagggagggaggaactgagaaatcaaaactgagcattggcacaaggggtcagttattaagcccctcttggcctgaaactagtgctagaggctatgggaagtccacagaaatatgtgattcaaccctcgctctcccaactgccagcacacatcttctaggttataaagcagttagaaaactagctaggcccagcacagtggctcatgcctgtaatcccaacattttgggaggtcgaggtgggaggagcacttgagcgcaggagttcaagaccagcctgggcaacatagcgaaaccttgtctctatgaaaaataaaataaaaacttagccatgcatggtggcttacacctgtaatcccagctctttgggagggtaaggcaggaggatggcttgagtccaggagttcaaggctgcagtgagctatgattgtaccactgcactccagcctgagcaacagagcaagaccctgtctctacaaaatcaaagtaagaaagataaaaaaaaaaaaactagctaaacatataactctactctacacagtcttgcatatctctactgtgtttcttctaaatacacagaaatggctcacacaaataaaatatgaaaaatgatttgtacttattttgaaaattatatccaaacaatacagcaagtgaaaagaatccaactactcagagataatcactgcaacaggcttctagacatccgtccctgtagacacacacctgcacacacacacctgttacacagggtaatcttcgatgtgcacttctgcatccttgctgtgctcactgggtgtagcctgatacatacatgcacttgactctacctgtgcatttgatgcttcccctgaacacagaaccattttacttaaacattgactctggaagctacaaaagggaggagatgaggaagagctttaccagtttgtggtgaagaaaaacacaaatccacaatcccaggagccctgagtttcgcacccacataggcagctcatgaaggtgtcactgtcacccagtgcagcactggagccctctgctgtgccacacattcccccgagctgcccttggcttctctttaaaactgcctttgggctgggcagggtggctcatgcctgtaatcccagcactttgggaggtcaaggcagaaggattgcatgggaccaggagtttgagaccagcctgggcaacatagtgagaccctgcctgctacaaaaaaaaaataaaaataaaactgcctttggagtgttgggtaagaagaaaaggtagtcaaggtaggatctaagctagaggggcagattcaagaccatctcttagacagggaatgcagtgtaggctggagccagttaaaaagcaaagccacagaagaactcgggtttcaatgggaaggacctgtagaatcagaaaacgtgtatttctatcgtaatattcatctataattggaaaaaaatttaatctctgtagcacaaactacaaaaagaaaagctcagcccagtttccttggctaatggagaacccataagaagggctctctctagtgcaacttctcatcctcagctccaaagacatcctcctccctgggctggagaggggtgagagtagcaggtctccaaggatgtagttatgaaagttttgtttatgcaacgagaccatgggcttggaaagctcaaagaactcctctcccttgccattgttcagagcttggacagatgaattggcagatgtgtcccaatagcacaagaaaaatcatatttctttgcccattccctaaaagaaatgttcttaccctcctctagccgtttgtgatgacaattttattactaatcaaagtcaggaagaaagttttaaatgtgtggtatatgataatcccttttgctaactgtgtagtgtgaacctttgtggatcctaaatctatgtcacctcttcttagacgattaggaagagaatagcactcatctgttcctgggtggtgtggacgggagactgaatcacttaggcaattcttcatttcctttttagtcaaaatatattcattgagtattcctataatgagtcacagttggtactcatttaggagaaaggagactttaaataagaaaacacagataaatgtaaaagtgtgcattatgaaaatgtctctgaaagattcaggggatttctagttcaaaaagtttttgactgggagacattatttttgggtcccattgaacatgtggagactgttgtcttatggtctttgaggcttatttgatgcttggctcagagaccaaattcccagccgggcgtggtggctcatgcctgtaatcccagcactttgggaggctgagacaggcagatcacttgaggtcaggagtttgagaccagcctggccaacatggcaaaaccccatctctactaaaaattagccaggcatggtggtgcatgcctgtaatcccagctactcgggaggctgaggcaggagaatcgcttgaacccaggaggcagaggttgcatgagccgagatcacaccactgcgctccagcctaagcaacagagccagactctgtctcaaaaacaaaacaaaacaaaacaacaacaacaacaacaacgaaaaaacaaattcccttctcatctggttcagatggctcaagtgctctccataatacctaagacactgaagacctgtatgttgaaggccatgctgaaatccacacatgttggggtggagagatcctggaagttgctatcaaacctgagcaagattgttttcagtcatagaatgtgtttattcatatacattccccttgaggagaaagaagaaagactgggcatggctttcttttgaatgacccgagaggctcttttggagaaggaagttgtagaacttgtcactgatttgatgtttggacttttccagggtacccagaaaatatgccttccctacagtcccacaaaaactctttctgtgaagtccatcttaaggtgagttctaatgggtagaaaccccacacatggatttggagccctttatacactgtttttgcctgtgatcattctgatgttacctttccattgtcttgagccttgactgtgtgtaagatgttttgctaagcacttgacatgacgtgcatcacctcgtgtcatcatcacagcaaccctgtagggcaggtgctgtgactgtgccattttatagatgaaatggaggttcagagagagaaagccaagatcatatagcaagtgtgtagtggaaccaaggcctgagtccaggtccaactgattttgagcattgctcttaggcatctctccttactgcattagttgccagcttcttttttcttgcatgcactcagatactttagttttataaagataatcaagaaatatttttccttccatttttctaccttgaaatagaaacccagatgtcagcaaagaatgtacttattcttcgccagacagaacgttaaatggatggaacatctggctgcttcctgctcagccacctctcgtgcccccaccctcccacctccctctcatctctctcccatgcttaggtggcagcctcccctagggaatgccgccacttggatccagcctgttgctttgttaccagctaagatgttacatcatagctatggtagcttctgtttgtcaggcactgtgctgaatgctttatgagtgttctctgagtcaatctttagctccatgaagtagatctattattatctccactccacttatcaggaattggagcctcagagaagtgaagggatctgacaaagatctcacagctggtaaatcacggagctggagtccatgtgactccagagcttgggctgtttaaccactaatgccctatcgtatgaagggcaaagcttatctcagagccctagtgatttcctctctattcgtctgcagctacatggtggtagatgtgtttccagtgttcccaggtgacacctaatagctacaactcatccttaccaaaatggctcttacagtgacaaacttgactctatctgttggggactgcatctggctgactgaaaggcaccaaggccgggcgcaatggtgcacgcctgtaatctcagcactttgggaggccaagtcaggcagatcatgaggtcaggagttcgagaccagcctggccaatatagtgaaaccccgtctctactaaaatacaaaaattagccaggtgtggtggcacacacctgtagtctcagctactcgggaggctgaggtgggagaattgcttgaacctgggaggtggagggtgcagtgagctgagaccatgctattgcactctaacctgggtgacagagtgagactgtgtctcaaaaaaataaaaaaaaaaggaaccaagattaagaagtgaaaaatgttatatcccactttcaagcttagtttggtctccagattgcagaccttttcctgtctgctctgtatcttctgatttttcttctgagcagttctaaagcctgagttaagcctctccaccaagaggctaacatttttgctgagcacagaaatatcctgctgctttcaaggaactataaatcttaatttgcttggagagtaataccttaaattatactggtttaagatttctgtgaattcttttttctaaaaagaagtttactctagctcctttcttctttaagaacgtttaaaaactaggcatttcatttgttataatttcatttagtttatgagcaagtcttagcttttcagtataccctcatagctggagcaaggtacagcaagattttaaagatatgacaaactacacattctacagttgctgccagcagagaaaagattttatcttcttttgttacaagaatgaacttgaaaacttaaaaggaaattaaaatataaatactacagagtcacataagcctagattcaagtcctggctctgctttttaccagatctttttcctgttatttaacttctgagcttcaatttcctggggctaaaatagtacttgcctcataaggactaaatgagaaaattcatgaaaagcatttattacagtgtctggtgtattgtaagtagtctagaagttcgttattatttttaactttcacttataaatattggaatattagctgaaaggaactctagagatctatttcaatctccttgttttacctctataggaacttaggttcaagggaatttacgttgcttgtccaaagtaaaacattttaaaaagtcttgttaaggatggtcttttgccctatgtggcatagaaatttcagttaaatcttaattacattcattacttttagtaaataaaaagaagaatctagaagaatagccaaggttacctgaaacagatgttcctgatttctctctccctctcttatgagtatcactaggagccagttatataagtcaagtacatgtggtgttggttactttcatctgtttgttcattgataactcatttgttgatttgtatcttctgagtgtcaggccctttagggaaaacagctgtgattttctagaagctcctttttagcttctctgatgctgcagctcatcctgtccattctatttcagtgccatgaatctggacaaatttgagaaaggccccagggaaatttttcatcctgaaatacaaaaggtaacagaaaattttatgcttcataattgtacaaaattgattacagtgttaggatagaactgacaggtcatcataatccttatcctgggatgcaaagccaaatcacctatgcaactttaaaaaaatcatcatgggagaacctcacacctaaggttctgatttgatgggtctatggtagggcctgggtatctgagtttttcagaagttcctcaagtgattctaatgcgtagccactcctgagaaccgcagaactgtcctcaatccacgaaccaatagggtgtacattcagaaaaatcttattggcttaaaagctaccctttttactgagtaatatagaattgtgtggaacattaaagaattttttttttaatcgaaatggagtttcactcttgtggcccaggctagagtgcaatggtgcgatctcagctcactgcaacctctgcctcctgggttcaagcgattctcctgcctcagcctctagtagctgggattacaggtacctgccaccgtgcccagctaatttagtagagatggggtttcaccatgttagctggtctcaaactcctgacctcaggtgatccacctgcctcaggctcccaaaggtgctgagattacaggcgtgagccaccacgcccagcctggaatgttaaagagatttttaaaaagttaataaatacaaaacgtggtcgattgagctcttactcatgtagtagactgcgctggctaccatcgaggataaaaggtatccagaaagccattcctgttttcttaggtcttactgttaagggaaaacaatctgccttaggagagaaaaaaatttagtcataatttaggtgacggtttatcagaaaaatgtcaaccaaacttttgtcttgtagttataaccaatttagctttgaaacttacaaacacagccatcactagtagagtgcctgtcatgtgtgaagctgagattgaagtagttgggtacgccagggatgggtgacaagagaggaggctggagaggcaggctagaattctatccaggaggcagcagggagccagtagaacctttaagcagggagcatcgtgctcaaatttgcttttaggtaaatagcaagaggaggactgattggaacatgaacaatctttgcttgtatatctttaaaatacggttagcttttaaaataaggttatcaactcttggcttaccccaaatatagagagttgtgaattctcatatcttttgttttgatgtaatttttaaaatagtatttacatccagcctcaaccccagacggaactcaggcaaaaatgggtatgttagtttaaactgtaagcgactttaagccatccaggcttattacaagtgatactttatagcaaattttaaaacaaactagaattataaatatgtcagtacccatgtgtccttattacttcactcacacaggttattattcctaatccttctttaagccttggtctgatcccccacaccaactctgcttcccagacacggagccccaaaacccacagagccagagctctgtgatgcttctttctgcctcttgctactgagccagttccctcggcagagctcacctctgctcagtcatccctgtctgatttttctaggagaggaaaagaaaaaaaaaaaagatatagcagcattctgcctatttatatcacaactctgtgcctgtttttaccaaacaaaaggtacttttatgctttcctacatttgtattttggcttttttccccttaacaaaaggaaccatttgtgaactttccccttgtcctctgtgtgtgtgagtgtgcatgtgtgtgtgaatttgcacatgtgtatgaggctcagagatgcagggtgaaggctgtcatcacatttctgtagatttcccttaggaagagttgagcaacaggctttaggtagagaggaaagagttcttaaaaatggtaggagccagagagtaaacagaaagtaaaccaactgtgttataaagaaggcatctttccacaaagagggaaggtggctggtgctgtttttaaatgttatttgtctgtttctggctgctatactgtagtaacattttccttgaccaaaatccagaagcaatgtgtgattaagctagctttaaatggatagagaaaaaagggtatctgtgtgtttcttcccactcctacccatcaagtttgtttccagatagttgcgatatgtttcctaaatgaccaggtattttataaaaaccggtagagctaaatttgatttttaaaacacttctaggtttaaaaagtgtatgtaaaatcactctcccaaatctcatatatatgaaaaaaatcagtgtcagcctcaaactaatgattagaatcatgcatacatcaaaagtaatgccagtaggactgtattgagaaacaccattactagccaaaattatactttctgggctaaaattacacactagaaagcagcaaaaaagaggacttccgatgctcacaaattcaggaacaagaatattttaaaaatctgaattatgttaagtgggacattggcaaaccagggcaaattgcaggactattcgcttctgaacaaatgtaatccaaaataaagaaactgcaacataaatgtaacctgacagcctatgacatccctcctgcctctacagctgagtgttgagactctagccctgagctcagccgggactcctgttgcaaggctctgattccttcagcctagcccactgaggagcagcctctattaccaggccagggactggttgcaaaacatcccagtcctaatgcttgcagggctagtggcaattgagaagctgagaggtgcgatccttttcttattcaccacagttagcaaggaaggagcactggcgtgggtgttaaaaggactgggcgtgagattcagagctgacacttacaggccacgtgaccttaactggggatccaattcctccacctgtgattcaggaacaattaaactgcacccccccataaatatatatatatacacctactgatgtacccataaaaattaaaaataaaaaaattaataaaaaccacaaggtgttgaggaagatcaaagtaaaccatggaaagagagaattttgtaatgacatacacagtgacatgcaaacataatgtcccaatgtaaaaaatgtgtaacataattttattttttcccagaattcagaaataatacagccaggcgtggtggctcacgcttgtaatcccagcactttgggaggctgaagcaggaggattgcttgagcccaggaattggagaccagtctgggcaatatagtggaaccccatctctacaaataatacaaaaaaatagctgggtatgatggtacacacccatagtcccagctacttgggaagctgaggtgggaggattgcttgagctcatgaggtcgaggctgcaatgagccaaggtcgcaccactgtgctccagcctgggggacagagccagaccctgtctctttaaaaaaacaaaaaaagaaagaataaaataataaagatggctgagttctgaatgaaagaggctttctgttaaataaaatggaggtttgtatgcctcttacagttctttcagaattgccatgtctccagttgacacagctcttccccagagagtcttgggccagaaggaggatgagggtccctccagcctccgtgcctccatcctgaccctcgtcgcctctgcactgtccccatggctcacctgggccattccttcccactccgttcagccacagggtccctgtcagagccttggctttggtgtccgcttatcaaccagaatctacttttttagaagttctggaaaagatgggacttccttgtaataagtttacaaacttttatatggggtgactaagaatgaaaaggaaagtaatttaagttgattaaatctccgttgtgtaccaggtcttccacacacgctgacagtgatcttcacaggggttaagacagaaggaaggagagacccaaatagattaaatgacttatgcccaaacacagttaagaatgcgacagcagggattcaaaggattgtttaggtttgctgctccatgctgctcttacgagatggtcttataggggaaaaagatccaagactcgtggcacccacctttgtcatagttgggtttttttcccccaaacaaagctcctataaccaacttttaaaattattttcaaaatgtcagtgtgagcaaaccaaagcttggctttcacagcaagtcaaaatgaaataattactgttatgcctggatgtaacttttaaaactttatttgacaggacttgctggttcttgaagaacaagaggtgagtaattctatggagatatttgcacctgctctgcctccatgtttgtaaatatatttctcctttcactgtgaacccagcctttgctttcagccaaatctccatgtagatttgcacagtgggacacattgcgcggaaagaacttactggcatgtatttttaaggtatattttagaattttctatgcatctagctataaagctatgaaaacaatcaaactacttaaatctgcttggaaacatttaatgtgttaagcttatgatcagggtgagtaatgaggttttaattttcattaaagtagggtgtgtgtgctttattaggatgctcttaatatacaaaatgctgaatttatttgcatgttgccattccctgttgcccccattaaaaatataaatatattggattttctaagtatataactaacatagggaaatatctaaaatattatcaataggcaatggagtaaataaattatggtttatgtatcttatccctctcagtaaatagcagtatcttttgtcttgttgctcaggccaaacttggaaaaatccttaatccatgtctttctctctcatcctatatctaacctatcagcacatcctggtgacacctcttcataaaatatccctaatccaaacacttctcaacacttctaccacaaccactctggtgtggggatgccaccccatcctctcttgcctgggctctgcagactctcctaactcttttcctggcttccactctcaccctctcttctggtttccagatagtagccagttgtccttttgaaacatgtggaatcgggtcatctctctgctcaaaactctaaaggtttcctgtcctgttcaaagggaagccccagatcctgaccctggcctgctggagcctgcatgatctggcccctctacctctccaatcgtcagctccacactcaacatactgaattccttattcttccatctcctcagaaagagcctatagttcccactgctggggatgcttgtcccccagatgtcctcacttaatcaggacctctgctcagagagaccttccctgaccactctgtctagaatagtacaccctgcctgtcacccttagcctctttgatttttcttaatgctggtattttcatttgtgtgcttattatctgtctcccccatgagaataaaagcaccatgagagcggagactataagcaccatgagaacagagacttctttaattttgtgttcccagatcctagaacagtaaaaatagaaggtatagagtaagtatttgttggttgaacaagtgattgattgattgatgattgattgattgaatgaatatattatgaaatgctatgatgccattagaaaaaataaggtagtaacacaaaggataaatgcttgagaggatggataccccgttccccatgatgtgattattacacattgcatgcctgtatcaaaacatctcatgtaccccataaatataactactaatatataatacacctaatatataatactaatgtataatacacctactatgcacccatagtgcaagagtgagatagagtactatggtctgaatgcttgtgtccccccaaaattcatatgttaaagcctgcctaccaatgtggtggtattaggaggtggggccttgggaagtaattaggtcatgaggggggagcccttgtgaatgggattagtgcccttataaacaagggagcttgtttgcccctttcaccacatgggcatgtagcaagaagccaccatctattaacccagaatatgccccgccccagacaccgaatcttccactgccttgatattggacctcccagcctccagaactgtgagaaataaatttctgttatttttaagccacccagtctatggtattttgttatagcagcccaaatagaccaagacatagacctttacttattggcatggaaagattgccatcacatagtatttactgaaaaaagcaactcacaggacattatttacgtataatcccaattatgtttttataaacaaatatttttatgtatattcattcattcattgattcaacacatacttattgagctcctaccgtgcatgtaccatgtactgtttgaggcgttgcggatacatcagtgagcaagaaaggtcccttcttcacggagcttacagtctggtggggtaagacaagctaaacaagtaaacaaacaaacagaaacatggtaagaccagtaaccccaagagctgtgaagaaagtaatgcacagaggtggggtgtgtggtgagggggtaggttttttacattgaacagagaaggtttctctgaggcagggacacctcagttgattcttgaacatgtggatgtaaatacaaagaaggggctgaaaggatgcaccccaaattgttggcgggagttgcttttgggcaggacagtggaactggggtgggatgcagcagagagcaggcaaagggagatgcttgctttttttattttttaagagagggtctcgctatattgcccacgctgacttccaactcctgggttcaagtgatcctcccggctcagcctcctgagtagctggaacttcaggctcataccaccatgcctgactacatttttatccgtattttgtccatcttagattcatgcttgttgcaggagaatttatggacttcacatgtaatttgtaaaaggcaaaaagtaaaaaaatcacatttctggtaaaaatttgaaaaagaaatacacaaaagataaaaggaaaaaatcacctgcagtcacaaagacaactgctattaacattttggtatatatgtttgttacgttttatataaaattaggattatatatagcttttgtatctcaaaattactctgttcattaatccacagatatttattgagcacccactgagtgcatgcacatgcctgttgtaacaaacaaacaatagagagaatgcactgatgggaaatgtgaacacttacttcccctgccccgacttcaccactttttcaggggctggaccctgaaagaacgcctgttcactgttcattgcatcctcctctgctttttttgaaactcccaagttgtgaaaaataagttgctgatctctttatttttcaattttatttccttattagggggatattagcttgagacaacactagtcacttgtcatgacatcttggagtgtgaacaatggccatgatcctccagagcttctctgagagctgtgtggcgaggcactctatttaatcctgctgcttctcaactgggataaattgggagcatttatcccaattccagcctattctagtggtaaactattagctgcaaagatgggcaggtaatccaataaagaatactagtgaggctcccgaaaggttagcactttggtaaaatgatgtcagtgtcctgaaacccatgttttgtttgctgcatagagaggcacccccacaagagaacatggcatcccaagctgtactacacatggagagaggaaagatgtgtaggaacttgtggaaccctagaaatatggaggtgttgcctaaacaagagtaacaaggaaccaggggtgtctcattttgaataaggccatcatttctcaggtccaaaaaattcttctggaatcattgggactttagtttccccccatagtttgtttttctcagaagaactataattcatagcatactactgatttccaagaatgtgactgcctgttggtttgtaatcaggttgagttttgtcttgtaaaatttagaacttagaaaatttaaattccatccaagcaggaatgacagatgtgaccttatctgtatgttgaatgtctgagcaagacttacatcctgagaaaaccagtacctgtgaattccctccagcagcacctccctccagggacccaggtctggccttgagaccttgagagctctgaatggctggttaaaatattatctgcgacagtccacttgcaccagatcaaactatcccctcctaaaatatgaaatacctcattataatgagccataccttgatttctggagataggtgaaaactgttagtcatggacataatttgggaagtcctggacaccatattacctaaatgaggctgtataagtaggttcaagtacttaacaagtacttccagtctttctggaatctccacctgaaacaggaggatttcatataatttatcatttaaactgggaccctttgagagtaattactaataacatcaggacaacagataaaacagatataagctagggctgtcttggcaaacttggacacatgatctccctaccttgaagatcctacacccttgggtgcacaggtacttaaaagacccccatcatgcaacccttgctgctttacagactttgctcttgtctgaccctaataacttgtgatgaagacttgacaagaccttgcaaaaccagtctttctggagtctccacctgaagcagaagaggtcctcagcaggggtatggtagcatggtgccagtctcagagcaatcctataaaaccttttaaaagcattggccagtgatcaggtggtagtaggccccatctctgcttgtacatctcagtttcacttgaaacttttcagagaagattatgccatgatactggaaagaatgctggatcaaaagtcagaagacccaagttccagctccggtcctaccgttcacttagttccagccatgcgcaagtccctgtcttccctgagcttccctgtcctgtcttaaaataaaagcatggactcagtggactatagggtcctttctggttttagcaggctgtcagtttatggctcagagttatggtcattgacctagtccttcttgctagctgtcagctcagctggacctgatcctgggcctcctgacagcctcttggttttttctttagtctagtggttctcaaagtgggggccctaggccagcagtatcagcatcacctcggaacttgttagaaatgcaaattatcaggccctatcccaaacctgctgaattgaaaactcctggggtggaacccagcaatcttcagtttaacaagcccttcaggtgattctgatgcctagtcaagtttgagaaccactactgtagttcctgcactattattctaagaggatcatatgtcagaccccaaattactgtaggtgctttttaagggacccttgagacatgtgcttactgtcatcacttcgaaaacagagaaagaaaagttataaaccataaaaccctaaagtgaatagaggtccctggaaacattctaagaaatttatcaaatgctagtttgtaaggaagcagtgatcatttggagacatcgtatgaaaaataagttgtttctgacaaagtttcttttctcatttattatgcatacagtcacttatgtcatgaatatttattaatcttttccaatgtactatggtcaacactggggattcaatggaaagaaaacagtgtatgatttctcctgcacaggactcaggttctagtggtagaaacagatacgcaagttcaataaaagatttacagagtgtaaatagtgcttcgaggagaataaacaaggttctccgatggagaataacagcaggaaggagggtggctttatatggggagatcaggaaaggccactctggaaattgacacttgagctgaaacctacgtgatgggagagagccagtcatccccggaactgtggaagagttccaggtggaggggtcagtttgggagtgtcctctctcttcctgtatagaaaaccactgttagtgatgagtgtgcatctcaggtgtgttggggacagaaaaatgttcggatgcacagccttagaacttggattttcggatttttaatactctcagatccagctatcctgaatcctggcaatcgccttgacttcctgcctctgacccattggccagtgtgctttaaatatctttgtcccttgtctacccttaattgaccaccaagaatttcttcatctagtggtgggtcaaccaaccttgtagaggtcgattctcttccaacatttgattttgtgtttattatgaaatacttcaggtatacaaaaaaaagtatagggaataacataatgaagacctacaaaaccactactggccgggcatggtggctcacacctgtaatcccagcactttgggaggctgaggcaggtggattgcctgaggtcaggagttcaagaccagtctggccaacatggtgaaaccccatctctactaaaaatacaaaaaaaaattagccaggcatggtggcatatgcttgtaatcccagctactcaggaggctgaggcaggggaattgcttgaaccagggaggtggaggttgcagtgagctgagatcacgccactgcactccagcctgggtgacagagtaagactctgtctcaaaaaaagaaagaaaaaaaaaaaccactacccaatttaaggaagaaaagcattaaaaatatgattgagtccctgtttacgcctccctgcccctgttcctctgtcttcctcccttccctgtggaagctgctatctatcatttccaccagatcagaattaattcggtttaaagttggagatggtagattgcacatttgtaccagctactgcttgcttggcttgggcttgctttttttttttttttttttttttttttttcacatctgttttgtgacttcttcagattgaatatctttaggaattggggaaaatgagcttttagtataaattgcctataattttcatttctgtgtctaaaagagtccacaatatatcagcctgagattatgttaagctttgaattacaacgaactcttcttcgctgactgggatttggacggttgctcatgggttgattggaagatggtgccaggcctgtgagttcctgtggccatttgttggaaccctgttttgccacagaacagaactggtatcctagagatgccattagtaatgaaattacaaatgaacgaattcataaaagcatacagtctcatctgtaagctataaatacctatcaaaatgaaggaatgattgttgttaacattggtcaataacccagatggatgggaggaagggatcccctgactgtccatcctggtgactgccattgtgctaagtcacgaacagcccatctcaaaactatatacgctgtgatgataaaattaactgtaacaccttttgttattatcctaagggctctgtgaatttcaagtttggggttctttttgccaaagatgggcagctcactgatgatgagatgttcagcaatggtgagtgatctcctcccgctctctgctgccagagaccctgtcctgccttgttgcattcttgccagttggagcttaacttgtctgttgagttggagtctttaatacgaggagatagttttacacaatttcagcgtgaattttgtagggcagttgttgcccagtttcattcatttggcaaatatttattgatcacctcgtttgtacccagtcactgttccgggcactggagagacagaagagcacatgggatttggagaatttggttctacacagtcccaagagcagtggaagatttttctgtgatttttatgagaggaagaattataagatggcgtcatcttcctaatatttagcacttttcgtgttaaatacctgcttattctgaacgcaagcagtaataacatttttgttttgcgatagtaaacacctgtggtcccaggctggcagtagtaagctgggttcatctgattctgcagttttcctttccttggagtcctgggaattgtggggcttcctcatggtgctcaagaagaaggaaatgtgacttacccatgctgtttaccatgcatgaatcggcagagcccagttaattttccagcgattccggtccatagttagaaaatgaggacttgttgatgcccatactttcctcatactctacttcttcctgcagaaattggaagcgagccttttcaaaaatttttaaatcttctgggtgacacaatcactctaaagggctggacgggctaccgtggcggtctggataccaaaagtaagcctgcctcttgatctattctgttgtaatttgtataacttttgtaagtcagcctgacccgtgtctgaacttataccagagaagggggaagggatggatgagagaagactggagggaggtgagctccacaccctgttcaacatagagtcatggacctgtttggcatttccattgagcttcgtaaaactaaatcagccctcacagccctggacagtgtcagaagtcctggtctgcccatgaatattactgctcagcaccatctgtgtgccaggactctggggatatagaagtggataaaccaacatggggtcctcctttctaggagcctgcagtccaggggacatccagcagatgttatgcagataatcatcaaatggtttagcactaagtacagaaggcaactgagaagaaaaagtacagagtgctatggggcattttgcctaatctgggggattaaggaaggcttctctgagcttttttgaggccagagggaggggcgagtcggaataattggagggtctcgaggggagaagagaattccaagcagagagaacatccatgaagaccttgtggcagaaaagaacatgttgtgttctagaaactaagagaatttgtttatggctggagggaacgaggcactgagaatgatgcaatgtggcctggagtaggagagggggcatgaccctgaagggagttttgaggttatattaataagtctgcattttattctctgtcattaaggggtttcaagtaggggagtggtgagattagatctgtacctttgagcagacaggggaggcagaggagaagcctgctctcagaggctgtggcaacagtccaaacaagagacagggttgccttgggagagggccataggtcagaagggagacaggggaactaattcaagagccattttcatggtagaattggcaagtggaggttgaaagaggagacagtacttgaagacacttcagggtttctgccctgggtagctgggtggggttggcaccagcggtgagattggaaacacctgaaaggaagcattttgaggatgggggcctgagtggggaaggtaggtaagattacaagcttagggttggaagttctttcaccatctcatttttgtgtagcattgctagcttttccctttgtttctgtttttttgctttatttgatcttcacagtcagtccttgaggtaagtcaggcagcgggtgtgaggcccttttggcctaatagtgataggcttcgagtgcaggtctccttaccctctgggagcctcatcttcccaccagcctgccatggcatcacggattctgaattcgggagagctaagtgtgccctaactgacagatgcagggataggggattgggccccagttgtcaggttccagcttcactcgaacacacatagagtgcacaaggtgaattcttcaatgcctgcctctcatacccccgctgccaaccctcagcgtctccaatatggtcataacaaccatccactgagcccttgatacagccaggcattctgctaagcactttgcaaatataatctcattgagtctccccaatatccctaggagttagatacgacttttatcctcattttcaaattaaggaactgaggctcagagagaagtgaggtaacttgtcaaaagccacatagccaatgacaaattgaatccaagtcggcctcattgtaaagcctttgcttttaatcacaaacaattctgtcacaaataccacttccttttggcttatggacataattgtttgtgtcatcttgtgttaatttcatcccgtacctcccacagcaactgcaaggcaaggaagctcaatactctcctctttagcctggacttcttatgaccttctccattctgaggcaaggcatgaattggacagcaagtgagcttagggagagaggaagaggcctttccatgtggggggttgcatcaagtggagggttgttgcttccatgcaggtggataatccaaatatcttggagaatgtcctgtatacagtatttccctagtctgcaaatgaaaatgctttccttttggctcgaattctctgtgctcactgaatgcatatttatattttgcagatgataccacagggatacattcagtttatactgtgtaccaagggcatgagatcatgtttcatgtttccaccatgttgccatattccaaagagaacaaacagcaggtacatgtgaacatacaaaccatcaaatagtgatgtgaatgtggagagggcaccattatgattccatagaattaggggctatgccggttaacatatgagctgagctgtggccaccaatttagggatgcttttggcggtctgtattggaactttctacaaatcttaggaagagctattctcactggtgctgtcaccttagagaaataaggggtcagagataataatgtgcatgcgtgtgtatgtgtaaacatgtataggtatttgtatgtgtgtgagtgtggtttcatagactcttttttgtctctctctttttttttaatatatttgattcaaacattcttctatccaacatggactcttgagagactattttgtataggtgttaccttttctctgtgccttctctcagtgtgccttgtgtcttgtcaaaatgagactctccaggacatatcataagtggtcctgtgtgatggttgacaagtattgttatcaggtcactgcaggaagttaacactgagtatctacatgggatgtaccaggctgggaaaaaacctctatctaagatactcctcacccaccccagagcttggccactgagacaggagcagaggagatgggttggtgagcaagggcctaggctggcaaaacatgggaagcctgaagtcaaagatgtctgaagttcagggctctgtcatagtggctgtggtttgttatattgggttatgtttttttaactctgtgaatgtgccatgtttgagagtctttctcagtgatgttatttatgctcactacaggtggaaaggaaacgccacattggaaacgatatcgtcaccattgtgttccaagaaggagaggaatcttctcctgcctttaagccttccatgatccgctcccactttacacgtatcctgggcctttgtaaatgctccagtgtggcaagctgtggttcagcctcactggacttccatgacccttaaaccaaatcttgtcatggacttgttttgtaatgctagctttagactcacttttggggaatttttcctaagcattgtgtatagttcccccttcctctctccttccatttcagtagtagatggattaattctcagagaattcttgactcctgaaatatggtctcttttctcaggtagtctacaaaatgaggaaaacttcctgctatccttcagtcataaatgatttagaagaattataggtgctgaattctctgagaaatttgctttaggcataaaaacttgcaagttaagataaaaggccaaaataatttttcttgttgatttaagccctggtaatcgctgttgtattaccatctcttgaaatttgagaaatgatagaattaatagtatttttatctgattcccctaatccctgttcagctcatattgctggcaaagtccagcaatggggctgaagcttctgcagtgtctgagctcagctctgccagacaggcatggggcatgagcttgacctgcccagcagacactcagttgtggccctgttgctctgggtcccagaccatgacagcaaaacccaaagttggtggctctactggttatacataataagcaaaaggcaacaaatcagcattttcagaataaattctagtcgagttactcatttccctggaggctccaagtaaacatgtttggagacaggcccacggtgactcatggcatctggagacttggacttgttccttgtgacataaaaatagaggatggaagtaagtgtttaaaagttaacagtttccaaactttcttccatgagggtagggaagcaaacaatatgcacttgcaccttcattagaattttcttcccttttcatccctgctttctgagtaatatctgcccctgtcccctgggatttaggactaatatttcccctttctagaggtggttcttcttgtataacagaaaacttctccaaattcacagtagaagcagtggtgaggtgactgttcaggtgattgagaggtagtcattattttttagaatttccctgagttatacgttttagatttggggcttggcacatttgttcctgaaaaggggcaagcagatcattaaggcagattcattccagggagcctagaaatggagacactaaggaattgatggctccatagccctagccaaggaaagcaggggttgggagatggtgggtggaggtggaaggggaggaagaagagtgggagaaaggaagaagctggatggattctttcctactattttagactctgcaaaccccagcacaagctaagtagattctgctcagaatctgccaccagctacaacaggcttgttttgttttgtctaccaaacccaaaaggagagaaagggaaggtatacagcggaaacatttaaattgctttccctttccaaatgtgtgagatgaaatgtattactaatttcctattgggatcttgtttgtacttccaggcaagggaactgctctttttgctttgctgactgcttagttgtttaatagctatatttctattgcttttctgacagctttggagatttaaaccttttccccaaaggatgcacatacaaacattgaacctactcatggtgccctcacataagtctccctgggctgtctcttggaaagaagtatgggttctgtcccaacctaagagtgataggtgccctaagcacagaagcgctggtcgagaatgactctgcacaagggattttcagagcgcaagctgtcagtcgtgagcatcagtgttgtgattagttcccttaaccatcaccacagatatttttgccttagtgagatacaatcaacaaaatgacaattacaggtaggtaatgactttgtctcgattgcttgtcctaattctcatgcttgttaatttagcattgatttttacaagactcttgatatacatatttcttgattgatttaatatgagtgcctgcaccttacaaaactttcttcaaggccaccatctcttcaggaaacatttactccatccagtgttgttccatgaaggagacctaggggtcagggttagtttgatattttattgtactttaccatgggaacaggtttgatatatttgatcttcatcctttcctagtctacattcttgcctgcttatctttctgttctcaaatattaatctgttaaaaggtattatgttgtaaaaagaacctgaactttgagccaaatagatttgagttcgaatcccagttctatcatttatttgaggctttgaaaaaaatgttttatcttcttgaagcctcaggccttctgtgtagagtgaaggtaatgacactaccccggcaggtgtagtgacaatcagaggcaatactgtatcttaaaataccaagtatgctgcctggtatgcagcaggtgctcagtgatggccattgctcttcttcctgggtacctggcttgatgggttggaccatgaaggattcaggaagacctggtctctatcctcaaagcacattgactaagctggaggggaaagcgaggtagtggcctcggccctggcagaccagagaaggcactcctggcatggagcaaatattcctgacacatcccatatgcagctggataaatggaaggacagaatagtggtgtattacttcattttcatactgctaataaagacatacccaagactgggaagaaaaagaggtttaattgggcctggcgtggtggctcatgcctgtaatcccagcactttggaaggctgaggcgggcggatcacgaggtcaggagatcgagaccatcctggctaacacgatgaaaccccgtctgtactaaaaatacaaaaaattagccgggcgtggtggcaggtgcctgtagtcccagctacttgggaggctgaggcaggagaatggtgtgaacccgggaggcggagcttgcagtgagcccagatcgcaccactgcactctagcccgggtgacagagcgagactccgtctcaaaaaaaaaaaaaaagaggtttaattgtacttacggttccacatggctggggaggcctcagaattatggtgggaggcaaaagtcatgtcttacatggtggcggcaagagaaaatgaggaggaaacaaaagcagaaacccctgataggcctatcagatctcatgagacttattcactatcacgagaatagcacgggaaagactggcccccatgattcagttacctctccctgggtcccacccatggcatgtgggaattctgggagatacaattcaagtggcgatttgggtggggacacagccaaaccatatcaagtgctaatattaattctgcaatattctctacttaggctgaaaatattttcagaagagagcgtaccactctttggccctcccttgccaactccaccagtgtttacagaccaccaggaattcagggactttttgctagtgaaatgtaagtttctgttttgaaacaattttgcaacttgttctatgtcagaatacatttcttcagattctcccagaatgctgtttaaggaaatgtcattgtttaagcattccatgttccgttaattctttgcacaacatgtgtttagtattctggtcatgttgtgcacgttttctcctatgttttcatccccaccttccatcctgtcacctgccttgaagcttctctacactcacccactaaggaccctcgggcctcaaatttgcctttctgccctgtgttctgatagagccattgctgaatctctgcttgtatatgtatctgtatctgtcagagagtgggatgtaggtgggggaaagagtggttgtgggtatatgcttagggatagggagagttgttggggaatgtgtgtgcacacttgcgtgagtgtatatgtgcacccatgcacatgtgtgggaaagagaaagacagaatgagaacataatgtgtgtagaccatgactgccaggcatcacttgctggtgagcacatattttcactctactggtaatacccaaatacccgactctgaggccacatctcttaaagcacaagagctctgcgcatccctcctcagggcacccctgggaattatttctggtagtcccatggtgggactgtgtcattgatcagaaacaagttactcgggttcatctgctgcagcttgctagccgcacgccctggcagggctgcttggtctatgccctccatgaagatactgctttccagcctcctgccaggtatgctgggcattgcagctgctttgctggctgcctcctgtccccacctgcaactcctccccactacagtctttgcctaagtctgtcactgttgccgtgcagctctgagacatctagaatgcccctctcttcactctgtccgtcctggtcacctggcctcaaggaagcattgactgagcccaaagcctcactgagtcctacgtggacaagtgttacccaacctccaatcttaatcctactccagtactggcccaagccagtccctcaggccagggcaagggacaggcacatgttgtttctcctctgtcttcctgtctccccagtcactccttcacagtcccaaacatgacttctcctgcacagaaacagtgccaagcatgagtgtcagttctagtcaccagaaacatccaagtcctggccaggctgtttggtagcctctcttccataggaaacccctcccttccctttcagagaccttggcatgattccacaactttgtcctggagaacagagacatgaaagacacctttgctgaggctccctctgctttccagctgggctgcctctcttcccagctggaccaccagcgttgttacctcccatactccaacctataccagggtccatgggtgatgtctccctcgacacattagaggcagcagacactgcaaaccatgtgcaacagatgatgattttgtctctccctttccagtatttatactcattatttcaaatgctacaacaaggtcccaaactcagatgcctggagagccaggcagggagcatgagcaagtgaggcgggctgagtggaggacagtcaggagtgctgggagctgtgacacacttgagagcatgtgctcactccatccagctgaggcctttcagagcatgcaccatggccagggttgccagatactctgagttttcaaatcaagccagaaagctgaaattgtatgtgaaattgtccgagtctcatgtgttcaagtccagaggatcagacagagagcaagaaacagatctgaaacagagtcagcaacagagtgggtgtagctactggaagctgaaagggtgttggcagcatggggctcaggaagacagcattcactgtagggggcctgtggcaaggaaggggccgctaaagacctgtaaccaccaattggagatcactcagcagcactagggacccggcttataagtggagccagtcaacagatggactttcatcagcgttgtcaaagacttgaggtgaaatgaaacgaagggctgggttgatttgacattgaagatttgaaagtagaaacagcagaagaatgcaggctcaaggtgatggagagggtgtgttgaggagatggagtgtggggccaggaaggaccaggaggggttggtgcgctgagaggacaggtagcagccggcggatcatagagtctcggaattccaaagtggattgagcagcgaggttgaaaactctgagattacaggagatggcatttcaacaaaaatcttgaccttttccttttcagccgaagcgaggctttaaaatggattgttccaaggtactaagcagaaaaaaaacctcaaacaaaaaaattcctagattcacagaactaaagaaaagaacagacaagcatagtttcaattcttgtgtgtgtgtcaagagatatcttgtaattccctttttaacttgatttattttagtaattaatggtgaaaaagccactttggaaaccccaacatttgcccagaaacgtcggcgtaccctggatatgttgattagatctttacaccaggatttgatgccagatttgcataaggtaattctgggtccatggtcttctttccttcttatggggtctgagttgagaacacaagtcctcaactcagcgatgaggccctggtgagaaaagcgtaggaggcgccttgatccttgctgtcaggactgtgctgtggccaccatgggctgacagtctctcattgtgacacaagaaggaaggacattgggtttccatacacaggaatgcgatttccagaaagccagggcctgtggaaatcaaggtgcaaaccagggacagggaggttgggtatcaatcagcaatctctggagcattgaagagtgctttttttggggtggctgttcttggtaatactactcagcattgccagtcacatgagctgatgggcaggcaaaggtgggatttttagaaagacatagggtgcttttttttggagatttattggccagccccatattcaggcactgaaacaagcattcccatttactgaagacccagacacttcgtaggcctgagacatagccacactgatgagacccaacacctttctatcacttcaggtgcacatgtgctcttttcttttttttttttttttttttggagacagagcttctctcttgttgcccaggctggagtgccatggcatgatctcggctcactgcaacctccacctcctgggttcaagcaattctcctacctcagcctcccaagtagctggggttataggcatacaccactgcacctggctaattttttgtatttttagtagggacggggtttctccatggtagtcaggctggtctcaaactcccaacttcaggtgatccacctgccttggcctcccaaagtgctgggattactgtcatgagtcactgcgcccggccgaccagcaccattttataggcactccttgactcttgtctggtcggtgtaccccaaccactcgcagggattgggccaggctaaccccaggaccctaaagagcaaacctcaattggtaatctctcaattccgtaaggtcagggaagacacagagagggtaccaagatgagcaatgatgtccttcaagataagtaatcatatcccagctgaagcatcactgcctgagccaggcttccctagccccccagttgaagccaggtcccctgttaaatgttttcatgtacttgccacacttccccttcatagcagtgatcacatgtgctaaacatgtcgttgcttaatctgtcttcccagtagactctgtgctccacaaggatagagactatgtctatcacattcccaaaatctggcagaagactaggtgctcagtcggtacttgctgattgaatgagcataccccattcagtgactacagttttaaagagaactaacattactaagtatgcactaggcactgtgcgaagtaccttacatgcattgcctcatttaaacctcataacacacctaggagacaggtattaaccacacaaagacactgagattcggaaattaactaatttgctcaaggcgacccacaaggctgcagatttgcacagctctaggggtactgttctcatagaattcagtttgttgtgttccagggggtgctgctgtgtaagattggcatcccagagctgtgcaatgtggtggcccaggtcacactgttagtaagttagtaagtgatacagctgcaggtctgctgatttcaaagccgtgtcctcagcccccatgcaatgctggctctccacctagtgactctgaatctagtatctaccatggacctggtacacagcaggtgctccatcaatgcttattgagtgaatgaaacagaaggtagaaataggaccatttggataaatagttttgtgcactatgagaagccaaaagatgagacttaacaactgtttgtggaattcataacttgtttttcttttttagaacatgcttaatagacgatcttttagtgatgtcttaccagagtcacccaagtcagcgcggaagaaagaggaggcccgccaggcggagtttgttagaatagggcaggtgggttttcttctgaaaccttttctgcgagacatgtagttttgagttccatcctaaccagatggcccatgtgcaaagactttgtttgcctgctgctgtaggagctctgtaatttctgttaggattgttgtggcaaccacgagtgagatttttgagaaccgagtaggtgcagttctctgcaggcatcactgagagagcaacactctgcagaggtaggaatgctactgcctcaaggcaagtagccacagggcccagctctgggcccccctcttccagagaacacagatctcttgcctgcctcctaggaattttctgaagagtgaggagccgatttgggaaatgccccttaaacccatgactggcaggaggaagcacagagtggcagtggcactcacagaagacttgaattaccaccctatgacttggaaacaatccaagtcaccaccaagttaggtggtgcccagtcatccccttattccaggcattggagaaaatcactccctttgccccgctcgcatgtgacactggtatttctcagttccgggaggcgacacagctgtctgccttgatcacacatcacagcatggagaaggaggagtgccctcagctgcaaataaggttctggcccagaagtagaaagctagacaaggcaggtggagagaggaaagccatgtaatcaagggaagcttagttacaaggttctcaaacattggttcttgtttaaagatacccagactttattcccagagattctgattcatcaagtttgaggagggacctgagaatctgcattttttcaagctcatggtttataaatcacagtaatgatatattgattcattgaaatgataaaatgcatttggataatttgggttgcgacattgtcattaaggcttcactgtgtccagctaacttcaattcttgattaacaagtcagtagaggaacccgaaatgttagcctgcaattactcctgttttattaaatttttgtcaaatcacaattgtttatcctgctgtacttttgccgcctagtaaactttaatagagatctctgttctgtaaggcactaaaactgaaatccattgtgagaggggatgctccatcaagcttggcagcttcagggatctgtaaaaaagaggtgagttcatgatactttcaatttgaactttgaattccccttttccttaatgaaaatgattgagattattggaaaaaggtttgagagcagaaggaagaagagcatgtctactgcagagtcctcagggaaagccctagataaaactgagtggccatttagtgagagcctctgtgttgccatggtatgcacatgccttcacctgcttcaatggagcagagctgctggaggaccgacctggtcaggcaggccaggccccacagggcctctcaagctttatgtgcatacacatcacttggacaccttgaccaaatgcgtgttctgatccagtaggtctggagtggggctgagagtctgtgtttccaacaaacttgcacgtggttcctgtgctgctgaccacagacatgctttaaacagcaaggctcctgggcagtgctgctcaagcttcagtgtgtattgaattcacccccagagtttctgattgaacaggtctggggtgggacctgaaagtttgcatctctaatggcttcccaggtgatcttgatgctgttggttagaggaccacagttgaaaaaccaatgcttaatctacagttcactcagccagccaaaaaattctttggctatttatctacatcctgttccactttccatgggggtaaaaactaggtgatcatcaaaaataaaacagacaaaaatacacaaattatattatgaatatgattttgtattgtagaacagtaccccatgtacttaattatatctccattcagaatacataaaagttaaatgggacagatttacagcacatcaccagagaagtgtccattataaaagcaaaataattatgaatacatttaccttactgataaaggtatagatgatgtgagcctacgtgctttaaagtctggtttcaggaaaatgatgagctcaaaatataattaaccctaaaaaccacaaccaacttcagacaagactactggaaaagcatccttcccaaaggctgcagcagttccagtgtctgcttgttcccatgcacagtaggaatttactgtttccaagtacgttatagataccagattccagtaagatttaataatgataagaagtttttaggcttatattaaaaacagaagtctgtggaaccataacttgttcaccaggtaataacagagcgagcgtccattgttgaggtcagtacttataacccacccgcaggccgtagaccacctcagagaaactcagctccagagggccccatgggctgctgctgtgcagttggctctgcagaggccagagccccctgctgttcccaagtgttctgtgcccagagaacccggctttgcccacctcttcagcactcatcgtttcatgagctgtggtcatgttcttagagagtgcccaggaacagtctgcacttagacatgaaagcctggagaccacattctcacctggtggaatccacatgaaggctcccccatggaagggagtccagggcaatggcaaacactgtctgtcgtcagaccagagcaactgtgggaccagatctgagtttgctgctgacactgcacgccccaatattcaacagttcctcagacctcacatggtcactggcacccgtgtaaagcaatggacaccctgcgtgcacctgcccattaaaatggggccgggtgcagtggttcatgcctataatcccagcactttgggaggttgaggccggaggactacttgagcccaggattggagaccaccctgggcaacatggtgagaccctgtctccacaaaaaaaattaaaaaaattagccgggcatggtggctcatgcctatggtcccaactactcaggaggctgaggcaggaggatcacttgagcccaggaggtcaaggctgcagtgagccatgttcacaccactgcactccagcctgggtgacagagcaagacctcgtctcaaaataaaatttaaaaaaaggtaaaatggcatatatatgcagcatttgagtacaattttgggggtttcacagacctccttgagacctctgtggatcctgtagggcccttgaatcttatgggggaagaacttctttctgccttagtgttccaaacttgtgtcttctgggcagaaaacatattgttactaagaactggttgttctgttggtgttacctaatgctgatgtctgtgtcttctccctattgacatttatattaactttgctttttttatgtccttttggtgtaagtcacaaactcagaattgccagaaattttcttggggaaacgtcatttcaattaatgacctgcacttgtttagccttttttccatttacaaaatgttgtcacattctttaggggatctttttagaacatcacaagttccatcttagcaattggaatattctttttgagaccgtgcatttcctaaagggagagcatcctttccttttctaagagagcagtaacacacagcatttaccctcagccctaatgccgttttcaaaggtggtcctcagagccctttgctttaccttgagtatgcaaatgcatgtttgcttgggtacttaagaacacacctacatgtgcacatgcaggctctactacagccccaggtgggacacatcaggccctgatgcctgattgagagtaaaagtgaagatgtaagacttcaacttgggcctgagaatctccacaaactgaggcttatccagtgctttggagggaagctaagaattctgttgaaaatgtccacaattctggtgtgactaagatcatggaacacaatgcctcctactccacacatccacgtgtggctctaaggctccccctttatgcctgagatggaaatgaactaagaagagtttgcttggtatagatatgtcatgcggaaacctgactagctctgtttacagctcttgccaaacagatgttattttttctttaagattttgtatcttatgtgggtcaataggcattttcacgtgaaaacaatatcaaccttttagtgcatcatgtatgttttactaatttgctgaatcagcaacacaggaatctgacttttttatagaattatgtgggacttcctttaatgatgaactaatatgaattctctaaaacagaggcaccatttggcccaactcccaggtgttaaagcaaaatgcttccttagaaaccattacgaatgcgtcaattgcctctgaaaaacattataatacagagacaggttatggtgccagaaacctgtgaattcactcttttcctattgcatacgtatttgaaaggagacttttcttcctaagaaaggtaattgagtccagaccccagggtttggagtgactccgctcccacgggggtatctgtgttactgtttcaggtgtggtactgtacatttccatttggtgggctgcagtgtattttttctggtgcacttatcttccgatgcttgtattgcctcacagccgtgggagccccagtgtttctgcagtaatttccctcatgaagccgtgtgtgcagatccctggggccaggccttgctggtttccactgatgctggcgtcttgctagtggatggttagtgagtagctgctcctacaaatgtctttttcatgtaacttgtagtacttctaagatgagtgaccaccaaccaactccctttgggccataaatgtgtgatctgcagagagtttagcgaagttttatttccttatgaaattaaacccttgtttccagggcaagcagaggaaatatactctgaaccaagcatgctggagggtgggccataggttctcttcccaaaatatatgatgggactgtggatatcaaatgacctgcaaaaagaatctccttttcagccaatacttattatcactccaacattttactttaaatcaacaaggatacattatttagaaccactgtctctgggacattccctctctcgaagtcttaaaaaaaaaaaaaagatttctgattcaaaaagtactgatgtccaaaacaaacaataagaatcttagataacccatttttgatggatatagaaacaaaaagattttgacaaggagacagattccagctcaatataaaatcacacattctgacagccagatagatcagccttcctggggagttagtcagttctctgtcgccacagatcagccaccgtcgcccagagagggtgcaacttcagagcaggtgtagactcaaggacagtgtggtcccttccatcaggagtcccctttagattattccagaccctgaatgaatgacagaggagctaaacactagtaacaggttgtctcctgggcttcagagggagccataggcacagagacaatgtctccaaagggcatttcctcggactgcccagaaacagctgcccagtctctggttaccgtagtgacattttgtgagaatcccaaagccaccactgtgagaatgacataatggcctaaaactgtggcatcttcccatccttcagtacaacctatacgtcctccctccgacgcttactgggcacatttaccgaacacctgctgtgtgccggggccccacgccaggtgccttctgaagcatgataggagatgtgggccgtgcttcataatggatctatttctgacctcatctgttatttttgatatgtgtttcaattgtgtgcccatagtcattgtatctataacgaacttaaggcagataatttaaaattcataaatttataatttaaattcagtatgtaatttttgaaattacaaaatgattggaaactgtgatctgaaagaaaacctctatgagcctcgagtttctctaaattggagataattttttaagatgctgagaatagtttataatgatgaaaatcggtgaaacaaaatgggatgatgatcacaactagaaggaggggattgtaggggctaaataaagttatctgtattaagtgtttacatagtggttggcacatagtagtaacttattaaatggcagctattatctttactatgtctctatgaacttgctaagaggtaataaaatccttccgggcgcagtggctcacgcctgtaatcccaggactttgggaggctgaggtgagcggatcacaagatcaggtgttcgagaccagcttggctaatatggtgaaaccctgtctctaactaaaaaaatacaaaaattagccggatgtggtggcggatgcctgtagtcccagctgctcaggaggctgaagcaggagaatcacttgaacccaggaggcggaggttgcagtgagccaagatcgcagcactgcactccagcctgggcaacggagcaagactccatctcaaaaaaaaaaaagtaataaaatccttagatcttgccaaaagtgaaacaacaacaacaacaaacaagaatgcaaacaacagactttagaagtttagtgcagtctgttagttttattgatgaacaagctgaggcctaaataaatgatatgagttacccaagatcacaaaactggttagtggcacgtctgggactagtacccagatgtgattgttagtccagggctctttccactaaaccaactacattatattaaactctaccaatgtctctaacacagatttccaaaaatatagccctgggcaaataattatgaaaaattttgtgatttaaagaatgttcactccttcccttttgcccttttgggaaagagaaagcatgcttcataatgactattcgtaagcttgcctaaaaccaaaagattctatttgagttgcctctatttttttaaatgcaaaatccaaaccaaaattaccaggttcctttctgaaatttttatcttaaggatccaaaatttaatggaaatgtcagatgtaaggagtattgtgatttgccaggaaattctttcttccaaatttgaaggaagtcgccttcaacaggatggtgggtgtagctgtttacacccaccattgctttggtttatgatttaaactagttttttcatgtccttattgtacaatgatgcttctgtttgtttttgcttaaaaaaaaaagaagaagaatcttcagggccttctttatatttcttgttgtgcttttaagccacaattctcttatttctttgtttacctttctcttgtctacatttaatcatattatgaaatgtttccatgagtgaatccatccattttgtttcagactgagttccactctatcccattagcctttgcttaatttcattagatgtatcccttgagagtctactcctttcaaggtcattattaaaaatcaagaccttttgtatcctaagttagcaaaacctactttgaaaggaaactgaatactgattaaatatgctctcgccctgtgttttggttttgcagtaacagaaaagctggttctaaaagattgttcttcataaagagattacaggaaggaaagcattgtcatcaatcagtcattaaatccacctgtcactctgtcaggtccttgcctcctcctccttcttgtgttgtatacaaacctgttcagccatctgagaaagactggatggagattaagtgctaattcactctgtacacagctcggcagctgtacaatgtatacctctgttcctatgtaaaatgaagggcctctgtcatttattaattccctggagtgctgttgctgctgtggtcgcatctctatccactgggatatggggctgctccaacatcccattttatgttccaacactggtgaagagagcatggctttgtccttgcacaggcttgggctccacatcctggaggtgtgacctcagacaagtattaacaccaggcctcaggctcctcctttgttcaatgggagtattataagttcctacctaataaggtcattgggacatttaatttaaacatatgaaaccctaagcattagggtctggcatatggaaagcccttagtatatgttacctgtccttgctgtgactgctcttctcccacaaatggaataattgtagttatttagccaactatgatgatgggtatgaggatgatcgtccagtgttttgaaaaattaagtctgccccagcggaagtacaaagaccctgagaattagttccattttgtgggagcccagggtagaggaggaagaaaagtggttgatgagctatcataaaatttacatttgccccagtaattgagaggaacaagagacaagccctaggtgtaatactaagcttagcttagtctgtgttctgacaaatctgagccctcagaggcctgcaggagtgggagctcctctccccactgtgggggcagttattaatcctgatggtgaaagctctgctccctcctggaccatccaggacgggatgaactcccaaccacacttagatttctggaaaagaaaagatcctcagggccccttgctcctaaattttaattaaacccaaccccacagcagagcatttgcagaataaatgcaggtaaagaatgagccagccacttctcctgccccaaatgtctccaccatcccggacacctctgccttgccctgattctgccatccatctcagaacagacccttttgcttacagaactgaatggaacagccttagtaattattttagccccctgtgtcctcggagccctcaggagcaaagtaattgttagcaacttagattctcagtaagtaacctcaacaacaaatcctgtgtggaagtgcaatgtcttgaaccatccatttattggagatttccctgagcattcccacttcagttcgtttttcctgctgttttggcaatttagttaatatttctctttatttatgtttttgtctaaaaaggagatttcctattcctttgggaaaaaatactgaaaatgtataggcaaactactactgctacaaacacgggacatattagggtagagtgtgtttatatttatcttaagtccaaaaggaaattttaattttgctttcttgaggtatgtacaatatgacctaagatataatgcaatttcaaatattacataaaaatgagaaaatacttgagaaaaatggctgctcttttttttttttttttaacttggtgttcaggcctttggtacaaccctagtaaaaattggtattgagagatgttgctttttctttgatgaacaaaaatagcgttttcatgcctctgctgctacgccccctatatagagttcgggatatagaattgcctatgggaagaaagcatcagtacttcttcctgagctaggaggagaatagtgcttgaatgtattttgtagagcttatgaaagccctagaagctgacttccttccttgcctagagataacttgggttcaaaactacccacaggcacgtttggtgggttctggaaagcgtgggctgggttgcagtgatgggtaaccaggtttccttttccagatgaccttccatcagtgcccgtgtttgacagaactctgccagtgaagcaaatgcatgtgcttgagaccctggaccttctggttctcagagcagacaaaggtggtattccctgccgggtggcatgctgtggaggaaggaaaacagttgccttctgcggcccacaccacaggtcgccagggtctgactgcataagttctgccagctgtttcctttcctgatgctcagtgcttgggatccctcagtggcccctttgttctctggggagggaagccgttgggggaaaggggtgcatacgtaattgcattgtcaggttaaagtggtgtggggtgcctcctgaattccagaacacctccaatcctagtttttctacacagtctgcccctggaggccctccaggttaccttacttttccatttaatctcctcctctgtcttttttatgtcaccaggaaaagatgctcgcctctttgtcttcaggctaagtgctctgcaaaagggccttgaggggaagcaggctgggaagagcaggtctgactgcagagaaaacaagttggagaaaacaaaaggtgacttgatagattggtagattccattcgattcgtttttttttttcctcaggctgcccaggttttactgaaaataaaaatgagtaggaatttgatcttattagtttgttttttgtttggaaacatcacaaaaataacatcactgtttccagaaggagcttgaaagctagacaaacacattgaggactagaagaaattctaggccttgcataacaggttctagagatgcattaaactctattagcaaatctattactgaagaaatgtttagactggttcccagagctctaattactttaattgatgtcatgtcgtaggtatgaagttaagtccacaaactctagaatataggaagtaggactttctttcctttcccttcctttttcctttcctttcctttcggcagagtctcactcttgttgcccaggctggagtgcagtggcacaatctcggctcactacaacctccgcctcctgggttcaagcgattctcctgcctcagcctcctaagtagctgggattacaggtgcccgccagcattcccagctaacttttgtatttttagtagagatggggttcccccaagttggccaggctggtctcgaattcccgacctcaggttattcgcccgcctcggcctctctaagtgctgggattataggcgtgaaccaccgcacccagctgggaataggactttcttaattttcctgtaactcaacctaattttaatatgtagtctccattttgcctagtgtcggaaacattctcagtccattcactgagttatgcttaatttccagggttcctaggtattgccaaattgtcaaggtctgggggcttccacacccgcatgtcatgtgtaaggcatcatttctttctcctcccaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggtaggtttgctctttaaatcatttatctcccaaccaagttgtcttgaagcagactctgtccttccacccagagtttgttacccactgaggttgtcccactgtttagtagccaactagggaaaccctcatctctggtgcccttgtttcccccagaagactaaagctaaagctcattcattccagtgaacatctacgggtgctgttctaggtacgaaggacacagcgatgaccaaaacaaagtcttctgatggggattactttccagttgacagttaacagaaataagcaaataaagctatgatggctggcataaagaaatactaaaattaaacatagaggagggccagggaacaaaggataatggagcagggagttgggagattctgtttagaaagaatgtcccaggaagccctctctgaataggttacctgtgagcagagatccaaaagaagtatgggagtgagtgatgagggtatctagggaaaggatattccaggcagagggagcagccaggcaagggccctgaggtcctgttgaaggcacagtcaagagcagagggaacaaggcaggcaggtcagagagaactgggaaatatactcttgagccctcaggccattgcaaagacttcggccttgactctgagtgagatgggaaaccactggaaggtttgaagcagagaagtggcaggttttgaaaagattgtcctggcttctgggtagaggggagcttaggaggccaagggtggaaataagaaggcctgccacgagaccagtgcagcatcctggcaagaaaggttggtggctttggtagcaggagagatgggaagaagccgtgggcaatgctttcctgcttgcctcagtcagcgggatttgctgggagattgaagggggagcttgtgagagaaacctccaggctcaagttccctccctgacatcaccatctcttatcttttaaagactagggtacattaaggtatggaatatatctagcattggccactaagatggagtatttctactggagagctgagaaggtattttttgcttagagttaaagccttttgaattatgcctatcaatttctgctaatgttcaacttcaggggacagagcaacatgacagttaagttaaaacacgttaaaatcttgctctacttaagtgttagctttcttcctatagtgatttgctattttaatgaagatttacatgcagcatatacatttatgtaatatgagcactgaaattaaatctcctgagtttatatcttagctctaccctgtgtaaactttgtgatgacttttaagcctcagtttcctcatctgtaagacagaatagtagctgtacctaccttataagtaggattcaatgagaacagtgcctagcacatgttaagtacacaaatagattagttagcaattattaatactattactgaatcccaggacaggaccagacgacataagggataaagcagaccatactgttgattgcattttgtttaattgtttcctggcctcgaccctttccagtagacagaggcctgagtcttgaggacaggttatgggaaggagatgtcggatgtgacccctggcactcctctcttgtcccttcttccctgtagcacggggctctgcaggagcctggagagggtgccttctctgtaaggagggaatgggcagtggggcttggcatggagctggctgctctgttctcacccctgtctcttgtatcctcaccaaccacacaggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggtaagccagcggttgtggggacaagtgagaatcagaaaagagtaatcatcgttgtgtattctaaccctgacatgccatgatttggatttctttaaaattatgtactattcatcacatcagtattatgtgattcactatttagactgagccatgtgaagttaccatttttataggtcagaatggttctatctattatcatgtgactgtcccatttgccctgtttagttttcagatctttccttgccattccatccttccgaataaaagagatatgaaaaggccgggcacaatggctcacgcctgtaatcccagcactttgggaggccgaggcaggaggattgcctgagcccaggagttcgagactggtctgggcaacatggcaagaccctgtctgtatttaaaattaaaaaaaaaaaaagacatgaagagtcaaaaggctgactataataactaaataaatgagagcatttgttagatgatttgtcctgggagggtccttggagaataagcttgacctctgaggcactgcagactctcatcttggggactgggtgtttggggtgggtactgcaccctccctacccccttaaaaacccactaggaaaggaagaaggggtggaaacccattaggagggagtgagcaggcagatttgccctgagagtctacacccctggcctgatgcacagagaacaaggatgtcctagtgtggcacaaaatctagggccacccaaaactgctctcatgttctaaaggtgactgtgtggggtttgaaccttggcgcccactggacagtggtgagcactcaccaccctgaggcctggcagcctgtctgtcactggagagcgttcaacactgacactgacattagcagatcacagagcttttcagcccacgtatgtatctctgtgaggcaggacaaggcctgcttgtcagtgagccattgaggtttgcagcatgcagtgcaagccagtattctggcctaggtactgaggaaaccacagaatggggatgtcagccccagggagactaactcctagtgagggcttccagacccacaggctacctccagtcctgttcagctaaatcaaacagactgcagaattcttccaattatgctttacaacttgtattaattgtaaatatgctctgtataaatattaaaattgctaattactattttaggaagacttaagacctaattagagcaagattttaagaaacagaaaaataagaaatagaaaactgtagttgtgattaggagaccttcttgtcttcagctattattgatcatagagtggtctgtcatttctcttatctatattggtggtggccagacttgtctgcaattggagtcatctgaggagtttgaaaatataccactgcctgtgttcctcctccagggatttcctgggtctggggtgtggcatgggtttgggtatgtttaaatggtccccagataattgtaatatttagccaagttgggaatccctggtatatttcattgctttgcaaccctggctgtcatcccttggagagctttaaaaaggtcagtgtctgaccccaggccaagccaattatatcagaatctgggggggtgtggtacttgagaaccaatatttgtttaagtctgcccccaggtgatactaatatagacctaggagaaggagtgggtcctgaaacttcctaatttaaagctgggaggaatgccgcccactccccccacccgccgccccccactgcctgggcatccctggaccagcatgtcttcctgccactgacttctgaggagctggagccctgatttgtactttaaaagttctcaccctcttggccgggcacagtggctcacacctgtaatcccagcactttgggcggccaaggccggcggatcacctgaggtcaggagttcgagaccagcctggccaacatggcgaaaccccatctgtactaaatatacaaaaattagccgggtctggtggcacacgcctgtaatcccagctactcaggaagctgaggaaagagaatcgcttgaagccaggaggcggaggttgcagtgagccaagatcgtgccactgcactccagcctggcgacagagtgagactccgtctccaaaaaaaaaaaaagttctcacccccttcttccttctcaaaactgtgtaagcagccaaacaaagcagaaatgccatggtgcagcaggtccttgttcaatcagtccttttcctggcagctagtttcctaagacttagccagcttttgctagtggaaaagtcctcacctcatttcagagaaactttctgacaagttctattttaaaataaatcatgcttaagtggctgaaaattatgcagtttacttactcatcagggtagctatagagaatatcattttattaaatttcttttatatggtggtttttattatttacctatatttaatgtcctataattcattataggatttctttttcctatgatttgtaaagaccctggataaattgggttaaaaaccattttctttgatgacttctgtgctttgttttttggatggctgtcaggaacaactctcaagttttctgtcctctcttctatgtgcttcttaaaagacaaatatacaaagttttttcctaagagaaaaaaaaatgtatttttgttgttgttgttgagactgagtctcgctctgtcgcccaggctggagtgcagtggcgcaatctcggctcactgcaacctctgactccctggttcatgcgattctcctgcctcagcctcctgacgagtagctgggattacaggcacagccaccatgcccagctaatttttgtatttttagtagagacagggtttcaccatgttggccaggatggtctcaatctcctgacctcgtgatcccgcccaccttggcctcccaaagtgctaggattacaggtgtgagccaccgcacccggccaagaaaaaaaagtttttaaggaaaaaaaaacccttccctatttcctggctctgagaggatcagcgtgtacagccctcccgtggtagaatggcggctgcacagctcccagcaggcacggtgcagtgcacagctcccagcagtgcttagtcagatgcactcactcatctttcaaggagggtactgtctgtctggggagatgagccctaagaaaatgaaaaagataatgagctgtatgttttctaatagctggttagaaataggccttgtgggaacaggactagctttttaccaagatgttcctgcagctcagcacccagggcagtggggacaggagagagaagctgacacagcgtaggtcattggaatttcatttccattccgtctacattcgctgcctgcccgcctctgtgggcaccagtgttaactgggcaggcctcgcttcctgctcccattcctcctctcttagccaggaccacttgatacctatttcaggcttgtacccaccccgggttctgtaacaatcctagctcaagagaggaaatgtttaagaagcactaaaagcaacattctgaaagtcactgacaagttcactgtaccagtgggcctgctgtgacccactgccgctgctttaaccaccagcactgacctcattcccaaaaccaagtgctcctctagggggaactgcaggcatagccatgggatctgggtccctggtttatgggaggggctcaggtcctcatcttgacgtctgcccagaatccagtggttctcagctgggggctgagcccagaatcacagggaaggctgaaggcagagccagctaggagaggtacagttcctacttcacttgttacaagtctgtgttttgaatttttacaaccaccatacattatttgttatcattttaaagtaccaatagaatgaactacttattactttttattttttttaagagagagagagagagagagagacagggtctagctctgtcccaggctggagtgcagtggtgcaatcatagttcaattctccctcgttggcctaccaaagcactagaattacaggcgtgagccaccatgcccagccagaactacttattgttaatcaaacttatgaaataaagatttaatgcctatgtcctacaacagacctgccatatcagggtctccaggagcaagaaccccaccaggcccctgtcccaaggtggagacagacacctatatcaaagcataaaatagatctcattgtgctaagtgttaataaaggtctgaataataaagtgctgtggcatgcctgaggaggaagtggttaagggttaagtccaagcctgtttctgaatcctggccctggggctgaagcctgccaccacctgtcctgcagcccaactctctgaatattgccacgtctgtctgcctgtcagcacagcgttggagccccttggtagacttacttgatgccaagtacccccctggtgtctgtggtcattgtgcatagatcttggtctaaaaggctgcctgaacttcctccatacgtgtcaccactgccaccctccctcaccccaccccaaacacacacacaggccttatctctaaactaaaagcctgtctagttccacctttcccactgcagtcaaccctcccataattataataattgtggccatcactgaatggccacctctgtgtaccaggccctgggtcagagcatgtcataagcgttatgtcttggaaggggctcttcatttctccttttttttttttttttttttgagacagagtttcgctcttgtaccccaggctggagtgcaaggcacgatcttggctcactgcaacctccacctcccaggttcaagcgattctcctgcctcagcctcccaagtaactgggattaggtgcccaccaccacacccgactaatttttttttttttttgtatttttagtagagacagggttttgccatgctagccaggcttgtcctgaactcctgacttcaggcccacctcggcctcccaaagtgctgggattacaggcatgagccaccatgcctggcacatttctccatttttattgaaaaggatactgaagtcagaaagaagaagtcacttacttaccccagagcacacagctagtaagtggcagaggcaggacttggaccccagctggctgactccagagaccatgttcccacagctggtggggatagcaggtccagccacaaagctggtagcactcggcccctcccgtggagaagctcccagtctggcagagcagacacggtgcagcacaaagcctctagctgagatagtgaagtaaaactaacatgtacagggacatctgaggaggaagggattttaagtcaaagtggtggggccaggaaggctcctttctggggtcagaggagactccaggaccatccttcatgtaatatacccattggtgctggttccttatctaaataaaggtatcagccaacattgagcatttaccgagctccaggccctgtgctaggtgcttagataagttacctcctggagtcctcaagccagtaggcctagatactcttattttctaccatcttacaaacgaagaaactgaaggtccgagaggggaaacaactggcgtgagtgcgcatgcctctgaagtgatggagctgggatttcatttactcacttgcccatccgatgagtttattctatccctgccacccgccaggccctgatctggatgatgaggggccagcagtgagcagcacagacaggcctttgcgtcatgagccttagatctcatggggaggggagccacagggaacaaacagacaagagagcaccagagggtgagggacactctgcagagagcctaaaacacagggcatgataggagccatggggattattttggatttgacaacccccgggtctgtccaatgccagtgctggagctcttggccactggtcctcactgtcactccctgctgagctcctgcaacttttggttgaggcatttgccccattataccttgttttatgtacttatgtgcttttctggttttttttcttaaggggtcaacctcaccttattcttttctgtatcctagtggcactgaatacagtgctagataatgacagatgggagagagctggggattccattggaaggggcacccaagcccaggcagtggcactggctgaggatggccagttggggccttggcaccataatgagaccttttagaggtgaaggctgtgttctggtgacaccagtgaagagaagggtcagccagtgcagggccagtgggaggagcacagtgtggacggaagggctgggacagaggagccagcaggagcccacaacatggtgctcctgtgaggaggtcagggcttagcctagaacagcagcaggggcacaaaaaaacacctgagaaactgtatgaagaggctgctgctggacttgggttggaggtggccctgagactttgagaatagttatgctaacaaaaaggaggagttttagaaggaaagctggttgtgtgggagataaaaagccaatagccttcactgagtgctcatcatgcatgaggccctgtgctaaaatctctgccttgtctcactgaattcccattacaatccagcagggtcagtgttctcatgatgcctgctttacagacgaagacctaaggccagaggctaagccatttgccacacaccacagaggcagtaagtggcctagacagggcttgatctcccatctgtctgcccagtctgtgcccctccaaccaccccacccccaatccactacctcctgcttttaatgacttggatgtggaatcagttacatctgagaacaaacgacatagtctaggggctgcagccctggggagaatgtgtgcctgagcccgtgaatttagggttttgggcacaaagcaaaatttggagctatagaagtggggttttactaaggagagaagagccaagaaattgaagaataatctgaggtgggagagagggcaggaggcagaagatgtcacccatcagaggctgcagagggcaggatggatagatgagcagaggccaaggccttcggttggggagaaggagatcttggctgagctcaaagggtggttttcctggaagcacaggaggccaggctctaagggttgagaatacaagtgaggaagtgaaaggagcaggaggctcttagagggctggagttttgaaaatcaagaaggaccaaggacaccatcaggttgagtgccctcctctcaaatgcagaaactgaggcccagagagaggagtttgccccagaccacggaactaggtgttctgacacccttttcattgcaccatgctgcctctcttgacatgaagaacagagaaagaataaagtgtgaagacatgccgtggcgattttaaggtgcacagactttatctgttggaggcagaaggatgcctcgctggaggtacgagagcggtaaggttgaaagagaaccagaacattagttcagatgttggctgtggcgtgtaccagtcaagggacttaagtgacttcaccctgagcctcactttcatcttctgtaaaatgataattataccataatgtcaataatattaggttgatgcaaaagtaattgcagtttttgccattggaaataatggcatataaacctgaggcatttcaatagagagaggagacataccaaacacagagcttctcaacggctatgaaaagatgatgagaaagtcccagagaagaaagaatggagagacttttctttcttttttttcttttcttttctttctcacttccattgtattataatcccagcccccaatgtgcattgtgggtgctggtggggcagacatgaccctatggcacctgcatgacagagggcctcggcctccacaaatgctcacaacttgtaaaagtcttttcacagggtcagcatccagcctgcccactaccgttgcccgttatcattgcaggttaattttgttgcagctattgatgtgtacgaagatggagaagctggtttgctgttgtgttacaactgtaagttaaggatgtgcttttatctttatttgcttaaatggactgctttttttttttctgggcaatttaaaaagattgtccttagatttacccagtgtatcattcctgggtttgtaattgccttccaggaaggaactgaaaaataccttcctccctgagtctcccgctgcgcaccaggcctcttggtgacacagtgcaagaactggcacttgtgatgctatctccaggatgcgccagtgatgacaatggcttccagttaggaggcccttactgtgtgccaggtgccgtgctcggtatgctgtggtcattgtctcacttgattctcacaatgaatgcccgcagcaggctcggttattatccccagtttagagatgaggcaactgaggcctagagaggtgaactcgtcaaggtcttgtggctactaagcagcagggccagggtttgcatcgggtgctctcttgactccagcacccacaattttaaccactgtcgctattctacattttgctgtttctcaggtattaatgaaatcagcctcaacccagggtatccagcctcagttggcctagtttggattaggtggcagggtaggtgttgggcagaccaaaggtatcaaatgggatctttaaggattttcagcatttcaaaagctaatattataatacattttcataaaaatgatgttttaagggtaaaagaaaagaagtaagctattttcctagataaagctgcccagtctaacaagacataaaacatgtttttcggcctaggattttatcaatttagagtggtaatgctgggtcagatgttttgattaattaatctttgattaataagtataagaaagctaattattagaagagaaggttgttttataaacatcatctttcaaaattcgagatttatggggaataaattaggagaaggtggttaaacctcttcaacaataaattgctctttggggacattttatgcacagaactgtgcaccctcctcagaacagcaggtctttaatggcccatgtgatgagaagggccccatcaaggcagcaggaatgggccactctcccacaccccatgggccaggccactgccactcctgctgccctgcatccccaggtttatggctgcatggtagaagtcacttctgtaagaaattcacctttctaaaataaagtatgctcttttttctgagacatctatagaataacttgtggcagagtgttttaaaaactgatttggattttttttatcctttaaccgtgtgaaaggatggaagggattttaggtggaagagaagttaagaacagaaagatagagcaggtttttagagtgggagaattaatcccaaagaaaaagagggcatggaaacaaatgtggatgccatgggctctgtgccagacttgccagtgctgactggaacaggccgggctcctcactcagcggctcctgcctcagctgtggttcccgcagcctctgggtctcacggaacccttccttgggagttccatttctcatggctttgctcatcttccggcttcaggctctgacttcatctcaggatgggatcggtgtgtgtcttgttttcatagatccactacatcagaagtatctttacatctctgtatctttacatcccaaggtcaaggccctggcaacctcagaggttcccatagcttcagtcttccccaaaccatgccacttcctcccatttctttgggtcaggaatctggcttttgttttccatatttctttttcccaagacattgggaggcatctggtgaacaacaccaataaaatagttctctccccacggtcatccaggtcacttctctaactcattcctgcacacacagcacacgtggaatttgcctgtttagtctatgttcttgacttgatcacagacgcctgtacaataaagccccttttcaacaaggtgctgcagaatgataatgctttccccaaaatctgaaactgatttgtatcattgaagtttttttctgtattaaaaataaagcaaaattaaaaataaactttatgtggaggaatttttatctcagatatgttagagttgaaaatattttataatggagattgcaactttcagttatgtgttatttgaaaaaaatatatattcacttggtaacctttaggggaaaaaatagtataaattgttcaatatgctactaatattgggttttttaaataattaaactctatttttattaccagaatctgtctttaactgtttaaaaagacaaagaaaaagaaaacttggctctgcccttagcacccagtaatcattcacctttaatgcaagtaatttcagtgctaagggcaaactcttgtgtttgctgatgatgctttaaagataatcatgccaggaaaactagaaaagctcgcataagtgccccttgtttttgatgcgatcatatttaacctcactaagtcttcactttcagataagtaatagtaagaatacaaaacctgcttcttaacaactgttgtaagtactaagcaggatgatacatgtaaagcccacaacacattgcctgacatgacaggattttattttcccactatttattccagaatcatcagagtatttattcagaactcagttttttaaccttcatagactttcttttttttttttttttttttttggaggtggagtttcgctcttgttgcctaggctggagtatggtggtgtgatctcagctcactgcaacctctgcctcccaggttcaagcgattctcctgcctcagcctcctaaataacagagaggcgacgggatccacaaggttgaagaggagcactctggctgctgtggggcattcgccgaaggggtaggggtagggagaccagggagaaggtgactgcgtatgtctgatgagaggacagcagtgggaccagaactacagcagtggagatgctgagaaggtcaggtccaaaatacatttctttttttttttttttttccagatagagtctagctctgtagccccaggctggagtgcagtggcacaatctcggctcactgcaacctctgcctcccaagttcaagcaattctcccgtctcagcctcctgagtagctgggattacaggcacgtggcaccacacccggccaattttgtatttttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgggcagatcatttgaggtcaggagttcaaaaccagcctagccaacatggtgaaaccccgtctctactaaaaatacaaaaatcagccaggagtggtggtgcgcgcctgtagtcctatctactggggtgactgaggcaggagaatcgcttgagcccagaaggtggaggttgcagtgagctgagatcacaccactgcactccagcctgggtgacagagcaagactgtcaaaacaaaacaaaacaaaacaaaaacatttcaaatgtaagaaccaagatccagtactcatccctcaaatctgctgcttcccctgccttcagcttcccagcagcaagcaccagccttccacggcaacacggtatcttcgtgcagctttcctgtttacactactgcttttttattaaatggtgttcagttaaaaaaaaaaaaaaaaaagaaccaagctaatttgctgattaatcaaatttgggatgtgagaggaagaagaaaaaaaaaggaagactctgcagtttggagcctgagcagctgggagaatggagaatacggcttcctgaatgaggaaagctcggccaagagcaagtttgaggaaaagctcaagagtccagcctggacccatcagtgccttcctgtacccccgtggagatgcccagtgacctggatgtgcaagtccaaggcactcaagaaagagctgtgcctggaactctttcattagcatataaatgatgtttaaagtcatgaaactaaagaaattaccaaagggaagggagagacagaggcaccagcaaagtagactgaggaagagtgcccggaaaggcagggattaccaggagcctgcaggaaggagggcgtccccacctgtgcccctgccagagcaggcgaggcctgtctgagagggacccttggacccagcgaggtggaggtcatttggaagacaagagcgggcgtctctggaaagcagggggagcactttttcacaggggttgtgaggcggtgggagaagagaaagcagactgggagcacagatgactcttcagagacttgctttaagggaaaaagagaggcgggatgtaatagctacaggaagggtctttttgtttttctgaagtgtgggataaatagtaagtttgtaaggccatgggggaagctccaatagggaagggaggactagtggtgccagggagagggggagaattgctggagcaagtccctgcatctgtggaagccatcaggacacagtgggaagaggaaggattggccacacctgagagcatcagagccacaggcagccgtggcagtggtgcccaaggtgtcctctctggagcatttgttctctcgggaagtaagggctctcttgactgtggttagctttttgtcttaattcactctgtcagatacacaactgtaagacactaagataactgttttacaaggcacagtggtcgcatcaaaggagtccctaagcccgatgggccaggacattccaaaaagattggacatggtgggagaggtacttgtttctggagcttctgatggcgctgtcacctcccctgttcctgccccgcagcacaggccttgatccgaagctctggctttctacacctctctctcccacggaagtgggaaatatcaggagtttaaaaaaagaactgttaaactgtacaggattccatatgacaggatgccgttgaaagtgtgctgcccagagagaagggaacaaggaagcagatggcatgaaaagaaggggagagcctccttcagtgaaccacaaacacccagaaggccagaccatggcccagctctctggcccggaccccaggacccagctggcacagtgcttgtgtccataaactttgctggactgagccaaacctgtgccctgtatcagagagccatatcagaggcagatctatccaaggagacttttctgtccccacctttctgacattgctgtccactctccttttcagacttccttctctcccagcttctgtcccatcttcttgctttctttctgcccctctggccctcttgtctcagtactgtgccgttcacagtctcttctccagtcaccccttaaacgctggcattccagagggccctgtcctcgcctttccatctggcgtgctcattctcccctgcaagcttgattgccagtgtgctgctgctgactcccaggtctctccagtccagacccactgctgaactctgcaccaatgtgtcacactccttactgtacagcccacttcagcagctcaagggcacctcggactcaacctgtccaccctgaactcgagatctttcctcctcacatgtgctcctcctctgatgtgccccaccccagtgcaagggcagcaccttccacccatcacccaagccagagacacagttggcacaatggacttctccctgcctttactccccatctccaagctgtcttcccacacagctcagattcattccaaatggcctatcttttatggaccagtcactcctcacctggtcggtgtagcacgcacggaatttcttggactttggctccgtcttagagcaacccacctctcccctctgcactgctgctggagtcagcttcctagaaccctgatgctatcctctcactttccctagccaggactccctttcccaagccagcctctgccttcctctgccttccttcacgtaggaaatctctatgtgatttccagagattcctggagacaggagaaggtgtgccctgattctgtgggaagcacggaaggaactggtgcaggctgtgtgtgtcacagtgttgggtgacaacgggagcagctcaccagtcttgttctgagcaagaggctgaagattgagggatacattccccatctgtttacctgccagctgtgccttggttcaaggcaaattttatgtagaatataaaatgctattacagaaaaagtgtcataagactttattcaagattttcaatgtcatagtttttggtttcataatgacaaatatattttaaatgttttttaatcaagtgagtcacataataacatatcattaatgtgttatatattttgttatcacatataattacataaacaaattggtcaattgaacaaaataaagaatccagaaatagatttacacatatttggtaaattgatttttgacaaaggtgcgaaggcagttcaatagcaaaataagagtcttttttaacaaatgataccagaataattggatagacatgtgcaaaaaaaattttttttgagaaggagtttagctcttgttgcccaggctgaagttcagtggcgcgattttggctcacggaaacctccgcctcctgggtccaaatgattctcctgcgtcagcctcccgagtagctgggatgacaggtgcatgccaccatgcccggctaaccaaaaactttgttccatacctcacattcattcattcattcattcatttttcttcaaagcattcactcatttattcagaatatataaataagaagtacaatatgtcaggtattgttttagaggaggaagacactatccttgcccatccccatcccaggattcttgacacataaacaaattggtgcaatgtgctataagagatgtgtaggggaataagagtaccaagaaagaagccatgaggttatgggtgtttgtggggctgaggatacaagaagtgtttcctgtaggagataatgataatatgtgtttagtctactatgtattcttaatctatatttgtaaaacaatggtccacataatgatatctgacttgtacaaaatatcttttagggacagtagtttttatgctggcaaattaaaattatgcaagaactctgggaccccttaagttttcctgggtcttacttactttgtaaattttagctctacatagtgtaatatatgttttatctgaatgttgagacacactaaggaacaacacacttctttttgcacagactggtggcaacagctttggaatgtgtttatcaaattaagagacaaaaacacaaaatgctacagttcaaaactggctttttattagatctgctactttgcttcaaactttaaactctacccagataatgcaagaaacagagaagtaccagttgcagaaaaccctctgtgttgattgccttttgggaattttaacatttgaatatacttcccagtgtggaagcttggagtcaggggtggactccagaagatacaggggcctacctagctgtaaccacattattatgaagaacaaaattacagctgaattaaattttgaaggctgtccttgagaatatgcatagaaagttttgtgttacctaatagataatttgtgagcctgatgtcattcaaaagccagagaagaaatattcaggctaaaacaaaacttcctactttcttagaacaaagagaatgtacttcttgttgggaagctaaatcctaggaaagggaaaacaaatactcatagattgcaagtcccagagaattttaaagtgagtaagatcgaaccaccagatgaaccagggaccttcctagagaactgaaaagaagcctcaagtattgctattgctgtagcgtacaggcatcagagtgggtgttttagtgagttaggttgagatcaggtggcctacatgagctctgggaaccaaaacaacaacataggaatataggttaaatgtgtaggtggtgctataactttaagtggctgagttcaagataatttacagtgatttggtcctagatgctgttatactggcacccacccagcctttttaaaaagataaaatcagccgggtccgatggctcacgcctgttttcccagcactttgggaggctgaggcaggaggatctcttgaggccaggagttcaaaaccagcctgagcaatatagtgagaccctggtctctaaaaaaaagaacatcaaagcctaaaagtacaaaagaggtctttcaggttgcagagataagacatggtccatcacccccttggtggaagagtgaatgaaaatattggccactttgattttgctgctgtttagaaggactcctggctgggcgcgatggctcatgcctgtaatcccaacactttgggaggttgatgtgggcagatcacttgagtctggccaacatggtgaaatgctgtctctactaaaattacaaaaaattagctgggcatggtagtgcacacctgcaatcccagctacttgggagaccgaggcacaagaatcacctgaacccaagaggcggagactgcagtgagccaagatcaggctactgcactccagcctgggtgacagagtgagactccgtctcaaaaaaaaaaaggaggctgggtgcggtgcttcacgcctgtaatccaggcactttaggaggccgaggtgggtggatcacctgaggtcaggagttcgagagcagcctgaccaacatggtaaaacctcgcctctactaaatacaaaaaattagccaggcgtggtggctcatgcctgtaatcccagctaattgggaggctgaggcaggagaatcacttgaacccaggaggcggaggctgcagtgagctgagattgcgccattgcgctccagcctgggcaacaagagcaaaactctgtctcaaaaaaacaaaaagaaaaaaaaaaaggaaagactcctctcacatcagatttaaaaattcattcaaaatggatcataaaactacatgaaaaacctaaaacctaataaaaacttctacaagaaagcatagaagatatttatgagcttggattggcaaaagtttcttagatattgcatcaaaagcataatccataaaagaaaaaattaataaattgaacttcatcaaaactaagaacttccttgaaaaacacaagcaaatgaaaaggcaaggcacagacagagaaaatatttgcaaatcacctatctcatacaggactggtaaagggaaaatataaagaactctcaatgataagaaaataacccagttaaaaagagggcaaaacacttgatgaggtagtccatcagagaagatttatggatggtaaataagcacatgaaaaggtgttcaatatcattagctattagggcaatgcaaatcaaaaccacaatgagggctggacaaagtggcttacacctgtaatcccaacactttgggaggctgagatgggaggaacacttgaggccagagttcaagattagcctgggcagtatcatgagactccatctctacaaaaaaaaaaaaaaaacaacaaagaaaaacttttttaaaaaactataatgagataccaccacacaactattaaatggctaaaatgaaaacgattgctcgtaatcagtgttggtaaggatgtgaagaaaatggctttctcatgtgtggctggtggaaatgtaaattggtataatcactttggaaaacagttcttcaaaaagttaaacattcgctcaccatatggcccagccgttccacttctaggaatggatgcaaaagaaataaaagcacaggctgggtgcggtggctcacacctgtaatctcagcactttgagaggccaaggcaggcagatcacctaaggttaggagttcaagaccagcctggtcaacatggtgaaaccctgtctctactgaaaatacaaaaaaaattagccaggcgcggtggcaggcacctgtaattctagctactcaggaggctgaggcaggagaattgctggaacccgggaggcagaggttgcagtgagccaagattgcgccgttgcactccagcctgggtgacagagcaagactctgtctcagaaaaaaaaaaaaaaaagaaaagaaagaaatgaaagcatatgtatgtccccacaaagatttgtatccaaatattcatagcagcattatttgtattagcccaaaactgaaaacaacacaaatgtccattgtggaggttttaaaatatgtccacaagttctttgatacttcttccctcaagaggtgaagatcattcctcttcctttgtaggcaggctggacttagtgattcctgtctaccaaacagaatatcgtagaagtgaaggtatgcaacttctaagactaggtcaaaaaaggcattgcgactgccttatggttccttcttgtgtcactcactctggagaagccagctgtgatgtcctgaggacactcaagcagcccaggggagaggtccttgtggtgaggaactaagtcctctgccaagaagcatgtgagtgcaccatcttggaagcagacccaagtcaagccttctgatgactgtaacctccaatgacatctttttttgtttgtttgtgagacagagtcttactctgtcacccaggctggagtatagtggcgtgatcttggctcactgcaacccctgcttctgggttcaagcgattctcatgcctcagcctcccaagtaggctgggattacaggcacacaccaccacgcccagctaatttttgtatttttggtaaagacagggtttcaccatgtcagccaggctggtctcgaactcctgacctcaagtgatccacctgcctcggcctcccaaaatgctgggattagaggcgtgagccactgcacccagcctcttaacattttttttttgagacagtctcgcttactgcaggctccgcaccccgagttcacgccattctcctgcctcagcttcccgagtagctgggactacaggcgcctgccaccttgcccggctaattttttgtatttttagtggagacggggtttcaccgtgttagccaggatggtctcgatctcctgacctagtgatccgcccgcctcggcctcccagagtgctgagattacaggcatgagtcaccgtgctgggccagcctcttaacattttaacgtctctgaatttagcatgcatcttataattatagtggacagctttctttctttctttctttctttcttttttatgggacgttttaaaggatgtcttattacttttgccagaaaaacagtacatcttttattcagtgacatcctagattcaatgaaatatggtaagttttgaaatctaggtaagaagaacaattttgtagttgaaaataaattcttaaaattgtcctaaaaaatggcagaaaacctgactgagtcagtaagtatagaagatattggaaagttttttaaaaactagcctccacaaaagggttccaaccctcgtggaatttgggacaaggacaatccaacatcactgtagaatctaagaaaaagtttgaacaaatggacaaatatactatgctactgaatgggaagacttcatcttgcaaagatgtatatttctcctcagatgaaataaattaatgtgattccagtcagaatcccaattcttttctctttatgcctggcatgtagtaggcactccataaatatctgctaagtgattagatgagtgatttgccaaaaattttttaaaagatttgtcatgaaggatgattatttctttaacattataatttattgcaaagctacaataattaacacagtatgatgctggtgcaagaatagacaagccactcaatacaacagaataaagtccagaaataaactcaagtatatataaaatgtatacgatgaaagtagcatttcaaatctgtagagacatgatgaatttttttaaagataacgttaggacaattggacaaacttttggaaaaagtaaatgtatgcctctgtttttagttctaaataaattaaaagtgaaatataaaaagtcagtgtctgaaatttataaaagaaaacatggaccactgtgtaccaagtcttagcggtggagagagcctttataaggatgacattaaagcagaagccggccaggaggggtggctcacacccgtaatcccagcactttgggaggctaaggcgggcagatcacttgaggtcaggagttcgagaccagactggccaacatggtgagaccctatctctattaaaaatacaaaaattagccgggcgtggtggcatgtgcctgtaatcccagctacttgggaggctgaggcaggggaatcgcttgaactcagtggggcagaggttgcagtaagctgagatcgtgccattgcacaccagtccagcctgggcaaaagaaccagactccgtctcaaaaaaaaaaaaaaaaaaaaatgcagaatccatgaacaaagtttgaaagatctgattacacaaaacttaaaatttctatgccaaaaagaaccataaaattaaaagagaaacagcaaactggggaaaatatgtgtgagtttccaaaagggccaatatcattagtataggctgggcacggtggctcacaccagtaatcccagcactttgggaaaccaagtcggacagatcacttgagctcaggagttcgagaccagtctggccaacatggtaaacccagtctctactaaaaatacaaaaaattagccaggcatggtggcacatgcttgtaatcccagctactcaggaggccaaggcacaagaattgcttgaaccagggaggcacaggatgcaatgagccaagattctcgtgccactgcactccagcctgggcaacaaagcaagactctgtctcaaaaaaaaaaaaaaaaaaatcattaacataaaaagagatcttacatatcaaaaagataaagacggctgggcaccatggtcacgcctgtaatcccagcactttgggaggccaagagggcagatcacctgaggtcgggagttcaagaccagcctggccaacttggagaaaccccgtctctactaaaaatataaaaatcaactgggcttggtggcccgtgcctgtaatcccagctattcgggaggcttaggcaggagaatcgcttgaacccaggaggcggaggttgtggtgagccgagatcgtgccattgcatttcagcctaggcaacaagagtgaaactccgtcacaaaaaaaaaaaaaaaaacagataaaggcatgagcacccattaaaatatgagagaaggatatgagcagataatttacaaaagaaagaaatccagttacccaataagcattgttaaaagataaattttgacacattaaaatttttaagagtttgagcagtgatttttatatatatattttttgtttgtttgtttgtttgtttgttttgagatggagtctcactttatagcccaggctggagtgcagtggtgccatctcagctcactgcaacctccgcctcccaagtccaagtgattctcccacctcagcctcccgagtagctgggattacaggtccccaccactaggtccggctaatttttttgtatttttagtggagatggggtttcaccatggtggccaggctggtctcaaactcctgacctcaagtgatctgcccgccttggcctcccaaagtgctgagattacaggtgtgagccactgagcccggacaacagtgatttattaatcaggcagctccaaacctgagggaacaaagggaggcttttatagggtgaatgcagaagcaaagcaaagcaagtatttgatttgctaaaatggagcagtagctttacttggctcattccaatggaaagtccttggttagaggttagttgactgtttctggttggctcctagaatatgaccttttacactgagttgggttttggtttgcttatgtaggaactcacagcactgggaccacctcgttctaatggccttgcaattattttaacatcatgggaaaaactgtgccccactgagaattttaatatgcaaattatcattgtaattatttggtcactcagactggctgagactgtcagagtcatggattctggcaccctctctctgcactgctagaagtggtctagatggtacagccttctggggaagaagttggcaggatgtgatttttaatggacacagcctgtgtactcacaggcaattattttaagacataatcagcaaactgtgaataatgagttcttgattgtctgttacaacatcatttataaagcagaaagctttggaaactaaatggaaacaggaggaaactggtaaagatgttttgttacattcaaatactgaagtgccatacagtgagttaaagttatgttcttgaaaaatgcatagaagaaaatatacaatatagtgaagaaagcaaattatatgttaaagtccaattctgtttttctttataacatttatcttgcttattcattctgaataaaaatacttgaaggagaaataccaaaatgctatcagtactggccgggtgcggtggctcacacttgtaatcccagcgctttgggaggccaaagcgggtggatcacttgtggtcaggagttcgagaccagcctggccaacatggtgaaaccccatctctaccaaaaataaaaaaattagccaggcgtggtggggcacgccttagtcccagctactcgggaggctgaggcaggagaattgcttgaacccaagaggcagaacccaagaggcataggttgcagtgagccaaaatcgcgccaccgcactccagcctgggtgatagagcaagactctgtctcaaaaaatatgtgtgtgtgtgtgtgtgtgtgtgtgtgtgtgtgtgtgtgtcagtatttctccctgggacataaggttgcagatgatttttaaaattttcttctttatgtttttctttgttcctcaaatattctacaacaaaacacagaaaaaaataacaaagctcataaagatgtagatatagatacaaagtatttaacagtaaataacattctgaataaaataaaatcatgtgacttacatataacccagcaatctatacaagagaaatgaatatatgtccatgcagacttgtacaggaatgttcatagcatctttattaacaatagcaaaaagcagaaacaacccaaatgcccatcaaatggtaagtagatcaacaaaatgtaggctattcatacagtggaatattatttggccataaaaaggaatgatgcactgacacatgggtgagcctcgaaaacatcgagctcagtcaaagaagccagacacaaaaggccacatgttgcatgatgcaatttatatgaaatgtccggaaaaggcaagtccacagacacagaagcaaataagtggttgaccagggctaggggaagaaatggggagtgaggtttcattttaggatgatgagagttctaaaattagatcatggtgatgttagacaaccctgtaaatatgctaaaattcattgaattgtacattttattttatttttttgagacagtctagctttgtcaccaggctggagtgcagtggcgtgatcttggctcactgcaacctctaccccccgggttcaagtgattctcctgcctcagcctcccgaatagctgggattacaggcatgcgccaccacgcccagctgatttttgtatttttggtagagatagagtttcaccatgttggccaggatggcctcgatctcctgacctcgtgatccgcccacctcggcttcccaaaagtgctgggattacaggcgagagccactacacctgcccgaattgtacctttttaatggatgaattttgtggtctataaatgatctcagtaaagctgttatttttaataattaaaaaataaaattggtttcattatttttcaaacagtaaacatactaatacagccaagacccaattgcaacaaaactctatatctacagactcatcaagttgctaattatatcattttttattcctttttttttcagaaattagaaatgtgattctaaaatgtaggtggggacattttgtgaactaaaatgcattagcagaatccaagatactggtcctacatgtcattatctcttctcagagtaacactaccatctttacctctaccctctgtagacagttttaaacatttaaacgaatgaaattatacagtatgtactcagatatctagcttctagcttttcttttcttttcttttcttttttgagatggagtctcgctgtgtcacccaggctggagtgcagtggcgtgatctcggctcactgcaagctccgcctcccgggttcacaccattctcctgcctcagcctcctgagtagctgggactacaggcgcccgccaccacgcccggctaatttttttttttttttgtatttttagtagagacggagtttcaccgtgttagccaggatggtctcgatctcctgaccttgtgatcctcccgcctgggactcacaaagtgccaggattacaagcgtgagccactgcacctggccgcttttctttttttgctcaatattatgtctgtgagtcatccctgttgttgtgtgtcaataattaacattcagatgtttagtaacatccattctttatgatgttaataaaaattcaggccagctcggtggctcatgcctgtaatcccagcactgtgggaggctggggcgagtggatcacttgaggtcaggagttcgacaccagcctggccaaatggagaaaccccacctctactaaaaatgcaaaaactagctgggcatggtggcgggcgtctgtagtcccagctacttgggaggctgaggcaggagaatcgcttgaacctgggaggcagaggttgcaatgagctgagatctcaccattgcactccagtccaggcaacagagcaagactccgtctcaaaaattaaaaataataataataataactccatctttcattgagaaagaaatgtatggctaaaacatgatggtttgggaggctgagacaagaggattgcttgagctcaggagttggaaaccaggctaggcaacatagaccttgtctctactgaaaaaaaaaaattagctgggtgtgctggtgtgcacctgtagccccagctactgggggatttaaagtaggaggctcactttagcctgggatggggaggctgcagtcagctgtaatcatgccactgcactccagcctgtgtgacagaacaagactctgtctccaaaaaaaaatttttttaatttaaattttaaaaatgtgatggacctctgtaataaatggggcctttgtttctccactgactttctcactctaagagggtctgaaccacgtggacttgtgtttagagcttgcagcaggccaggaacaatgtacttgaatgaaccttgtgttaatctaatactggttgaggttcaccaagaggatacaagcgtatggcttcaagtcctcttgaataataataaaatgttagggggtatctggctcccaccatccttgtcctgaatgaggctcaaggtgtgatccaccttgcaggagggcattctccacccaagggctgccgtcaggtgtcccttcttgaccgttcacaagtgtgggagacagtagggcataggcattcagcacacgggctctgcagtcacgcagacctgtgttcaaaccctgcttcccccacacagtgcttgtgagactttggacaaactacttcatctctcctaacctcaattttctcatctgtaaagtgagtgtaataatggtatctactttgtgaagttctacagattaaatgggataatggctttaaagctcagtgcctggcacatagtaaattctcccaaaacagcagctcttattatttgtagtagtaatattattctggctcagaatgcctttgaccctaagtatccagcatcatggcggtattcatactggctatttataaagaactagcagatagggtactattcttgttgcctgtttttcatttctttaattacagtcatctaagtgttgtctctaacaaaaatgagttgctgttgttttcattgcagacagttgcatctataaaaaggtttgcccctttaatggtggctcttttttggttcaaccttctgcgtcagatttccagttctgttggaaccaggctccctatgcaattggtaagaaaagtctttatcataatgcttttctccttcatggatatgtctgaactattgtaagcaaatcctatgtaagcaaatcactggcttactgcgaaattgctataaattatacgcgtatgatgaatattcacagcgttctttttctttttcttttatttttgttccccttttgggactatcgtcttctactgttcttcctagtttctctcagtgcctgagcatgtatgcatttgagagcaattaaatgtcatttttcagtacttggttatcatttcagcacctcagttcatttctgggcctcactttcctttttctaaaattcaagtgtaaggtctccagcctcaaaatgctgactgacctcggggagaagcacagtgctttcagggccattggtatatgtttcatagaaattcaggtacctgcctgccactaaaatgtcaggacatgagcggcgatgctttgtgtttgtgattcaagatccacaactggccattgccttttggaagtcagatcagagccaagaatgttccagttcattcttttgtcctcacaataaaactgtgtgttaataggtccacaggacagcattttgagaggaaggcagagggaccaacctaagatcctgggaggaccagttagacttgatgacagattagatctggtagacaggaaagggagattttgaaccacgttgctggaggggcttgaaagtcatggctggaggcatagatgtggtaggcacagtcaccaggaaagccaggagagcagatgcgctcatccatggaaagagtgcagagagagccagtgcgaagaaggggacaacacgaagtgccaggaagaaagaggtgtgccccagggcagccagggcaggcacagtgcctggaagccagtgtgtcatccaaatcatttcaagcagaggggccagcccttaacaaataactcagcaaaccccttgatgccgagggacactgcgagggccagtgaggaataagatgcagccccggctcagacgtgcagctggaggagcacatgggaggagcgaggagcactgagggacaccagggctgggccttgaagagcgaccaaagggaagggtcccaggcaggatggcctgggcctgcagacagaatgtcaggctggcgtctgaacaacagaagggactccccacaggactatggcaagtgagctgcctcgctggaagatcaggcagtggggtttccatgggggaaaatggcagcaagcatggtgacagtgcacacctcctgggaggcgcagtgtggcaaccgaggggaggctgtcttgggaacccaggctaccttaggatcagggtgacttgcacatgtgaaggaaggagagaagcagccagaggaatgagagatggaagtttctagagaagtgagtgtgactatgacacagtcacagccccttcgcggccaccaagccagcagctgggaggtgacactcccgttcccttgcagtctgtgctttcccgtatctcctggccttcaccaccgactccatggagatccgcctggtggtgaacgggaacctggtccacactgcagtcgtgccgcagctgcagctggtggcctccagggtgagtaggactgggattttatctctgagtggtttgggggaccccggcactgtgggatttcaggtgagcacagaagccgcctcttgtcaagttaggctgatgaagaccggtgtcagaatgccagcacgagatggaaagcctgaaaccagactgatctgttgggttttcatgtgtgatttctgtgggctttcagaacactcctcagctttgttaatagtcattaactggtgctggtggcagctggggagcacttagctgaaaagagatatccccgctcagagactgggtcagttattcatgtcactgctgccctggaggacagtccaagtctagaaaagtcagagcttgcaatctttcttcctttcccaccctctatcctcagtttgaattcttagcctatgaaacatggctaattgattaatccctgcctcataacccacagctagggcaaaacggagggatgcaggaacaaagatgccttccaagatgtcttttgtcgctggcatataatctggggggtcttgttctagtcccctcccctgagtcaggcccacaaagtcctccccagccctgccagactgggctggctcccccgctgtgtcccctgttcccttccctggtcctgacatccatcacatttggtggtaggtgactgcctatttgttcatctttgctgctgcactgatggttctgtgagagcagatgccatgctgtcttaccatcatagtaccagtggtgtgctcaatgcttcagtcccgcagtgctctggaaaatgtgtgtgtgtgcacatatgtgcatatatgtatgatatgtgtacatatctgcatgtatgtatcatatgcgtgtacattagttgattgtaaatagcttacaatttacaaataataaatatacaatgctgtttatcataaaaatccacttagccaattggttcttacaaaatgtttttgttaatatttgctgaactcttgtatccatagccaacctacagttgcagttcaaccatgattttacacttggagttatatctcaatccactcatttttttccaatgtatattgtcatttaatctgataggtaatctgctataaaactatttttcaccctcatacaactcatagtcattaaactgaaacttctttcagcttctgtaccagactaaacacacttctacgtttcttgttcattactagtactttctccatcactgtaagtctagacaatcaacaaaacaacaaatcaaagtcaaactgatagtctttgctggattccatggtgtaaagagtccctgcatgattgatttcaagctgccagcgtgacgccactgcaggtggtgctggggagacgtgcattatcccccatggtgcagtatctctcccccaagccccacacagacactgttggtgtcaataactccagagcagatgtaatagtaagcacagtcaaataattaggaatggctggatttggatatttagggcctttgtttttttaggtttgtataatttaatttctaatcatgtgtgtttaacagccagtttgcaaaattcctgaaaattggatttcatagatcacatccagcacaccactgctgttagcagcagcgccagcgcatcacgggtgtgcctgagtatctgctggatcagtgaatgaagaatccatttccccatctgccaaatgggcctaactgaatccctaagatctttcccgttctaacactccaggtgcctgagattcctgttagggaagtgtgtgctgtgtttgtgattgcagaagatgtgtggtggaacactgactgttttctattgtggatcaacaaatagatgatgaaaagtggcggggagtggaatactcaggaaaagtgtaactagccacgctgggctttcctccagaaggctctctccatccctcgccccggcatcccgcactgcactgtatgctccaaggatggggaccagttggagggtttgcagtgatggcaggagggccagtggatgcaaggcctagaacaccaggcagcccggtaatgctctctcttcctttctagtcggatatatacttcacagcaactgcagctgtgaatgaggtctcatctggaggcagctccaagggggccagtgcccgaaattctcctcagacacccccgggccgagatactccagtatttccttcttccctgggggaaggtgaagtccaagttttactgttttattaatatttgtaattcactctaatttctctagtttgttgtctaatatctacatgtgattactgtttaaagaagttactatttaaagccattaaaaaaagaaactagctgagcgtggtggctcacccctataatcccagcactttgggaagctgaggcgggcggatcacctaaggccaggagttcaagaccagcctgaccaacatggtgaaaccccatctctactaaaaatacaaaaattagccgggtgtggtggcacacacctgtaatcccagctacttgggaggctgaggcaggagaatcacttgaccctgggaggtggatgttgcagtgagccgagagcacgccattgcactccagcctgggcgatagagcgagactctgtctacaaaaaaaaaaaaaaaaagaaagaaatcttgcagtctgaatacatggttgtgttcttaagaaacctggtgataacaacgacaaaactccattataaaaataataaataaataaataaactgggctaggcgctgtggctcacacttgtaatcccagcactttggcgggctgaggcagatggatcgcttgagcccagcagttcaagaccagctgggcaacatggcaaaaccctgtctctaaaaaaaaatacaaaaactagctgggcatggtaacatgtgcctgtagtcccagctacttgggaggctgaggtgggaggatcacctgagcagcggaggtcaaggctgcattgagccgggattgcacctctgcactccagcctgggcaacagagtgagagaccctgtctctacaaaaactaaaattaaattagctggctgtggtggcatgcacctgtggtcccagctactcaggagactgaggtgggaggatcacttgagcctgggaggtcaaggctgcagtaagtcatgattgcatcattgcactccagcctgagcgacagaacaagaccttgtctcaaaaaaaaaaaaaaaaaaagtttcagtggggaggagggagttaaaggctatagagtttccaacttgcaacagcagttatttttccttcagggctgttaacagtagtgggttttgaaagctaaaagaatagagtcatcaagcctagacattccccagcacatgcagtctttcactctatctggctttgcccgcaaaccccagaggcctctgctgtggttacctcatcgctttgaacacagcgcttttcataaattcttaccacatcactcatctttattgcacgcagttaagataaagcacagaattccccaagcagggcagctttttgcttttcttgtctagtcttttttcctgtgcagtcacgagtgcattttacctaatttacacatgaaaatgctcttagaaaacgcaaagccatcaggcaccctcaaatcagtgctcctggccagccctcccagtgggacattacagatcagtgtgtgacataacgtcttccttcatgctatgttaaggaacaagaaattactctcttgtaaataatgtgcacttttcttaaagttctgatgttctttttgaaatcacatttcaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggtaatggttctcaatcctggtttccactgtctgtgaacagaccagctggttttatctttggatatgaattgtcctcagaaacaatgagtttaaaaggaaagtttccttttaagaagggatttttaagtaagttctaatacctctataccaaggaatacactataatgtagccaccaacagtgatgttgttgatctatatttattggtgtggaaagctgctcaagccatgtgaaggggggaaatgggcagtttataaaacactatgtctagtctgataccatttttaaaaataaaagtaccaatctatgtatgatttcctagaaaggtgtctagaaggatttatatcccacagtcctcagacaacattttatgttggtatgtcccaaagtggaaatgtaccatgtttttacacgtgtgtgttcagttcccttattacttctcccagccctagacagtgggggcaggtctgtggatagaacagatgcaagatatgtgttgagctcatttctctcagtataactatgggactgggctcacacctgttatctcagcattttgggagaggctgaggcaggcagatcacttgagtgcaggagttcaagaccagcctgggtaacatggtgaaaccccatctctataaaaaataaaaaaattagccagccatggtggcatgtgcctatagtcccagctactcaagaagctgaggcaagagaatcgattgagtccgggaggtcaaggctacagggacccatgattacaccactgcactccagcctgggtgacagagtgacaccctgtctttaaaaaaaaaaaaaaaaaaaaaaaaaagatgagaggccaaatcagagaaacataaagcccctgataagtgtgaaaaggttagactgttagaaacctttttgttcagatttgtggaaacaaaataaggaaatatggaagtgacatgttaaaccaggagaaactggtttgaaaacttagactgggacctgcatgaacgttggcctgggcacacccctgccctgcagtaatattccctgaacaactgcaggaggggattcaggccacctgacagggcaggactagacactaacaaagtccattggtttttcaagttggtgccttccactgtgttttgaaaataaatgtattgctatttttaatgcagccttccatatcaaagcttgatctgcccaccactgtttacaaaccactgagcttttgcaaaacggaacctctgaattggagaattacagggttatcaacggtaggactgtaaatcatctgtcctcattaggctctttgagtctaatttttttgcaaagtgtgtatactttataatcagaaaagaaaaaccttctaccaaccagaaaaccaataatttgaaaatatatattctatcatctttcttcctgactctagcacaacaatgcaccagttcccaaccaagaaaaaataagggtcttttctgtctccgtggcagccctgtggtagtgaccctctgacctatgattctcaatccaggcctctcggatgaaggtggacccaagtcagaaggagcgccaaaggccaaatcaaaaccccggaagcggttagaagaaagccaaggaggccccaagccaggggcagtgaggtcatctagcagtgacaggtaaagagagggagaggcccctgcttggggtggtggacctatgagtcacagcactgcccaggaggccccttctggggattgataatgccactagtggcccctggcagctacagcagagggccagcagcctgttcctctctgagggtccccagaccctcaggcctgccagggagggatctagacaaatgggcacacttaccagcagtcaactgctaattcaaatctattgagacctggccaggcacagtggctcatgcctttaatcccagcagtttgggaggccaaggcgggcagatcacccaaggtcaggagttcgagactaggctggccaacacggtgaaaccccatctctactaaaaatacaaaaagtagccgggcgtggtggcacatccctgtggtcccagctacttgggaggttgaggcagaagaatcgcttgaacatgagaggcggaggctgcagtcagccaagatcgtgccactgcactccagcctgggtaacagagcaagacttcatctcaaaaaatatatatataatatatattttatatttatatatttaatatctattatatatatatgtagagagagagagactttttcctcaccagattgacagagagtttttaaaataaaaatgctggctaggcatggtggctcatgcctgtaatcccaacactttgggaggatgagaagagaaggtcacatgagcccaagagttcaatcccagcctgggcaacacagcaagacccatctctacaaaaaaaaaatatatatatatatatataggctgggtctggtggcatgagcctgtagtcccagttacttgggaggctaaggtagaaagatcaccttccttctgggaggtcaaggctgcaatgagccatgatcacaccactgcactccagcctgggtaacagagcaagaccccgtgtcaaaaaaaaaaaaaaaaaacacttagtaagactgcagggaaacaggtgctctctatgcagtaatgcagtactggtagcacatacacagtccagcctatccgaatgccaggtcagcatcacacgtcaatgaatagtagttaagtcacactgatttgtcctgtaagatctctgttatccttcaagcaacatcacacgtgctccagtgtggggagtgatagttcgtatgtccaagcttcattcattcactcaacacacattcttggagcacctaggacttagttgggtattaagatatggaaaggactaagcccccacctgtgccttcaaggggttcccaggccagtggcaaagaccaacaagcgtccagaaaatgactgcattccagcatggcaggtgatgtgtaaggagggttgccatccagcccacacctggggcagggagggtctcaaacatcaggggaggctgagcctcctctcagaagtcataacctgacaaggcccctgccctcagggactttgcattctagtgtgggaaaacagacagccaacctgtaaacaagtaagcaaataaaatcatttcaaatagtgacaagtgctacaagaaattgagaagaagtgacggggctggcacatagaaggtctactctgagagaggggtcaaggaaagctttttgaggaagtagcattgggctgggcttggaataaacggtaagaagctaggggaacagcccttctgacagcaactacctcagggcaagggccccgaagcaggcctagcatggccagttaaaaggcaggaggaagagtggacaggcttgagcatagagaacggagccaggaactgtgtgaggccgagagtgggcagcagctgagccaggtgggcttttgcaggccaatgagtatttgtggaatgcattaactctctgagaagtggaaaccaatattggtcaaattaatatgcagctattgagagagtcctgaggagctggaggaaacagagggagtcaggggtgccctgggaggctggagggatcacaggcctagtcccggaaccttggctatgagtttcagcctgatcctcaggccctgggcacccatgggagggttttaggcaggatgacattatctggatttgcactttagaaaggtaggtaaataatgcctcacaaacaccttccatgtgtcacacactcggcctttaatcctcaaaaccccctgaggtgatgggggtggcattccagcacttccccacctctaccacataacagtgagggtttggtgagccaaactcatgagctcagatgagcaggaaattgccagaaaaaaataggcccagttctgtggtactcccaaagatcctcttacagtgacttttctcttctaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaactttattataagtaagttttttttctgcacctttggccccggttgctgtttcagttcaccgtgattggaaccagctgcattcctgcctgtagacttttgagaaaagttgaatggttagatcttagaagctcctccttcttccctgcatctcatgaaaaatattaaggcataggagcttgtcaaaagtcttcagattattttgtgtggttttattgttactctgcaataatgtaaccagagaacagctactccttgtggttaaaagtattctcattgtaatcccagtgctttggaaggccaaggtggaaggatcccttgtgcccaggagtttaaggctgcagtgagctaagattgcaccactgttctccagtctgggcaacagagggagaccctgtctcaaaaaaaaaaaaaaaaaaaagaaaagaaaagaaaaaaaaaagaaagcattttcaaactcctccttctttttgagtccccctcactctttcacataaatgatatgaagataataatttggtttatctgcctttcctggctccctctccagtgtgaacagaaagaaatgtggactgggccaagtgcaaaagaaatagtgaaatctcagccactagccaaggggagatccagtttcactagcattgtttgcaaatattttaatctgtgtgaagaaggtattttacctttggctttagtctagccaattcaattttattctgtctcttcctacttatattattacattattcatcaaaggaaacttcctgttaccccgttaaagcagctcagaagagttcttctgcaggcttttttttttttttttttttagacagagtcttactctattgcccaggctggagtgcagtggcacgatctcggctctctgcaacctccacctcccaggttcaagccattctgctgcctcagcctcctaagtagctgggattacaggcacgcatcaccacacccagctaatttttgtattttagtagagatggggtttcaccatgttggccaggctggtctcgaactcctgacctcgtgatccgcccaccttggcctcccaaaatgctgggattataggtgtgagccactatgcccggccagcaggccttctttgtgagtgtggagaactgagtttgacaggaccttggtctgacagattttatagaagtttgggtcgtacctcctagtgggccttgcacactgtggggaaagttcccctctctgtcttttgtacaaacagatcagcatgatagcccaagctgaaggttgcttggttcatctttggcagaaggcaagagtcaagagtagtaaagacagtgctttttaggtatacccagatggggctgtttataaccaaatgtgtctgctcatattctttgcagcagttagcatgcccattcttcctttgtgtgttttatgcccttttcctatatagggggaaaaaaacactgtgtctcaaccccaccaacagtttaatgaattatgttttattattcttgcttttcaaataaggaaataggcttaggaaggggcaatggtttgaacctgcaagttctttgactccagagcccttgctttccccacgtctgccatgcagagccaggctcagtgccttgtgtcagctggatctggctggtgtttttcatgttaaactaatttgtaagctttatgagcttgtatctgtgtttttcctttttttctggaagtttcttgcttcacagtgtagcataaaaaaaacccaaggactattttagagcattcttccaaatcagcagcattagagccacccacaatttgacaagagtcacaggtctgaggagtgatgtagcaagggcaagaggtggaccctactgatcaggctgatggtgctttgcctatgaaaagggggcaggaggctgttctggcaacattatttgtctacaaaggccaagaagtgagttctgcacactcacgggaagggaagccatcggccacagggtaggagcaccctgcctacataatcctttctgtgtacccgactggctgagtcacacagaaaatcatctaactgcagtgtctgcctatggagttggaggcattgatccactctgcacacaccaagtgcctcctctccagaggaggtcatgtccattgggggaaggacggaagtaaacaagggatcacaaagcagtgataaatgctgtgataagaatacacatctagtgctcgagttatcaagcattagatgctgtgggagtacagaagggcagttgcctaagtctttaaggataggcttgtggtcaggactgaaaaatgttggttgctagaaccatcaagtgactgcaacatatcagatgactgtcttcatcataccggttagcctttgagtgcttcacatgtcttatatacattaccttgcttcacaactctcctggaagataatggtcatccccacttagagatgaggaaacacaaggcccagagagggattacaagccaagcctcttactcccatgccctggctctttccagaattacaccagcattccaccacagctgcctgcacccagagtgttgggtatgaatcgggtacaactggtgagatccaacagtgcctcatcattcgacttgggtgcacacgggagaaggtggcattaaaatccacagggaactcaaaatatggaggcaggtagatgaagattcaagagtcaggactccctgtgaagtgagtgacacttaagagggggagtggagcccagatctgtcacacatacggcgtgggggaccccacctaccactggtcctcagcacctggagacccgagccttcagcaatctgggaagcatgaaagtgggtttcggtgcacagggccacgcctccgccgccagcagcccagcgggagcgtctgaccagtctcgccctccgagaggagagagaggcggcccaggacggtctgcttagaggctctctcccctgcagagctgggcccaggcataggtcagacgcctccaatacagtccccagggcagcgattaaagcggagcaggaactgcagacccgaccgggcaggacaggtgcagcttctcggagttgggggcgggaagtctcgggctgaggcccacgtgcttcgccttcgccccgcctctaccctcattggttgaagccagattgagaggaggtgccagaaaaaaaactcctccctccaacctcattggccagctcagttctgaggcagctctctggccccgtctatgggctcgcactacactccaattgggtggttgttctcccagacggaaactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtgaggccccgggctcgctcctcccgccctgggaccccacgccctcctctcgggacgggcatcgggaccctccgccccccacccttcccctcgggacaggcatcgggccccgccgccaccacctttccccacgagacaggcattgggcctctctgccccccatcccttccctcgggacgggcatcgagcccctcagcccccacccctcccctcgggacgagcaccgggcccctcagccccctacccctcccctcgggacgggcgcggggccccggctcttttacctctgagcccgcggggagtgggtggagggggaggatgggctgcggcttcggcgccccctcctcagcagccgcccgcctccaggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtgagtgtcccgtctctcgagtgtcctgtctcgcggcctgagaccgagggggagtgggacaaaccgctccccaggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtgaagtcctttgcccaggcgaggtccacagctagtcagaggggaagcagttgcaggaacccagggttgtcccacttagccgtgcccctcttttgctctgcaaacctgcggatgatccacaggagcccactccctacattttggttttcatccctggcttcgggtcaatgactgcaattagcaggaagttcctgtcctgatttctcttggggcaaaggctgctggcctctgtgttccccttcccttctcacaggccagcccctctggcttccccatcttccccctttccccctcctgacccaggctgcccacttgggagccccgaacatctgggtcaaatcctggttctgccactaacctgagcagagtgcctccctgggcctcagtttccttctctggaaaacagggattatggcattagcccctgaggtagtggtcaggattcagtgggactttggatagacagcccctggcatggcttgtagaggactggatcctgacagcttggtgacccatgaactgcccccagccatgggcttggacaatatctcccccaagtgaggttgaaagcagccactcaggcccctccctgggtgctcatttcaccaacgtttgctaaccggcagcagcagctggaccagaagagggtggggaagaagctgggccttttatgtctttggtttttttaactgggcagaaacacacctgtgttaggggcctaagctatggaataaccttagatgcatgggtgagggcctggtggcctgtgggcccaggagggagctagtggcagccactggtagtgaccgaggcagagagttcgtgcttctagtccaaggccaccactcaaagcgtgggccctgggctaggatcctgggtgggcgtcacgtggagctggttaacaaggtggaatctttcgcctgtccagacctactgcatcggaatctatgatttatccagggtgtctgtgcacattaaacgaaggcttgagaagctctgtgcccaccgcctctcgtcatcatatgcagccctctccgttacccttaatcccctttaaacacctgccacagatctttcagtggtggggacctggggatggctctgctcacctaggcaggttccactaaggggcttcagggcctgccgtaaccccctgcaaggactttcctcagctctgaatggctgagacctttccattttaagaactcttggagcctgagtaaagcctcatctttttttttttttttttaatttttatttaaaaatttcggagtttcgctcttgttgcccaggctggagtgcaatggtgggatcttggctcaccgcaacctccacctccagggttcaagtgattctcctccctcaacctcctgagtagctgggattacagatgtgtgccactaggcccagctaattttgtatttttagtagagatggggtttctccctgttggtcaggccagtctcaaactcccaacctctggtgatctgcccgcctcggcctcccagagtgctgggattgcaggcatgagccactgcgcccagccataaatcctcatctgattgctggcaggtctacatctccgaaatcgcctacccagcagtccgggggttgctcggctcctgtgtgcagctaatggtcgtcgtcggcatcctcctggcctacctggcaggtatagttgtcattatctcttgcttcctgtttgtggtcatgtggccattttacagatgtgtaaacagaggttcagtgaggtcaagggacttgtctgaggtcacatagccagtgcccaacatgccaggctcgccttcctgggaccttgggataggtgagtctttttttttttttttttgagacagagtcccgctctgtcgcccaggctggagtgcagtggtggctctctgcaacctctgcctcctgggttcaagcgattctcctgtctcagcttcccaagtagctgggactacaggcatgtgccaccacacctggctaattgtttgtatttttggtagaaagggggtttcaccgtgttagccaggatggtcttgatctcctgacctcatgaaccgccaaacctcagcttcccaaagtgctgggattacaggtgtgagccaccgcgcccggccgataggtgtgtcttatgactgagttccagggacagctggagaaggtgataccctcagctttcctgaagccccctctaggggtgtgggaagggctgactgcttaggtcagtaccttactgtgcagtgacaaaccagagggctccagaggtgggtgggtccctgtaaaaatcttcagcccgggcgagtaaagggctgagcaagtcccctgagaatgtcagtgccagattcaccatgtcggcgagttgcaacgtgaaggaggccggggtcctggggaccccgaggggcaaagctgggccagcatgaagaaacttcaggagacaggtgtgttctcattagaaagaggccaggctttagaggccagacccagtggctcacacctgtaatcccagcactttgggaggcagaggtgggcggatcacttgaggtcaggagttcgagatcagcctggccaacatggtgaaaacccatttctatttaaaatacaaaaattagccaggcgtggtggtgggcacctgtaatcccagctacctggggggctgaggcacaagaattgcttgaacccagaaggctgaggtttcagtgagctgagatcgcgccactgcactccagtgtgggcgacacagtgagactctgtctcaaaaagaaagaaaaaacaagggcaggcttcaaatctgaccatcctgagtttggggatagcctctcctacgtgctgtgtgaccttggccaagtcataccacctctgaaagcctcagtttctctgtcttgaaatgggcataacctcatctagtccagtacctgtccattaaattaattgacacatgaaaagtgcctaacagtgggttccaaatgagaattgtcaagggatgacttgagaaccatggggatcatcggggtaggaggcctcgggggcctgacgggctatggcctggcccagggcacaagccctctgcatcgtcagggcggatgatacacaggtctttggtgtttcatttttacccacttaaccaccctaacaaattcagaatcctgccagcgatctggctaccttgggagacctgagtaaaccaaagcccccactgtgtgcaggtgttgacattcatcatttcggggacaggtactgggtgtccacccacccgtggcactatcttcagctcatcttaatatgtgcttgttgcttctcctgcctttcctgatcaatttctgtgagtttcgatccactggggtgggtgaactctgataactccacaaagtgacatggtggtggcacgtttgcttcacattggggcaatcatgttccaacgactagacttcatagaacaattgtctgcacccccagcacagaagaaaaatagggacatcatggctaccttagaggtatttttccactgggaaccagggatgggtaagccttgggcttaggaaaaattagtaattagagcagcaatgccctagactcatttattccagggcccctttgtaagagaaccttttaactttatataaaactaggtaattctgcacttatgctgttcttcatacgtcaagacagcaaaatcctctcacctctctactttcatgtatactttgaatagataatgcattcaaatgactcaacactcaagtgccagagtggagagatgtccagtgaaaagcttcctccgcctctgtccctttcttgtctgggggagtccccattgcctgtttcttggtagccttcagagagtctgttcatatgagggacatgcatatttatcctccctcccccacctcttctacaaatggtgccacatcataccatgcggacacgcagcaagcacctcatccttcatttttgtggctacataaatgtttcgttgaacggatgcagcctagtaatgtccgcgttgtcatacccactgtcgcttccgcagctggtgtgattggcccgtgccatgtgccttcatgaacagttgtgataatggcaatgtcagtagcgaacatgagggcagatgtgcagaggcagcgaggccccatctctgaagctgagtctttgaggctggcaaggcccaggctggctcaccctggctctgacgccagcctcctccacccaccccccgcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcaggtgagaggctggaaggcagagctgacaggagtgggacagcagtcacgggagggtagcacagcctgttcccaaggccacacacttggggggtgggggacagggaggtgcctatccaccctccaccctcagcgaggacaggcccagtgtgtcctgtctttgagcaggccaagacagctggagccccacggagctgggccctggcctccaaagtcaccagcaaagcccgagctttgacccttactgtcccaggaagagaatggccaggcctggtgggggatacagaggcagagctgaggacttggatttaacaaaggagttgcaaggcagggtagagggctaaaagtctgggttttagagtcacccaggcatgggtttgaagcccccacgctgcccctcacctaagctttagctcttcacctgtgatgtgggagtcagcacctgcttcacagtgctgggtgggactcagtgggggaaaggaaggcggggcttagggaggaggggggctcagtggggagggtggggtcagcgaggaggatgggttcagtggggaggggagggtcagggctgtaggaggtgcttagctagggccaggcccagacctgaggcaggtgctggatgtgttggtggtggcagggatgagggcagcagcttgctctttgcccagattacctctttgtggctcccccccacctatcaggaagtgccctgggcaggtgagggtcatctcacctgacacatggggaggctgggacttgtctgcacacctgaggacacagggggtgctgggatgaggagccaagacgtgggagtcagcgctccccaagccttaggacagtagacccccagaggggggccgcttgcgggaggggagagagaaatcctgatggccagtatccgtcagagcagagctttca

SEQ ID NO: 821 - DNA, 3741 bp, Homo sapiens
cttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaactttattataag

SEQ ID NO: 822 - protein, 995 aa, Homo sapiens
MKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 823 - DNA, 54929 bp, Mus musculus
  misc_feature (1)...(54929): n = A,T,C or G
ggtcacagagacaggccaaggagtctttttacagctcccagtgggcatgattagccaagccagactctgtcagtctctctgaaataggaggctgagggtgtcttggagctggcatcatgccctggtccctgacccaaaaagacccttcctgtttgtcattggaagtggtggctcccccaggaactgagactaatgaagtgttagagggattgagagcaaagaaaccccaggacacgagctggcatcttccaccggtggggcctcccaggagccttctctggggtggttcattgctgaagctttgccaacattgccttgtccaatgaggaatgcaggagcagatgccagggctccatccgacagatgaggaaacaggcttagatgggctgaaggtcactgcctacagctgtctgctctctccttcatcatttgcagtccgagtcacccagatacaaggccactactgctatggggtctcagtgagaggaccccccccccccacctcttaaatgcaatagtttaagtaaagtgcttacaggtgtgcctggcatagagcaagttctcagtaaatgttactgagctagatttggacccagacctttttcttctacacctgttctacatactgttcacctgataaagaaacaagatactgagctgggttgaaactccccaagtagcacaatatgagaagacccatcttacctagtcctgtaggaaccccctgttactctcctcaggggagattagcactcactttggtcccttggagtccactgagatgctgtgggcataggggggtgggatgtctgtagctcccctctgcctgtacactccacagcatactgcattggatcacctcctaagcttttcgacggcggctttatatataaccacccctccctttgtgaatttaatttattaatttggggtagttataaataatgccctgtgtgtaggcttgccagcaggattaagtccccgtgctgcgagtgcttccggatgcttccgtggggtggagggctttcctgatgagagaccaggaagtagcatttgctggagatgtcagttcctcctcctggagtttcagagtctagagctgtaagactggctgagacccccttggctgagacacccagcagatgctgtactgccagtaggcaagaagttacctcagatattatcttcagctctgttgtcactgcctgacacttccaggcaaagtgtctagccaacattgcccgaggaaagcagagggtctttgaaactgctttctggagcacagggacagaacccaagggtggccatgccccttgcttactggctatccaatctgagctcattgttttggcttctggaatcttctttgcctcccatataaatggtcaccaggccgtagctgctttagactgggagattagggggaataatacatatgatttgctcagtccagcacctggtatggggctaggttcctctagttctggggaagggattactcggatcatcctggcggacagccaacaaggattaaattgaagctagagaaaatctgtcttcatgtgatctcagctgaaatccctgccgccgacttgtgcatggtgggcttggctctgctcagagcgactgcctgatgatggggctctggtgtgtgctgtgatagtgcttccttatctttgctttgcaggtgaggcaaccagtctgagggtgaaggggacacactctccctaggctcgggcctgtgcatccagacacttggtgaccttctgcttgggaggggccacctcgtgcctgaggtggctcagagggagataattgtcagagagctgaggtacaaggaccccagaagcctctttcttcaatccccgtctcccagcacacagttcagagggcagccagactgggatgtggcctgtgacttccctgtatttggatggatatgccaactcttgtctgtcttttatgtgtgtctgtcttttgtgtgtgactgtcttttgtgtgtgtgtgtctgtgtgtgtgtgtgtgtctgtgtgtgtgtgtgtgtgtctgtgtgtctggggggtatttccccttatgctgtcttaggcccttggacaccaccatgaataggaacaagatgaactgtccactaggccaaagtggctgctgtcaagggacttgtgggcaggtggagggggctgtgggggctttcctgggcactgtagaacagccaggttcgtgtggagcttgttcaggtttctagcctagtgaacctaaaggaccaggaagtattcttttcttacaggataaatctctgtgcccatattctatccagatctcaaacaatagtgttaaaagcccctccaaaccctacagggccccacttgctagcattgaacatatcagccatcttccttggtcactctctaccttattttgaggcaggatctccctgtacctagagtttgtccattcagctaagccgcctggccagcgagctgctagaatcttcttgtctccctaactcatcccttagtcctagggttacgcatgcatgctcttgtgactcacacagtgactggagaagtgaactcagggtgtcacacttacgtagcagacactttttagactgggccatcttcccctgctgctcaatgatatatttttttcctcttttcctgatttaattgtaagtactaatgactgtaatgttactgaaggtatcgggatcagcggctggactctagcttcctgtgatggcttgtgtattcttgggccagggagtggcaccatttggaggtgtggccttgttcaagtaggtgtgaccaggttggagcaggtgtgacactgtgggtgtgggcttaagatcctcaccctaagcggggcgtggtcgcgcacgcctttagtcccagcactcaggaggcagaggcaggtggatttttgagttcgaggccagcctggtctacaaagtgagttccaggacagccagggctatagagaaaccctgtctcgaaaaaccaaaaaaaaaaaaaaaaaaaatcctcaccctagtcgcctggaagtcagtcttccactagcaacctttggatgaagatgtagaactctcagctctgcctggatactgccaattaaatgttgtattaagggagtgggaccttggggcaagagcctacccagctaaatttagatccaggcatggtggtacacacctttaaccaggagacaggcatgctgatctctgcattcaagatccatctacagagcaagaaccaggatagccaagcttaggcagtggaggatttagaaaacatataaagccagtgataatgtaatagtacaagggggtcatgttctagttcctgtaagcagcaaaactcagcagcttcagccatgtggctctggctctagagttaagaatggaaggaactactgggacaattgatgctggttagttggagctaagaaattagcaatgattaagaagagaccagcatcactgggttgaaatctgggaattgttttctgggagcacaaagaagctgtgttccagagatagccaaggttgtaccttgtgctgcggctggacttggtaatgtgtaagagtcacccaggtggtactggttttgaaggcatgcaggtgtgagaggtcatggaagaccattggagaaggtgtagcctcagctgtagttgatggcccaggactgaaggagtcatgcaaagaatttgagctttcacaccatgaagagagcctatgagaggctattggtgaagcctagttggagtggtacacccttgtttattggagatgtcagctgccatgctcccaccttgataatggacagaacctctgaacctgtaagccagccccaattaaatgttgtttttataagacttgccttggtcatggtgtctgttcacagcagtaaaaccctaactaagacactttcctaacaatctatgtttggccacccactaccgattagacagacaagtaatagtgaaaagtagagaaagatttaatttttgtgcccacatggagaagaaaaggaaagagacctggtgaccacacctgcctccatccaaagtccatccccaggatcctgacctgaaggtcaggtttaaatagtggttaagaagtttgcataactgagcatttgtggccaagatgaggatccacctattattgtctgggccacagtctctcctacaagatgacacgtttgtgcgagcatgtatggttataatgtgtgtgtgtgcatgccataaagtgtgtgtatgagagagagacatgtaaagctgttagtacactctaacaagcttggtctggccatgtacctgcagaaggcttgaagtcccccaaatgttggtgccacagggcattgccactgtctgtggagtaaacatgttgtctacttttctgccttaattggattgctgctgcttaccattgccctagtcactggagaactggggaaccgggtcagggaataaaggcaccagcctccctctttgatctggggcagaggccatctgggtatctcccttggtgtagtttacaggtttgagtggccagactcaaactcctgactatgggacttgtgacattcctttgggtgtaaggtgcttattcaggaagcttctgtgtcctccatcattctgctttgggaagcagaccacacagataccctgtcgccgctgccttttggggtccttgagaggccccgactgagagacttagttctgtgtagtagactggttctttagccagatcccaggactctaatggagcctagagatatacatcaggtctttgatctgggccatttgtcctactcagccttggctaaggcaaaacttttgatgtagtgggtcccatttgaagtcacagctgaaaacaccactccggggccacatgcagggaggaaggggaagaaaccgtgggcaccctttggtgtgaacagaagtctagtgtcagcaggagagaaacctgggttcccatactgtgaaactctgtgttcacgtcactgaacccctgtgtggttctgtgtcttcatctgcaccccgtgttgtcagtgctcattaggagtacagggtgtagcttctggtaagcaccgtgtgggtggcagttgtcattaccaaccgcagagaaccgaggtgtggctgcacattctttgaggatgtcagtgtgagccagtgctagtacccggctctgcagaattcaagcctggcccatgctgcgttcttgtgatatgctactaccagaggagtgggggcttcacgttggtcacaatatgaacagcaaggagagggaggtctaacagctggcgtttattggatgcaccatgctcctccacaaagtaccatcaacgggagtgtgacaccgtgcttgtgtcccttgaactggcatacactgtattctttgaccaccctgttcctctgaggggcttgaatccttgcatataatgagcagggtctgagcaggtatgctgcggctgggtgtgttgcagaacggtgaggtttctttcggcagttgaagccttaagaaggtggtagccacaaaagccagtcctcccacttggctaattccagctgcagcctcagttgtagcttttgaactctgaagtcaggtacaccctaccatctcggaagccataggtttatcttagcaaccttgaatctccgtgactctgtgctggggacatacgttgcagtgaagaaccctaaggggcccaactgacagcaatctgcagcatggtgataggggagagttgccctgaagaagcaacaggaagtctgggggtgggggtagtcttgtgggtacaggtgagatgagggacctatgcattcttccggtttgttacaaggtgagttgagaaatgtcaagagttaggaaacttgggagctggagagatggctcagcagttaagagcactggctgctcttccagaggtcctgagttcaattcccagcaaccacatggtggctcacaaccatctatctgtaatgggatctgatgccctcttctggtgtactggaagacatgacagtatactcatatacttaaataaaaccttaaaaaaaaagagttaggaaacttgccctgaggggtatgtggaagagttaacagtagcctcatcttatgaatggggaaactgaggcacagtacagttagatgaccttggctacccagaaataatggagttaaatgggtttcctggccttgcttacatctctgcctggttccaggtgctggcattggggtgaggacatagtgtctgggcatagcttggttaccaggtagggcatgattatgctaattactgttgttttggaaatcggggtgactcgtgggccactgggatttgccaactttgttccatatcctctcagccttgcctgccccgctcaggagcctcagtgcctttgtctgcgaggggaacagtggctctttgttctctctgtgtgctgcatggagaaccgtgtccagtgctggccttgccggacagccagacctggaagtagagcaagtatggattcctgacctcaatggtcaggcctttcagtgacatgctcttaacactccctgagaaggacagtccacgcccctcccaagggggagagcaagcagtctctggggatgttctgggagctgagtggtcagagaaaaggaagggtgagctcacatggagtctttaccctgagtcctgtcctcaccctatctaggagacagagctttgactgtgccatcccttccatacaatccccgcatctgtgatgcactgtctcctaagggccccaccattgcagtgttccttctgtggtgttgctggttccaggagcccttcacgcccatcttgaagcctcagatgaagtccaaggtagtgaggagagactagggcttctctggggtgctttcgagtcatcgtccctggagaatgatggtggctactctggtcacttgaagaaaagcagaaaggctcgtttatacaactcaaaagtgcaatagtggctcacacctgtgaccccaacacccagaagggagaatcaggagggtggctgcaagttcaagggcagcttgatctacagagaagaaaaaatagccgggtatagtgagtctagaggcacagacaggcagatcttttgtgagttcaaggccatcctggtctacataaagtggtccacgacagccagggctgtgtagaaaaagcctgtctcaaaaaaagtgggaaggggagctggtgagatggctcaacagttaagagcactgactgttcttcctaaggtcctaagttcaattcccagcaaccacatgatggctcacaaccatctgtacaactacaatgtactcatatatgtaaaaataaataaatctttttttaaaagtaggtggggggagaaagaagcgaagactcgatgttgtggcaagaggtggccatactgtggaatagagccacaccaggcctgatgtgtgtcccgagttgcttttcttgtgaaagggctttattggcataagggtgcctggaaagtacacagaggaaggtggctggcttccagactcaactgtttaccttctgtagagcagccaggaacgcagggagcttattttccaaacagcccctggttgtcaggtctacgggcctcaggctaatatccacctcctccaccaatcctcaggggacccctggccttcttctgcctgatttttgtccttgcaaactccagtagcccaagatgtacctctggatcctaaaacaacaataatgaacacaagcatgccctacctggtactcaaactaggccctgacactatgcccctccccagtacctggcccagcgaggactggagatggagaccagcatggtagttctgtctgaacttaaggaatgtgcccactgtcagtcttgggacccagtcatcttttcatagctgccgtagtctgaaaatactgtccttttgtctgtggtacctgccacggcagaaccagcaggcatggctgtaggtccttgggtgcagcctctcacagtaaccttcttcacttgccttcaaatcctgtctgggttggaagaaaatctagtgtggcatcaccacacagagccagagaggccctttgagtttcctcaaggaaaactgaagccagggttatgacaagctggtggcttggcagggcagacagtggcattcctctgggcctcaggctactgcctgctacatagcatggctggcccttttttttcttcctcggttcttggtgttctggtcgtaggaggcaggagtatcattcccatctcccagccttgctgtgaggtctcagaagacaccccagaagcagagtcagggtgaatctccttaacgtcgagaccggccagacacaattttaaacaacaacaaaagatccttgggtcgcatcccttccgctcctcagtctggtgtcctgcctgtatttggtttgtttggtacacaagcccatcaccatgggaaggaagcatagcccttgatgttttcttattgggaggtcctttttttttcttttaaataggggtgacattttaacatctctcctggcagaccataaaaagtggggttaaggacagcaggaaggagctgtcgtattcccaaaggcttatcagaagagttaaagtaaggatgtatgtgcaataggtgtgagcagggcctgaggggctgacaagacagagtatgcagtatgaacaagtgtggggaattgtcaccactcataggcctgctgggacaggggaaccaagaatgtaaatggagccatagagatagatggctggccgtcctgggagatgggctgtgcagaaataccaggactgaaagagtcatgaggaccaggtacagggatcaagcgtcatgacctaccttcgatatcaccttcgctatggcccctatctgccattctgccggagggcagcagctatatggttgtgacttttgggattgtgacacccaggggacagagtggacatggggcagaggatggagggtgggttggaagtttaaatcaattgccttaggtctcactttgtatccaagccaaactcccacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtggggggtcagccaggtactgggctggcgccacttgcctccaaggagtctagcctggcaggtggtgatgaccatgtgctggcggcagacatctggcgcatcaggaagcgtggtgtcagggtgccctggctgttggcaggtgcttttggcttggggtcaggtgatgctgaataccagccggccactctggctccctcgaggcttgatcctctcagccctgtgttctttaccaaacaaacacattcccctgtggagcagtgtgtgaagtactcaactgacccccggcatgcagccctgtactccggcagccctccagggtcagtgacacgccctggtttcagggtggaatccaagtgcccaggttgtcagggaagcgactcctagacttgccaggaacaccactttgccatggcttcagagtatcaggggaagaatatctgcttagatggagctctgactgggtgactggtcatttttcttaatctctctgagctctggtctcagtggttgggcagatgaggtgtgtccagtaaatgctatctccatacagccagtgtacatcgtccctgcttgtgtgcctttggggacctgcatgctaacaaggagtctgggctctcctcagctactaagaataacgagtagtggggcccttgggctcttactctgtctgtcccatctcttggggtactgccgaggctcaggggtcccagatgtggactcaggaactgaagttcttctcctgtgttgttctcaccttacagctgaacctcagcagaccgattgaggagcagggccccctggacgtcatcatccacaagctgaccgatgtcatcctcgaggcagaccagaatgacagccagtccctggaattggtgcacaggttccaagtgagtaagggtggagggagggccaggataggagagctgtaagcttagagcggtggcttctgtagagacagctctgccacgggcgagctgcgatttcctgggcaagtgctcagcgatgggccaggtcttgcatgtaacgcaggtttgatgtcagtactggtccaagtgttgatgagcccagataaagtttctgtgtctccagggcaggtgtgctcactggctggtggctccaccttgaccccaggatgggaccttgctgttgcaccaggtcaagggtccctttcttgaaagcgtttgaaccatgtcctgcattgacgggaaagcctctcagttgtttgatttgatattgtgtatgacacttctcacaggcccgagggaggatccctgctcccacccatttccccagcagctccaggttctgacccctggttgacctgcctgtcaccttggggttctcatgtggggtagccattgctgctgtcatcgctgctggctcgccctgtgtgtcctctcttgtggacagatgcgattctttcctctggcagggagctcaggagtcatgaaacaaagtcgtattatcagcggaaactcagctaaaacagtggctgttccagggccgccccaggcacagggcgcttggaccagcacttttcatctgcagtaattggaggctggagatcctttcctctgttaggacaaagggactcttgtcacacagcagccatcctgctgacagtgttcctcttgccacgtgttcagggttggtggcctcaatccccaccccaccccctagcatctcatggctctcacccacttcctggagacctctcactttcgaatttctttccccaccgcttgtcctacctactccgtgcctcctgtatgctgtctagggtgtccaaaatgaggtagggattgtccctgtgggcctctgcatggagcccctctcgtttgctcataggctgaagctgtggccttggtcctcctcaccttgtggggttttcttgtttgtaaaatgagtgctcgcagggaggagctgctggcagtgatggaaagagcttccatgctcagccctagagggtgctcactactggtatgtgccatgcatactccttggatccctgctctggggcagttcttcaaggccagctcaggagtgagacaaggctagaaggtttggcctgactggcccctactccctggcctgaaaagcagccagcttgagcctgttccgtatctacatcccgcagggcaggtctcatcagctttgttttataaccaggaaactaaggctcagaggtgtgcagggtgtggcagggccagggcttaatattgactttctcagagagccctctctgctccttccctgtgtggctcttacaccgtctctcagtgaccaagtgaccgaatgccttcaccaccatcctgtaggtacagtggacactcagtgaagcagccaccatcatgtctcctgtcctttaggggacccccaagtgtctaactcctatgtctgcagctcttcagagagtggttgttctctggggagagagcagagcctggggatttgtgtagaatgtctgccagtcccacagaggatggtgctgatgccttgcagggaccctgctaagctccctctggggggaaagccaggccggggtaagggtgaggactccagcaggagccagtcactcactcttgttcctcattacttttctattgctgtgataaaaacactatgaccaagatgacttgtagaagagtttattctagctgacagttccagaggcagagtcggtagagctagggagacattagcagacagtggcagcccggcagaaggagtaggaagttgagagctcacattctcaacctcaagtgtgaagcagagaatgaactggaagtaggtgaggcacttccttctcagagcctgcccacagcagcacacttcctccatccaggctgcatcacctaaaccttcctccagtaacaccaactgggaaccaagtgttcccatgcctgaaaccacagggcacgtctctcattcaaacaccataggtagctctctcaagccggctgtcagaaagtagtcaagtgacactggaactggcgttaggtcctgctgtcccccttcagtgccctgccgcttcttcagactcaggtgagagggaaggcgcatgagagccgcctccaaatccatgggccgtgtaaccccagtagtgtataatatagttatgttattatgatcattatgtccatagctgctttgtctgcatgcatgtctgtgtaccacatgtgtgcttagtgtccatgtaagccagaagaaggctttgtattccacggaactggagttataaatagctgtgagtctctatatgtgctgggatgaacagccagtgttcttaaccgtgaaaccatctctctagctctagaagagtcaacttactgataacagatttacattgctggggttacacgacccatggacgaaggctagggattaggtccctcggggcaagacagtagggactatcagcactgacctgatcatctctccttgggagatgcaagttcagagccaggccacatagatccaggaactgacccttgaacttgaccatgctatggccttcgttttcaaactcttgttcagttttctgtattggacagtaacaagaaggcattggcttggcttgggacccaggaggaacagagatgctatgatcaggcatggtgactacaggagcaagaagcagagcccaggacctgttatacagagagatcttccctgcaccttaagtgttttgtgcagtagatcaaagtgaaggggctctgcctcagaaaggactcttccaaaaggaccccatcttactcgggtccccagattttaggatcatatgtagaaaacggtgacctttggagatgttcttatgagcctctggtcctcaaggaagggagcttcggaaccaagaccagcttcttccttgtgtccaggtaggcaggtgggagggtgtgggcctggtgcgtactgcagttcatttgagccggttgtcatggagaccacgcccgttcagttttccctttggattaacctcacaatgagggctcgctgggatgattcagggttttctgctccaagggtcatgcagccagcagtctggcgcctttgcccactgcctgagacttagttatcagtgcacagacatgggcaaaggttcccccggggagggccctgcctcctgggccattggggatgggtgtggctggtatacaggaaccctggagcctcttggcttctcagtgacttcctctagtgagcagtaacaaccttctctgtcactttagtgccacctgtctagtctgactgcaagggttagactggtggccctggggctcccgagactccccaaatggagcatgcctgttgtaacccagcaagtaggcagctcttccatgggtggtccctgaagaaagacaggaaggaggcatgaatccaaagtgatgggttttctcattatttgtgagtgtgtgcatgcattcacatatgagtttgtgggtacatcaggagtgtgggggttttgcttgatttgtttgagacagggtctctctttggccttgaacttagtaggccaggctgactaacaagctcttgggacctgtctgtctcctcctctctaacactgagattataaatatatgccaccatgtgtttgcgctctctctctctctctctctccctctccctctctctctctctctccttccccccccccctgtctctctttctctctctctctcttctcagggttcttggtcagtctgtcagttgtctgtctgtctgtctgtctgtctgtttgtctgtctgcctttttgccttttcaagacagtgtgtctttacctaatcctggctgtcctggaactcactatgtagatgaggctagcctctaactcacagagatccatccatgtttgcctcccagtgctgggcttaaaggcatgctctactactcctggctctggataccttctttaagggcagccttgtgctgttccttctacctcttccttcccacactagccctccacagaagccactcaagcctgactcttgcccaccctttgtgcaatcggtctgtgtaggcaaggtcaccttcgtgaggatgctctatcccgatagtagatgcagttcctgttccaggccttccccatcttggcctttactttccaccacttggaagttcataattcattgtcagttgttgttgtctctccggggccacctgcttccaggatctttgtccctactgctgccctccacacctggcatattttgaatatgcctctgtgtttgtcaatagaactgtggggagggagtgtctggtttggggctgggtgggccctgtgggccagggatgggtggagtacacagctctgggtgactaggagcagggaagaagaaagccaggagatttagggggcaggggctgctgcctgacatgtacgagggaatgtgccctggagccagcaggctgcagagcggcgtggcagggccagagctcagggagtttgggagccagtctctggagcttggactttctcatgcagagagattagggagtaagacgaatggtcataaggtcaggttaattgattgggggggtggggcgctcaggatttttttttgccagtgcaaggtgatctttaagcaggtaatcactagagcttggacatctggaccaaagaggcctccatgctcagccccaagtgtgctgtatttgtgtttcccttctcagctgccaggacaggataaaacactacttgttacatcatcccaaggatacagcagggaattcccgccccgaccccatttattggttccttagttctccatcgggtaccaacagcgagctgttcagtcaccctgtgggagccctgaggcaggagacccaccctgtgggtctgggctcaggcagggagtgcagcttgcttctgtacgatagacttggcaacctctggtggctggcggagagcgtggtgttcaaggctcttcctgctagctggctgaggctctcttgggtcttcaggaccttcaggtgctggcacagttcctcatggttaaggcaaggggatgagaaggtgggaaatctcatgccggttctcagtaggttcgccctgcagggaagggactgagctcactccaggactcttgtttccctttaaaaattaaaatagcctacaaggtttttgtgagcatttttttaaattaatatatgcatatgtgcttggagcagtgcctggcatggaatgagaactctgtgtgtgtgtctgtgtctctgtgtgtgtctctctatgtgtgtaggtatgtgtgtgtgtctgtgtgtgtgtgtctgtaggtgtgtggatatgtgtaggggtgtgtctgtgtgtgtgtgtctgtgtgtgtgtaggtgtgtgtgtgtgtctgtgtctctgtgtgtgtgtgtctgtgtgtgtgtgtctctgtgtatgtaggtgtatgtgtaggtgtgtgtctgtgtctctgtatttaggtgtctgtgtgtgtctgtgtctctgtgtatgtaggtgtgtggatatgtgtaggggtgtgtctgtgtgtgtgtgtaggtgtgtgtgtggatatgtgtatgtaggtgtctgtgtgtgtgtgtctgtgtctgtgtgtgtgtgtctgtgtatgtgtaggtgtaaacactgaccgttttcctccgtgttgtcaggtatatggtagtacatgcagaccctgtggcaccagtggggcactcgctatgcttctaataaaactgtcactacagtgacagcagcactttgctcccagctttatctgtggccatagccagtttataagttctcaattgtaattggagccaatgaggcagcaattatgaaagtgtccctgagtcgaggcacgcctgtgagggggccatggaaatgtgactctgcctaaaaggcagggtcagggagaggcagtagccagagggacttggctgttattcctggctctgctcctcaccagttagcccatgttggttccagtcactgtgcctgccatacgagggacgttttagatgatacttaacagtcaccttgggatcgcccctcactagttcctaagtgtggctggcacctcccaagccatagccccatccacccttccctctcaagtacggatgcaatagcacaagtgtggagttcaatgtggcagcctccagcactgagcagcccctagtggagggtctatgctgtgccggaggatggaggagaaggcaaggggacaaaggtttccttgttcttgaccttctaacccagttaggaagccaacatctaaacccacaagaagttgtgtaacagtctaaagtgagcttctgttggtttgcatgtgggcctctggggtcagagctagaacatgggacccagaaaagattttctattgtcacagcagatggatgacagaggctgtctttgtctagtcacgtaccatgtggacaccctgcctggatcctgcccatctcttactagctgttccttatctcaatccttgagataacagaatgagttacgaatttttcaggcctaaggaagctgccacctcccgaggatcatttagaaagaggcaggactgtggctatcacgtatattcttgtcatatgtgcatgaggggctcctttggacagtagctaatggtgcctttagctacttccctttccctcagctggctggagggtcagtaactcagggtcacctaggaagagttcagtaccttggattgcttctgacccagctggtgccatgtgctgatgaaacacaggctaacagaagccaagggactcaacgctgcttatatcccagtcccagaacagcagactcagtacagggcggccatgtggtcaacctcaggatgactgcaaatctcagccagaaggccagtccccccatggagaccgtcatacctcccattgtttatttaggtcgtagggactgggcactgctctttctgctgaaggaggaactcaatttaatgcctttgtctggcagaaggcactcctcctatccccactgtggatagaaaacccaagccctgccattccactgcccagtatcagagtccttacaagtgacaggtagtgttttacctcaaggtttggtgcatgctgagttttagaaatgtgtttattggcagagcgtgctggtacacgcctatactctcagtgcctgtgaggtggaggcagaagaatcaggagttcgaagtttagtgatatgagattgtctcaagtcaaacgaataaacaaaataagatgcttcatagtgtgttttctgccagacatggtggcagacacctgtaatcccaacacttaggggactgagggaggaagactgtgagaccccccaaaataagcaaacaaccccaagaaacattttctagttgtaaagaaagcatttgtacccattactcagtttctcagctgctggtctattgacatcttgaactgcgtagttctttgtagttgggacctgtccaggatgttcagtggtctgtttggtctatacctgctcaatacagcagtacccccaaacattccctactgtaaggaccaaatatgcctccagagactgccatagagttgttgggagatgtcaccctacttaggcactactgtgctttttaaaaaaaaaagggtagtatttttatctttgtgtgtgtgtgtgtgtgtgtgtgtgtgtgtgtgtgcatgtgagggcagtgctcacagcctaaaaatggacattcgattccctggagttggagttgctagtaattgagagcctccacacacggctgctgtaaactgcgatcaagttctgtgcaagcctgctcttacctgctgaaccacctcgccagctccagggctgcttcttagggtattgtttcagcagccctgagagcctggggtcacgaaagctggttctgtttgtgagtgtggatgacgaagccccaagggtctgctttccgagcctggggatgggttcccagcactagagaactttgtcctgtgggctcctgcctgtctctgcgttcctagtttatgaagggattctatatgctgactggtatctgtgtcacccatgtggggctgtagttatgaagcccagcttcctttgactttatggaataagccgtgtctctgtggatggtatctgcatccccagactgaggcttccataccttctgaatgaactccagcctctggtctgcttcccaaccctgtttgtgaacctcttccaatgatctgtagtaaccagacatcacaaggaccactggagtcattcgtcattcaatcagcaagtactagtcgggtacttgctgtgtaccaggaatcaaaaaacattgcagaaaccacaataagttagacaggccaggcagatacagtgtatgcctcatggactgagctcacacatatagctgggtatgtgcacgtgtgtgtacaggaatggtgcaaacaaggcacaaggtattagaagaaaaagaacgcagctccagttacagtaaggtccagggggaaataagacatagcctgtgataatagagaactggctgccttttgtgtgtcgtagaggaagaaacctcagttgaggaaatgcttccatgagatccagctgtacggcattttctccattagtgatcagtgggagagggcttagcccattgtgtgtgatgccatcctgcactggtagtcctgggatctataagtaagcaggcagagtaagccgtgggccgcaagcctttctccagtgatggattatgatctggaagtataagccaagtagtaaccctttcctccctaacttgttttttggttatggtgttttgtcaaagcaatagaaaccctgactaagacaaacaggaagagtctttgaagacaagtgatatttgtgaggtcccttttccgatgactgtgacttcaccatctagtgccattttcctctttgcaagctatccaaggtgagcagccatcaccccacccccactcacctgtggcagttattggtgacatgagagggtgcacacttgctggcagagcaattctcacctctgagcttgcctgggccaaaacatgtggccctgggtctattgtctacaccgcaacatgcgaggttagagtgtctggcaataagacctcctgctctgaggcctgttggaaactagaagtctggaaggctgcatgtgcaggtgcggaacccagtatcccctctcaagtgacgcctgcccttcccagagtttaccagtggcactgcacatagaaggagtcctcaagacctgcttttctctgcaagttccagggttctgcttaggtgttccatctacaaaccaacaaagcactggagaagagggtagggaacctgtggctaccaggagtccctgcctgctcccaggaactcagtcagaggcaatcctgcaggctgccctgttgtgtttatgcctgtaactgaccagttcttcatggatgggcctttagacagttctgatctcattttagaagcaagctgcaggtgactgtccccgtatgcatatggggggtctgtaggataaatcccatggtagagacatgaactctgcacgtttttcattttctccccacattttctccccatgaaggttataccaccttcgtccccaccatctgggtccatctcctaattagtacattttggcctggagctaccctctgtgaagggtgccaggattccagcagtgtcctgggaagggctgtgttggctgatctaataatggggctggcctcaaccaccttgcccctgactatctatgctgagcaccatacatggcccatctcttctgcatcctgtgttgtcaggttctgacgtcttgtcctcaggtataaacagggctgaggaacagggagggctccagtggattctcttgtcctttctatcagctctccaaaatcacaaagatggagtcagtgtaaatggtcaagggtccaagggcccctccccaagtctctcatgaacgtgcagtgcagtccgtgtaccccactatatcacacttactaccaaagcttgtatgtttcttgcttattccccaggtcaggggatttattatatccacactccttagctggtctgtctccaggacctcagcctgaactttcctttgagacccacccatgtccagcccagctgcctggttcccaggtaatctcagtgccctttcccaaggcctctgcctgaaatgatctttttcctcttgacttgtgcccctgactcttcagcgtcagtgggctcaggaaccccctccctacattcccttatggccagactcgtgtccccctcccccaagtcccctaccccaccgtcatccctgctgccatttagacgatctttatctccgtgatggtaggtgggaagtggtggtggttctgtagcttaataggcaagaagttatactcaccccctcttcctaggggctggcctcttgtactcctggaggctttgggctgagggctcagacatgagagatctctctggaatacaaatgagggctggttaagaccccagtgtctgctggcaggaagctcaactctccagagaagccttctcagagagtgagacaggaagctgtgggtgaagctctctctgcacacatcagaacagcccagagcatgtggagactcaagaaagacagcccctgggtatagccttgcctgccactgatggaggggggttgtgtgatagggtggaataggggtaagaggtgtgtgttgaggggagagatggctgtgctttctgctccagcctgggtaggttcatgcctagctggcccagcgcaagggacctatagtcacatgctctgtgcttccagggcagcaaggtcacagccttaagaatcagtaggcctcagatctgactcaacataggtgccccaggaaccttttctttctcgttctgcacattacaacctgggtacctaggacttgaaagccagcatagttgatgaaaataagtcctttcaaactcttcattgtatggctaggacaactgagaaaccactaaacctacgtgacttgaagaaattcacaagagccggtgccagctcaatggctttagcccactttcttaactctgtttttctctctgcctgatggcgcctctaggtctttgtctagactggggctgggctgaaagatatgatctgcaaatgattggaaggtggaagtcttgggcgaccatcagggactgttaacacaggttgcattcagatcacctctgtctttgataccatgaatagggtcgtagctcctggcgtattctgtatgctaccataatcacctctttggctcctgaaacccttgctccaaaatttagttgtgtgcgtcccaaggttctgtcctgcactaggcccacagccagctatgtcttctaactgtgctcttctctaagctgtgatgaataggcaggtgacaggaaagctttgcctggggatgttggccttggtcttggttgatgccaagtctacaacagtgggttgacttcatagcttcttcattggtctactggagggtccagtattcatgctcccccccaaagcattttgtacttggcctaataacgtcatcatgacgtggtcttggcatcctggggccaggttttcctttttgcagaactgagccatccctttgcagcacaggttccggggaccacccgacccatcatcttccttccgtgtggtccccttatttctcagtaggtttccactcctgctcggccttgctctgtgccatgtgagtcttcctcataaccacctctctggactgtcgttcactgatgggatctcccaagggcatctgtctttatagtcgtaatccagggctgggaaccttgacatagctgctgcttccttcctgagaagacaggctggactaagggacctccccttgcttctgtctagttctggatccacaagactcccacactggagaggaggttgcagcctcccagtgcctccttttctctgtgtgcattatctctggctgaagctgccacgtggaatatagtctgtacagtctgtattaggctgcaggccctggccccattgcagcacatgaggaaggtttcctaggaatgaactaggtggctctggcccagatgcagctgagccgtccttcttggagccagattttcttgtgccatttttctttgcctggtatcagagccagggctccatacggctcatctcgcactgaggtactcctggccctggtttctttgtccgagagactatcaacaggccctccttggtaggctggatgtgcgagaagcgtgtctggacccgggtataatcagcgcatgagtagtaattcaccctgggggtgagtccaggtccatcatgggaccaaagtgttggtgatgagaagactcctggctctcacccagcataggggtggtgtctaagaaggccaggctttgtgactgtcacaggaactcagagggggaaggtggcactgagaagacccccaggggtaatcttcaacagctgtatagaagtcaggtcagctctgtttgggagtcaatcctgccattcctctggtaggcgggtgctactgaacacacacctcctgagtcccaggagcccatggatagaaccaagggtttcccttgggcttgacctgcagattcaagatgcccagtgtgtccacttttagagccaaatgatgttctggatcctagctcctgctaaacttcacgtacatattgataccatctacagtcgctatctctgtatcattcacaatcaatgcattcatttaggttgtgctcacatggaaagctgggacctcttgggactgctcccgcaagaggatggctgatgcttttgaggattttcaagggaaagagtgaacccagaggcttgaatcccatgttgcagaatgccaaacattctttttctccgtgttctacctgccccttacgtgtcgaccttccctggacttcacagcagctcccgggggtcgctttatccagagcttaggtcacatgggactgcagacttgactccagatgtggacgatgtgacacaatgtcctacttttccttctctggttgtgttaaacaccacaactaacagcaacttgagaagaacaggcttcggtacacagtcaccatccatcgtcaagggaaaccaaggtgggaacccaaaggtagaagctgaagcagcatccatgccgctcactggctttctcagacattccaggcccacctgctcaaggatggcacccttcacctggatgggccctcttatatcgattagtagttagggcgtggtgttgcttcctcaggccagtctgtgggagcaattcctcactgagaattccctcttcccaagtatgtctaactttgtgtcaggttgaccaaagctaactaaaacacacaggcaaggtctgaatttggagcttttggtgagagagcaaaacccacttccctgccaggggaccgcagagatgtagtatagccagtgtgcccgtcttctcattagtctcggattgcagtggggaactgtccacccccaccccatagtgtgtgtgttatcagtgcctctaatggcatcaccctgtaggtctggatcagcttgtacttgagtgggcacctggttggcctctgtctcatcccctctgacagtgggacttactgtctgtttctgcatgaaggccagattccccgttcccttcaggatctcgcgctggtccctcttggcaggccagctctctgagggaacacgtgtttaccgcttgccaggggagatggtttatgtctttcttccagcaatttgtctggcaattctaagaaacttgtggaaaatgcatgcaaccctccattacaatagatgggctgaaaagcttggagaagaacggcttgtgatcacagggaagctggtaaaagcctctgcccctttgcctctcctgtctccagagagattggtatgccggggcagagagtcttctgtgtgtctgctgctttcatcccaggcccaaagctggtcggcgcctgcttgtcagattgtttccttctttagtttcacatggcttctttcccttgtaatttggcttaaattcctgcnnnnnnnnnnnnnnnnnnnnnnnnnnnnnnnnnnnnnnnnnnnnnnnnnnnnnnnnnnnnnnnnnnnnnnnnnnnnnnnnnnnnntacagcctcgctgtcacctgcagtgctaccaacaaacagttgtccttctctctccagagaagccccgtatggctttaaaactctctccctcaggtttctccagctaatagactcctggaatgtaaggccttctatacaagaacctgcagggtcatctgcagtaagtcttgagagacctcaagaagcctagtggttggctgccttggtccctgtcacacgctcttgctgacacaccaggctgcttctggaagcagtggagtggaaaggggcttgagggactgggatagcagagctgaccaggaccagttgggaaccacccacactcactggtgtgcctgctgcacctgcaagacatccagcacgggcatcgggcggtggtagagtcgtgctttgtaagtgtgtgtgagcaggttgggacggggggaagctggtgagtagtgggcttgtgtgtcggcatgcttcattcattgccggaaaggccagcagggatgcttgcccatgggagaagcagggctcaggaacagctctcgggtaagctgaaatgatggcagtgggcacaactgtggggcctaatggccgttcttcatagatctgcataatggctgtgtaagcagccagtggagcagcgggattctcaggagtgagcaggtaattggagtctactagggttgatgccagcatagaggtgcctcccaaggtggcacccagccacatccaagggagagggagagattgaaacattcaggggagaggatagaaaggcagtcctgtgggagttcacggggaggacagtttcagacagagtgggtatgaatctggcttttgcctcaaatgctctcgaagtgatactagggacaaaaatagattctctttaaaaaacatttcaatggctctttctttgtgttgataaagcttactagagaggcagcattgtggtgttttcccctctgacctttgctgacctcagcctggctgtagaccagggtggggctgggtcaaaggcagcagtgggtaaagtgaacttgtatgatcgtctgccagagctctcttcaccgtatgcctggtagcttgacagcagatttgcgctatcgtagcttggggtcggtctgaaatttgtaaatcaagatattagcaggcctgtttccacctggaggccaagggaggacctggcccgcacccacccatacccactgtaactgaatcctaactcgataatggctaaaatcaatcccctttcccgaataaatccagattcacgggtgctggagggttagggcttgatgtgttgggagaattcagttcaccccaccacagcggggggaaacctccctcaagcccagcccgtctgcggaaactcttcgttgtcttcagcatcttctagttgtatccttcaaatcataaatttgaaaagccagagaagagtctcatttctgtacgccagcgagttgctgtgactcaccaagttgcctagggctcctggagtcacgacagagtgccctttttttttgtcttttggtgggtgtatatgcatgtgtacgtgtttgtgtctctgtacatacgggtgtgtgcacatgcatgtatgcgtgcatgtgtggggctagaggaccctcaaatgctattcctttaaagccgttctccttgtttctcaagatgttcttacctgcctgcaattttccaagctagggtaggtggcgtgaccagcaagtcctaggcatctgcttgtctcctctcccgcggtgttggaattacaagtgtgcttgactgtgccccacctttacctgtggcccggggattaagcctgggtactcatgcttgtatagcagacactgtactggcggaggcatctccctagccctctgaccttcaagctatagagttgtcttacagcaacctgtctcctatgtgagttactgttccttcccaggatggtgtcagactcctcaaaggctacccccatcccccagtttcccttgggattctatatcactcatcagaaagggaagttcttctgactgacaacacatctctgacaaggctaagcccagtggcatggccatagtacgtggcacaattctgttcttcacacacattcagtttttcttccttccctccctccctcctttcacacacacacccccactcccgccctgtagacagggtttctacatagtcctatctgttctggaatttgctctgtagacaagactggctccaagagatccccctgcctctgcctcccagatgctgggattagagacatgccccatgccgcccagcttattgcatgttcttatgaattttctgtgaaccacgcaccaatcatttcgttccagtcttccctgccctgccgtgaagcccttacccattggtgcaggaagctggactggcactctgctagagcatactgatagagagatggatcagccctgtgctcaggcagagcttttacctacccgggggtgaatggcctcaccagaacctgactgctcagctcaggccttaggcgtacctctgcttaatttcccactgtggctactcacagatacctggtctctgctcttccctcgtgagcttctctataggaactctcagagagagttctctgacccctttgtcccagcatcccagcaagaaccctgagcctgcctctgatttgtcacttgtccacttggcccaaagtcctgtagtggggaaaggacaagagagggacagatgcttgagggattctgggtatacagtcttatcaatgcccttgtcacagcatagccccctctaaccacaagccggcttttctttcaggagtacatcgatgctcaccctgagaccatcgtcttggatcccctccccgccatcaggaccctgttagaccgttccaagtcctacgaacttatccgaaagatcgaggcctacatgaaaggtatggacacgtagcccagccttctgacgggtggtccacctctgtggtcacaggttgtcactgttcaaggaaaggcaaggagtcttgtctcgttaggcactttgacacagggaagagttgagttataggggcgaccatcctaggcacggaaggacctgtgttctcctttgcaattggggttaagagacataagccagaggatgctttgaggagagctattctggctgctgctgctgctaagggttttgctgtgctgaaccccgtggggagatgaggtgtcctgataacgctgtggttagggagcagaagtgtgtgtgcggaattgctcatgtgaagtagagttatataacagggcaaaggagacaataggaaatcaggggcctttaatcaaatgcagagagaaatcaggggcctttaatcaaatgcagagagaaatcaggggcctttaatcaaatgcagagagaaatcaggggcttttaatcaaatgcagagagatgcacatggctgcctctggacatgatggcgtacatgctgtccccctgagtagagcctcccctcactgtggagtttctgccagctgtgggctctcatccagagaagttgcctctatcccacctcatcagccccagagaagcatagactgcctcttcaaggtgtgtgtttctgtgagacgtatatttgagattctgtgagcagtagctgcctcctcttccctgcctccatgttccctgctgagccttttattttccttttaaacagcagttttttctttgccttggtgcaggggctactgagtgattccccctgcctacgtatcctatagactatatttgtggcctaagctgccctgaactccaacctagatgccctttgccgtgctagcggaatccgtaagcacattttggtagacaggaccagagctagtcctgaaagaggggatagggatatgggagtgtccgtttattgggtaagcaccatgtgcttggccctaagcctcttatggtctgtctttcagcactgtttgctgggcacagcgatcctgtccatttcacagatgaggctcagagctggtatcagtcagcgttttgttatcataatgaaatacctgagctcagctgtgtatataaaaggaaggtttaattacctcgtcgttctgaaggctagagtccaaacagtacagtgcagagctgtcccttgactgtgttccctcatggtgggtgacactggaaggagcacagatggaagcaagcaaatggccacatctcagacggtgacctgtggacaatgacacttgcctcctttataataacagctcccttgccttgtgaaaactagcagggactcccagtggcatcaggaatcacacacacacacacacacacacacacacacacacacacaccctccaccacttaaatgattcagtcatttacactatagccttaggaacctccaaccacacagacctttggaagatggacggacagacggacggacatactatattcaaactacagtagagttctaagaagtagccagcacggtggtgtcccagaggccctccagttctggagcttcagctccctgcctctaagctttccttttaaaaccatgaccatgggtggacggtacatccaggttcccgcctggagcattggcgagtcttccattctctctaaggaatatagacagctcttcccggggaagagctgggctaggctgtcatggaggggcctaggggcttcgttcctggtgcctgatcttaccagttatcatgagctctcagggcgacgccttcttacatatgtgtgggagggtacaaaatggcaggtagccagcaaccttcttccttgggtcggaatggcttgatttgttttatgagatgggtccaaaactctggatgagaaaaaggtatttttttgaacaccgatggcataaagagcaagtagcattgaatatgagagaggggccatctggtgaaagaagatggcaggtccacacttcatttgatgttctaggcctgcctgtgagaagtgacagccttgagtgtgggtctgtggaaggtgccaccatgtaaacagcagaggcagacaggtcgaggctgaattggaatctggccccagctgcctgtgtgatcttggacttgttacctaattctacctgggtatatggaagacgcaggtcatgtggctcaccttcacctgttaggataaaggggatctcatttgtagagacatgggacgccgtttggtctactgggtcccccgaaatagaagcttccggctgttcttgctataactgcagggcccaggcagcatctttattaggtctcgtgagcttgctgaaggcgtaggagtgggaaagcagggctcttacacgcattccaggggcagctcaggcctggtgtgagcatgcaattcgtgatcaaggagcaggtgggtggcagtgcatcggcctcagcccgcacaggagctagggaacccgctagctgtcagtgatttcagacaatcaggtcctacaaggcagtgaaaactaaggtgcatggaacttgttccagagaggacccagtggttagttagctaacaggtttccaaaccccaggtggaccctgctattcctgggcacagaagagtgctacctgggacattccctattgtgcccacaggacggtgttctgtttttttgagcctttatggcatctaagggtcatggggacttctgatttgtagttcctttggtttctcttgcatccattgctaatgtcccccatcttagatgaaagggggtggtctcaagcctctgtgtgaatgtcagtttattctactgagtgggacttcagtgggcagacatgctagaaggaccaacagcgggttcatctgcccagaactgctctgaggctggccaggaagcccaatctctggtttactaccgcagtggttctcaacctgtgggtcacgacccctttgggggttcaccgaccctctcacaggagtcttctagctaagatcatcagcaaacacaggtatctatattatgattcataacagcagcaaacgttatgaagtagcaacacaaattttatgatggggggatcaccacaacgtgaggggctgtattaaaaggtcgcagcattaggaggtttgagacccgctatgctacagctgccccgcagcttttctgggatgggggtgacacaaggtgactcagagtcagaggaaatgtaggagggctccctgcctgctggatgcctttggcaaatgacctgcctgggtggacagatgggataggcaaggactctgagactgccaggcccgagagtaaggtgggacttgggttttgtttacaatgtttctgtgcttgagcaagtgagttgagattctcacttgtcagatcaggatagatgtggctggaagcagccttgaacagcccatcaccagtgtcctgtgaggagaacctagcttctggatctcttgacagtggcttgcaccagctcgggctctggatggaggctggggacaggctactggagggaaggtgccaggcagaaaccattctgctggatccatagccacagtctccaagccttgcctgccagggcttacaggaaccacggactgttccctaaagcaggattggttctgggctggcaggaagtgttgaggggaggggggagcttgtgagtgctgcaccctgaattttccttattgcctgcacaagccagcttgtgttcttccaggagggcagtgggctgggaacttcctgcgccctttcctgcacatggggcagtttcatggcagggctcctggtgggctccctgctctttctgtgccagcccctccacgggtgtaggggcccttcctgggaagggaactcatgtgcctatgcctcagaccctgatttttcttggaggcacacagcccttttcaggcgtactgtgaaccaccataattacccctgaaattccctcagataattatagcaatccgagtggcagggcttttgtgtagagaaaaggggcttggtgagcccttcctaagctgccagcaccgggaggctgaggtgtgcaccgggcccctcccttctctgagaacccagccttcaggcaagcccgagccgggagaggctactgcagagacacttggcttctctggactctaggcacttggctcacgaggaaggggccccagagatctcatggcacctgggccagtatccatgcttacatgcccccatcctctccaggcagaacatcctctaggagaaccatccctcccccctttagtgatgccccaggctcagcagtcagcatcgagcatctttgtgtggtcagtgccttgtgtggtcttagcaccacattcctagatctcctgtcccccaggaccaggagggaagcaagacccgttctctgctttacaccagccagccgcagactctcagcatgtaagttgctataagagcagagtaaaacagggcttccctgggcctctgtaaaagccttgcagcttggctgtgtagcagtgagtacccaggcagctcccaggacctcattctttgatagcatggccctgctggtccacagtggtcgctgaatctttaggttcggaagctgcgatatgtctcccagtggccagaactagctgaatgctgagctgcaaggacttgggaattaatccttcttctgtgtagctatttgcccagctgaaagctagatgttagcactgggaagaagagctagcacagaatgtgagggggcaccagtccgttctctggtcatccccaaaatgcgagctcctcctttggaaacctgccttttccatatgaatggcatttggaagggctgttgggcctctggctggtgtggggtatgccctttgccccctgaccccaacagcaatttcctcaatgcagctgcttaagagcactgaggccaggtttcagtgtgacacacccagagcctggcccgggactcattcatatagctgcttcttggagatagccacttggtggcatgcctgtacccgtgcctatctttaccacctcccacccctcaggcagaggcacaggcaaccctgagcctcatcctagttcagactaaacatggaagctcccaggaacatgacatttcccggtgcagggcttgtaggggtagggaggaaaccctaacgacaaactgtaattggcattcatttgaaggccagttctcacagggataacccactgtgcttcacaaggctggcgtccagagacacaagccccaaagtcaaggcttggttctgctgtgccaggcaaggcaattaaaggtatgactctagcccgttcccaaactgactgaagccagatgtgagaggatccgaatgtcgctgaatggtatggatttgtgtccttgtccttagggataacaactgggaagggtcttgggacaagggcaagggctagagggcttctttagggctctaaggactttagggtgaggttggctttccagccctccttttcctgtaacctcccacgcgatctggggaggtgaccagatggcctgtcccagacacagacctccccagggaggggtgtgcacagtacaagcaatcttccctgcctgtggttttaatgggaaattaatcatggttcatcttggaggcggtttggaagcagggttgaaattgagtaatcttgacaccaggaggagagaaaggaacgttgcttagagctctggacaaatggctctctaaagatgagacagggcttgtaggtcagggtgcagctatccatcctaggagagctagcgccacccactcagcctcaccacctgagccgtgctccaggcagtcgactcgtatgcctgacactgtggtggctcttttcccaagatgactctgtgaggaagggttgcccatgttagaaatgaagacacccgagtacatcgagccgagtgacagagttccaagatgaccagaggcaggtctgggatagaacctgcctggtctgagttgctcctaacccccagggtaccctggcccctgcatgcccgcctacctctgtggcttttagggatagcgctgtggtgggaggctctggtgctcatggctaatgattcccaggtccctgccattatggggccctgccagctggcagtgttcccaggagtgggtgccttttatgtataggaggtgaccgtgaccagagaaggtcttcagtgtccatgcttattagaacataatcctgattgctctttgcaagtacggccatagattactttaaaagagcagcactttggccctgaggccagagcacactgcgggcagatcacctgggagcatagccccaggctggccactgccacccctcaggcccaaccttttcaggcctctaggccctcctgagggttactggcctcagcagctcccacttaaacctaggtccagcgggaaccaaagtttggttgtgtcccctctgtgttctgtggctctacaggagaagggagacagaattacagtgagactcaggaacagaaaatggagttgaaaggtgttaaatatgaatactgacagactagccaggaaagaagttttggttaaggaagatggaggtgctggagaattcagagccactgaaagaagcagttcatttgcatgacgatgaaggtccagtctccccaccccctaccacccagcccggccgtgctaaggtgttcagcaccttagcagggctcctgaccattgtatttgctgctgcgaaacctgccaagttgtctcatcagattccagcgctgcacccctctaatctacttggtacatcgtggagccccaacagaggaaaggggaaagtgtcagatatgttggcttgtggctttactctgctgtagcacttctcagagccttgatagctacacgaatgtacattattagtctatggtggcatggatttttttgaatcataaaatacactggtacttcatattccaataagtgataagtgatttgccccattatgagacacatctcgatttcatagatggaagacagaatcaattccaagtgccttggaatcaataaaatacagtcattcttactctagtctagtcagctgtgacactgtatacacccccataaccgccatgtatacacccccatatcccccacacatacacccatacccccccatgcacacaactgccacttcatggggcttctggcaaaagatctgctctacccaggacatttaaattccaggctgacttctatgggttttaatcagttcatttcttttatgtatgtgggtatttggcctgtatgtaagtctgtgcactatatgaatgcagtacccttggaagccagtagagggcactccgtctcctaggaatggagttaccggtggttgcaaactgccatgtgggtgctgggaatcaaacctgagtcctctagaagagcagccagtgcccttaacctcggagccatctctgtagctatatctgactcaagtcttcaaaatcagctgctaatcttccttctggagtcttctcattctttgaagggatgtgtgaaatccacatacacttctaaaaataagaagttgggttatacacacgtatgtctactgctacaaccgcacccccttcatatctgtcaccctgtgtccgagtcaggcacaaaaacaagggagggtgtcctaacaatatcatattcaatatttgagccagtcagtcatcattcatttgactatttgggtgcatagtgttacttagttttgtttggacttggcaggggtggagtttgttttgttatcatttttgttttgttgctatagttgtgtaaactatgtttctgtatatttctatacaaattttcccccagaggtgggatgtcttgcttgaagaatccgagcacgctcacacaggcagatcttgccgttttacccttgagcagttcatgtctaatcccggcagctctgtctgggggagaggacacccagcccatcttagcaccgtgactagacaggtccggcgtctcttactgcgtttactgcccacttgtgtttctgctccaataaatcctcatgggacttacccttctcttgggttgagggaaaaaagttgttattctatttcttattgactatttagaatccccttggaatggaggaaactgtttaaaaaacagtttctctagtgcaagcatcgtctttgtgctggggccaagctaacatctatctctgcttcctggacacatcctgtggagagagcactgcaggcgttatgttttatgtgtcttggaaacacaggggtgactgcagtttgggagttgaacctgagagtctgggggagccccactagggtctggaggggctgtaaatcagtggggacagctgccactgagctaatccacatttacagcagctggtcagggttcaggaatgtctggccctgtcccagcctgtgtctggctccttcactcctgggctctgaacattccgggtggaaatagctgcttggctccaggaaacagagacaggtcaccagcctggtccggaggaaaacctgtcaggaggctgactctagtgtgcttcctcaggccatgtcagccccacaccgggatgttgatctcctccagccctgtgccctcatttgcatagaatcctcccacattaccttacctgtagccaggctcccaagttgggatattgctgtctgtagggagggtgatgggacagaagacctctgaaaccctagggagcagaacgccagctgtggccactgtggaatgctccctgcatcccttactggccccaaatgaccctagccagttgccctcttaggacttacggtgactgcatgtatagtagatagttttcaagatagcatgtgctcttatcatttggcgcctcagctctttttattattattaatattattaattttcaggcagggtctgctgagcttgtaatctctctgccttaaccccccgattagctgggattgtggacttgtgccaccaggctcagctctaaacgcctctcacaaggacatcggctcttttataccatagccaaccctgatgacctcgttttacctggatacctcattaaagagaccctctcttctacagccccgagctgagaggactgaggcttccacgtgagcttcaggaactaagcgcagccctttagtgtgagctacttcagtgtcgggagagcttgagaagcgagctgaggtctccagtgatggaaacctagggtagcaaggcagtgctgagacttgtgagatgccagggagccgcaggtttggggtagaacactggggagagaagacggttatgtgtgacaggctccgggagcaatttcctgattgtgaattccaggaacacctaggggcagctgggatgcagtcccagtcctgggaccacgggggctgccttgtctgatgtcctaggagagcaggcctagatgatcctgtgtgagtgagctgaggctggggcattccaggtgccctctagagggcgctatcacattggaacagggctaccttgccctcttgaacttttcaaacgccctgcatgagtgtagcctcgtatgttcctttagcagtccaagaggtagatggtgtaaaagcgttccatctgcagatgagggagaccagataagagagagaagtgtggtgacctggctagaggcacagatgatagtgacaggactggctctggggcctcaggcaatgctcatcaccactgccacattttactttgggggaatcttcgtcccagagatggcttcttctccacactctcctggccccgagctacagagatttcagtgcccagcttgtaccctgtccctgcactatggtgtgtagtcagcatttgatcccttctgctgagcatctccaacatggctcactcccgctgacggcttgacccacagcagcctgggctgaccgtgccagagcagccatggctggggagtggctcagtgtgctccagaaacatgaggacccaagttcagacccccagcacccacatcagagcagacacagcagtgtgcagccctaactccagtactgggggcaggaagtagagacagatggatccctggagcctgctggcaagtcaggttcagagagagacccccgtctcaaaaaaaaaaaaaaaaagatggaaagtgattgaggaaggcacgatgactgccccttcaccactccatgtacagtgtgtatatgggtacaacacacaagcacacaataatgacactacaaccagttcttggtatgatcttatcaggacttgaactagggcacctcttcagctcccactgaggcaacaggccctgcaagccaggtagtagactaggttccatgcctttaacagtttatctcttaccaaacagaaagagtttaaagcaaagatggcaagaggtgaatctgtgtcccttttgtaatttaaattctttcataatttaaatgcgttctctccacgccggagcggaggagcgggtactgattttgtcttgacctcattgtagggaaactgaggcacggagaagtaaaagtttcaaatgagctgatcgtgaggggtgggactgggatgcagacctgggtgtcctgggtcctcctctgacctgttagagcctagccaagtcagacagtggggtgcgtcatttggttagggcaagcacaacagcagggttctcctcccatgtgaacagaaaggggtgcccggcaaggccatccaggcaagagaattggcttgagtgacaagcaagagttccccaggccaggaaggagtccctagggtccaacacacacagagaggaggacctaagatctggttccgtgtcaatgcttgttttcagaggagtcagggagaaccttgatcctgtgtcttactgtcatgtgctaacaataccatgggcccctccctcattgccctcctccctcatcgcccccctccctcatcgcccccctccctcatcgccccctttgannnnnnnnnnnnnnnnnnnntcgccccctttgaatgaaagccatttcctaccatacttcagggaccttgggagaaagaaatggcaaagctgcacccagttctgacagaccctggctgtcacaccaccgagcctgtgggaacccacttttcctgtggattcccccctcagagcagggaaggtgggagcgtagtctggtgcgttgctcatttgtgtgctcgccagcctgcttgggtgcagccacaggcatggcctgttgtgctgaactctgtgaaacccaagctctgggaagtctagggagttacccagctccgactgagcctgcagagtctgtatagaccagaacggacatggtcactaggcctggtcacgtgtggcctcctgtggcgccctccctggtctatccagggtataattagaattgagagtctgaacagggagttctagcctgggctgctgcgccttggctgcccatctctcctgggagttctggtgactgggaataggagctgctggttctccctagcctgacctggcctgacagcctggtgtgccttctccgcactagagagaagggtgaggacagaccaccaggctctgcccactaccccagagtggttagcttcgtgtcatccatgtcaccgcatattttctcttcctgcagctgtgctgtattgtcactccagactactgagcaggactcaagccccagaaggctacctgtcccagcctcaccctgagtcaggcctggtgaacgatcctagagagagatgggatattcctcaccacactcctcatcctgtcctttcataacggcacggtcattcattgctggtgctgcagtgtagtgcttccatcccttggggacacagtgtggaggaaccagagaaaagaccattcccgtggaccacccccccccctgtgttggagcccagtcactgcatgttggggggaaatttcagcagtcaagcaaccagggatacaaggtcatagggaatcgcatgtgtaccggtgttctgtaaaagcagagaagaaaaagggagattcatttattaaaaaataaaacggtgaagatggaaacagaaatagactgagaaaagccagtaagagcccggacatggaccagggaatggctgtgactcagaacatgtctgctcctcagtgtgtctcctccgctgggtcctggctgcacgccagactcctgacaacccagcttagctcattcggtcccctttcaaaggttccagctggtgagtggttcagctcctgccctgtggttacctgcagagtgcacaggatactctgtgtggcctggatgccagcggtcgttcctgtgtgagatcccagcctcatgctggttgtgaggtagaagagtgggaagcggggaggctcggagtttctcaggggttgatgattttcagccctcagaggaagacaacctcaccaaaaaaagccacttagcccaactcccttccaaaaataagatgacagataaatcaacaacagtacccttcctccaagagccagaaatagccgctccggctcccagcccaggcttacccaaaattcctttatcctgtccctgctggtgaggccaccctgcgcttcccatggctccccacgggcagctttgggaactgaggtcctggcccgccagagctcctgccctgatgctgcaggtcctcatcccatcctccatccctctcagcaaggtggttcagtgttcacccgctggactggtcacagctggctccccctcatgctgggctccccctcatgctcagccgactccctctcaagctggccgcctgcacaccccacctcagcactcccctcgggtgctttgtttccttccaggtcccagcagcatacctgacctctgttttatctgctgctgtaccccaggctctcaaatctagcagaggctatccttttcctggtggtggatgaacccaaaatgcgagcgagcagtaatggtttttagtccactgcgatttcacaggtatactggaatgactctggcgacaggagccagagcagggaactggggtcccagtgaccccctcccttcccagggttggcatagggtaggcagccagaggtctgcagttcagagtgtgggtagccatctctaaattagtataaaggaactgggacatcactaggcgggcatgtccttctttcttggcccctcttcctctctaggctctcttgcgtacttgagagttggaaggcagggtctggtctgcccagtgctggatgtcgcctgttctctggaagtgacacctctgggaagagatgggctctcacccttttctgctctcacctcaggttcaatgggggtgggggtggggagaaacacctgaagttgttgggtttttttttttgttgttgttgttgttttttaatgtgtgtgagcattttgcctgcgtatatgtctttgtacttcatgcatgcctggtgcctgtggcgatcagagaggcattggattgcctggaactggagttgaaaatggttgtaagctacgacgtactgaaccctggccctcctcaagggcagtccgtgcctcttcccagaccatctctctagcccctcaaatgcttttataaacatatattgagatgatggggtgatttcacctccagccaccctaccctagatccaaagaggatacattctgataccccaggaggtggttgaaacctcaggcactactggatgctgcgtttcctgtggttttccctagtcacacatacctacagtgaattctaacacgggactggggatatatggctcagtggcagagcacgaagcgtttgtgagtccccaggttcagtcctcagtaccacaaaaatgtaatttataaattacatacagtgatggataaatcataattatgtggtgattagaaccattgtaacaagagactacaatctaatagctgctgacacttttgaaatatttcgtgggtattggatgcatgtgtgtagggggcatgcacacatgccacaatgcatatgtggaagtcagaagacagcttgtgagaagcaggcttgctggcaagacttcttacccatttcagtcatttcaggcacctaccaccccttcccaccccccttttatgagttaggttttcaccatgtagcccaggcagccttgaactcccaatcttcctgccttaggttcctgaagacaggtaggtgtataccagctcacccccaacgtatccctgttttaagtaagaaaagtgttctaggacatgccagctgacctgataacctaatcggttcctgactgtgtgcaggatgggtgctgggcacaggggtagttcaggttcagaccccactgcagtggctggccagaaaccccagtgcctcggcagggcacacactgtaggtatgtgtgacgtgcaaattgttccccctttggactgtggatatctataggtgatacagcctgtgggtctggtttggtgaggagctctgggataggaagagttgccatggtggtttacagacacacacacacatgaatgcacgcacgcacacacagctagctgtcttgggaggctcatcacagactgggtgggggacagggggaatcgtgctgttcaggacaccctggattaggctcttaatgggtacttcttttgagacttcttacaatacattttgatcatcttcatcctctactcctctcttgactccccacacacccatccccatccacctgtcccaccctggcttcatgtcacctctctcttttaaaataactcagagttccgttgtttgtttggtttttttgttttttgttttttgtttttttttttttttttgctgctcatgggtgtggggtcagtcctctgatatggtgaccaacccttggctacccctggcatttcctcccccagaagccatctgctgcccgtagctccttagttaaggcttgcttcttgtgagccgccgcccctccagtcttgcgtgtcgactaacccgatctcacgcaggccttgttcaggctcccacagctgcgtcaagtccatgagtgcagtggtccgtcatgtcctgaagacgatgtttacctcaggcctcccaacctctggctttgacagtcttcctccctgttcttcctcagtagtctgggggttgggggtgacatcagtgtcccgtttgtggccgagcattccactggcactcactctctgtactttgtccagttgtgtgtgagtcagccaccctccttaaggatattgctaccaaggcagttgtggtgagaagcacgggcttgagtcaagcaagctgcctagtgcggctccccaactgcatggcttgcccactggagagctccgtgcaaagagcttcgcctttcttgctgtccccaccccaccccacaccccgtttgtaagtgggagatggggatacttccttgggagggcagtgtgagggtgagtgtgtggaactgtgtctggcacagaacaagagtgtattgagatgtatccaaggtgctgtgtaaaagcctgagtgggccaccgcaggaaagatgctgagatctcagaagccaaactcaggtcatgctagtctcctgactgggaagtctggtctcttttacaggacatggccttgtaggatcccagcagcttggatcttcctgaaagaggagggcgggccaagccctgggccagagatgtgagtggaccgatgctaggccaggtgccgcctaccttagggctcctgctctctgcagcacaaagaccatctgaatcctccttccatagacaactgtgggaggaaggcctgctggtcacctgctgggcctttctggctcagggtgtagtgcagacctaggcctcatttgaataaaggcttacagcggtacagaaggatccgctcttcccacccccatgggacttggggcggtgcttgatcccaagcttctgttggatctatacaactggacgctgggtgccacaggttgagggcaaaggcacatgagcaattgcagcagtctacagatgctggcttccagccccctcccagggtccccaaggaatgcaaccccaaactattgtgcctacttggagtttggactttgcctaaggagaatgagctgagaagagattaagcatcttaatatgttctgttgtgtttgtagctttccgtgaagaaggtgaggctgggtcttgatttaacgtgctcatgagacaagagcgcctgctggcttactctgggcttggtttccaagtctgtgggtagcaggctacccctacccccactaacactcagcctttccaggtgtctgtgcccagtacagggtggtctcacctcctgggagcacactgtcatcttagccatggggaccatgacaagaagcaacaaaaaactaatattggggattcaaaatacatttgctttcccaccaataatctcctttgtcctgaccttgtttagcagcagaagtataaggaagtatgtgtagagcaagtcggtttccatggccttgccccatatccaacagtgttagaacccatgacgggaaggcagagagatggctcagcaggaaaaggtgcctgccaccaagactgaagacctgagttcagtccccacaacccacgtggtggaaggagggaactaagtctggcaagtcgtcctttgaccttcacgcatgccccattccaaacacacaaataaaattattttgtttcattttattttatgttttgatttttcaagacatggtttctcagggtaaccctggctgtcctagaactcactctgtagaccaggctggcctcaaactcacagagatctgcctgcctctgcctcccatgtgctggatctaaaggtgtgtgccaccacactcagctataaaataatttataaaaaaagaaagaaaggatccattggcgagcaccggaggagacagtcataccttctgaaaccagtgggtgtagcaggcctggagcctgcagtggactgggggggggggggggggcttagagattaggaggctgaggtgggtgccagatgcctctgtgaggggttagagggtgactctgcagactataggggatagggagtggggcatagcatggtgcaacctgtgctcagatctaaccacataacattgtcatgaaaccaagatacagactgggagcaggctgggggtgggggtaccgagttaaggaggtgacagcgtaccaagcagtattctatttgatagctctctgtgtataaacagagactcaaagactaagaatttagtaattatagctgtaaaaccgtgaaggttgttagtgcacctcacattttccaattagcgtatgagaattttatgctgacagagggctggagagatggttcagtcgttaaaggctaggctcacaaccgaaacagcaggaatttttatattgacagaaacagtcatggaaaatgtgaacaaccatgcctggcttattgtgcacacacaaccatgcctggcttattgtgcacgcactcactcacgcatacagggttgtggggttggtagctgtgggggtaggtgtagaaggtgactctggccagtgtgctgactcaacttcctctgccctagatgacagaatctgctcgccgcctttcatggagctcacgagcctgtgtggggaggacaccatgaggctgctggagcagaacggcctggccttccccttcagtatgtacaccgtgggctccgggtggacatcgctactgtgggaggagcttacaggaccctgtagatttgagctctcttgaagcaattgaaggccccggacgccaagaagagtgtacggtcctgggtccccacctctgcccataccttgagaaggtctttgctgaaggaacacttcctacctggcctggaggcatctgtctgtatcgctctgaggacagacagtaatcaatgcctgccagcgactgtcttctccttagtcctagtccccaccggctctttgtgcctttgtgagagttcctcacaaccctgaaagcccctggtctcacctactatcagtaagcaaggctgggcctgcttgatacttagacaggggcagggggtggggttcctatccagagggtcccggttccccttgtctggccatgtggttaccaggcccactaacccctctgtgttttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccacttcacctaacttcctgtccctactcttaaggctgccttcccccaccttgggagcctggctcagtctgcccgggatgctgtgcaagctgcctgctgggcacacatagatagcatcttgcagctcagagggccacgagctgcttctgttaagagcgtaccgcaggccaccctcttggtatatcctcacaactcgctttgcacatctgagaggaaatagcgcaccgtcacgagggctctcaagagagatccatcctcgagacctcatccaagccttacacctacagatgccgtccccctggggtaagggcctccatgtatgtgtttggtagacacacataggcagtttgtagcagagccaacagaaagcacaccagattgatgtgtcatggtttcctggcctcgggtccatcagtgataggtgctggctggactcccgaagaggcatttgagaggaatgtctcagtcctactggttcagaggagatttgaggagagagcccacatctccagtgtgctgagacccttccttctgcatggctgggtgcctctgtctctgcgtgtaaaggaatcttgcccagatgtcagtacagagtgtctggagagacactttgggggtgtggggacagtaagcatgtaaggacttagaggcaagaggggcagtggctatgcagaccacccttaggtccctgtagtgttcttagcaaggccccacattctccagggtgacctaagtagccccatggggaaagccttccggataaccctattggcagaagtgctccctgagagaagactaaaaatggaagctcagacgccatgactttttccagatctaggtcattttcatctcctggcagatgtttacggggaaatgtctataaacagtatcagaacaccaggggacagtctgtgccaggggttggccctgccatgggaagccatcatcagctgcaaggacagctgtctgctaatgtcaagagccatgtgggggtatcctggctgcttgggttcccagctgcagcagcaccccaaggtgctttcccgagtaagccaggcaggaagcaggcagactccagagcagccgcagcacccttcccatcaccaccgaatagctcctctgtgacagaggggaacccagcctcgggatagcacacagccggcactactggcagtgttacacattgcctgacatgcaccttcagttgctatgcctccctgatcatctgcccactttttaatcgctgggaatttgacagttatggggcgagggagttgctgtgtagcttgccacagagcctggctcacagctgctccaagaatggaatttaggattccatcagattggggcactgctgagtcactgacagtcaacccctaggcgaggtcatcaccccccagggaggccatctagcattcaggtatgtgcagaagcacacatacacgaatgcaggcatgcacgcatgcacgcatgtccgtcctctgttgctatctcagcgccaggcactctcccagtccacagccatccttgggcacatgaagacccattgcattctgaggtctggaggacagaggccaggggagacaggaagtttgtcaccagagaatatcttatgtagagtgggcagggtggggggaccagtgcctcctacctttcagggatatccagtggcattgagttcagagagggttgaaatgaagctacaaagagggaacttctcacggggtcctcgtgtgtatcccagcctggtgatccatgcctctgccttccccagctccatcatcagccctcactagactgtttgcttccatagacctagaacccagtgcacacacatgagctctacagggcagtcagtcccttcttccctccctccctccctccctccccacctccccacctccccacctccccacttacagaagctacataacacaatttatcaaagccccatacacctgcacttgctagtagatactgcttgtagcaaaaagagtggggcttagctggcctgtgctggatagtgtgtcctatcaccaggggctttcagtctgtcgggtctacagcatctgtgttcttggctgcttcccacactgttgcctcattcttgtaagaaggttgagaggacatctgttcacacctcactcccggcctggcacacactggtgtttccacatggcttggattctggcttctgtcctgcccaactgggcttcaggcacactgtggttctgtggtggctgacctgagggtgacagttggtcaggtggccatctttccaggatcattagccttgcttagtgaccccggaatgtgcctgggctctctcctggccatgtagtgagtgatgttgctcaagccactacttcaggtaagctggggcaaccccctggtcccatcatcctcagggccggtcatgccagactccatacccagcttgtgatggagtagaagaggacccagttgtcctccccaccacactcagcccccatcagatcctccttcagcatgttggtccctagaggagcttgaggctcggacaaagttgcattccagttggctgagtatcatgtgactgtgatagggcatgtcaaggtgccagggagacccaattccaacccagcctcactctcctgcagatcgctcactgaagcatatggggccttagtttccttatttgttaaggtgtggcagtgtgtccatctcaggcactgtaaggatggcccctgggcacctagttcttgtagtaaagttataacaagaggcgactctgaccaaaggcctcctcctcctggctggcaggagtctcctcccttttgggcctttgtggaagaggctccaggtgttataagcaatgagtagcacccaacctaggggtccccaggattgcagtgattcatgatctggggagctctggagttcacagcctgctctgctttatgtgacagacccaggaaattcaaggtttcccaactcgaacagcatagctaccaagttcacggatgttcctgcaccctgtcccactcgctatgactcgaaactctttgggagtgctcaaagagggactcactgtccctgagggtattagaggggcccccttggaggatgctcacctccatccgtcttgggcaccagctcttcgccacagggccagggagaggtcatggtggggtcgcccaggaaggtgactggccaccgtgttggagattggcagctgatggactctgatgcagcctttggtctttgtctccccagatggctattgtgttcaaccaagagggcctgaatgccatccagcctccctgtgtggtccagaacttcatcaaccacaatgctgtcctgtacaaggtgtttgtggtgggcgagtcctacacagtggtccagagaccctcactcaagaacttctctgcgggcacatcaggtaatccgatccactgctcctgattgtgtcactctgtgccaaaccctggggcagagccgaaatggatacctggtgtctgtctcctggtcttccttgttatttctgggttagtgagagatgacctgggttgaaagagttgtatgagatagatagatagatagatagatagatagatagatagatagatagatagatagatagatagatagatagatgacaaaagggtcctgaagggccatcgagagaccctgtgccgtaggcaccttggggctccatccctcagagctgccgccgactccaggaaatttctagaagcttcttattcccaggaaggtcccttggcccacccagtgatggtgcccaggaggagtgtgccagagtgggtgtggccagcccagtgtgggacatgaaggagggagatgacggctgacccaccacattgcatgccacccttgcctagtgtgtccggtttgctaaaaggggaccccagtctgaattaccagaagccttccgcagttgtcaaggtgtgccagggctttcgtagcaggctgtagctacctagtcacaaagagcccccatggagctcctcaggcaagtccccagggggcgtaatcactcaccccctgccacccatgcctcagggaacttccccctgaacagatgggcagggccctagtgtctctgagatgtcctgtggtagaggtgttgacaggactccttgtcccagagggtcttggagaaggctctcaggagtctgcccctccctctcatgctcgctcctccatccatcctggacatcagctgtgtggggccagtgaaaggtgtgctgacaccagagctgctcaaaagaatgttctagcaatccggaaggcccctcttaggcaagttccagagctttgtgggtcacagccatgcctttagaaagagcatagctcagtctccctggggggttcttggatactagattccccgtgaggtgaggcttgtctccgcctgagaggaaagagctatcctaagcatccgccagccccagctgagcaagcagagccttcctcgaggccccagaaggctctgttgccaggacttcctgccctcatccctgtagggctggttacagcgtcttcagctctctgctctgaaccttcttctctggctgagaccaggtggtttgggacagtcccatcctgacactggacccagctgagaccacgcaacgagggcagtgatagacaggtgtgtcacgtgtaccaccaagagacattcttgcaggctgtgggacacaggagattaaggtttttataaaaacatttatttgcccaattttaaaaatacacccattgaacctatgaacacacacacagagacagacagacagacagacagacatgtcttgcttatgacactccctttcctttcttaccagatcatctcatctctgaatgaaatgtggggtccttccttacgcccacaaaagcctgtttgttcactctctcctcctctttcttcctggttgtaaagcacgaggccagtttctgccttggcactggggatgataaaggcgggagctgtcagtgtgtcttctcttgtgaccgtttctaggccacgaagtaccctgaggcataacatttggaggtgggctgggaatcagagtgactttgagtgggcctgtctgatcgggaagtggcacagttccagcttcggcctgcacgttcctagcctgaccaagacgacctcaggcttcaacagccctttctcctgactagttggaaaggggctttgaggattctttccagagcccactcaaccttgcggcccccgccctccatgtggcagggccctcagcttccatgtgcaccctgggagataggtctcctgccttggggttgttctggacgtgggctacagatagacaaggaccctttcactccatagctaccatttttctctgattctcatgtgcatttctgtcctttgcatgtcaaggtccaaagtcagtgtgtgacttatatagcccctggtaccttacagggtaggtacctggactggaacccagggagtttactaagggagccagcatccgcttgtgccagccactagggatacggtgtgcttatgttctctgtcttaggtctgtgattctcaagacatcgtgcatatcagatatttaaattatgattcataacagaagttacagtttggcagtagcagtgaaaataattttatggttgaggtcatcacagcatgaagaattagattaaagggttgaaagccacagttctaggtagctgtctgcatcttcttcctgtttctctttcatcctgtaccttgaccctgaagccacattgccttgggctcctagctttgtgtaaggactctactccccctccctccaggtcctaagggtgcataagacccgtgcctcttatttatttgaaaggataataagcatctccagggttgtcccagtcctttgatgctattgcagggtgactgtggtatgcaaatgagtgggtggggccatgctctgtgctctccaagaagactgcagatacaggtagcctggcttacagtctgtagtttatactgagctgacaccaggacacctaaagtcatatgatgctgcttttattgaacatgccatagactcgccatgccagagggccagccaggagccaggcaggcaggtttattagcaatgtgtgttcccgtgaggaataacaacatatgggagagacataactggaggatccgttttattggagatgagcacttcaggggacatataggcaagtgctaggacaccagatggaagggtgtgtgagaaagactaagcagggcagtggcaggtacaggcacctctgcagagtcgcattcaatgacaggatggtggcttacaccatggggaaagacaggagaccaaacatgaaggctgaaagcagcaggtcatagtctacattgttgagatgcctgagccagtctggttattcaccctccctttgagtctgttttgtctccctgagagcaaaaccacccggtgaccatcaccttggcctcccattctcattgggagtttgaggtggcccccaagctaagtgtttgggggactagtccaggagcactcagtggctaggctcccaaatatcagcgctcctgggagcaagaacattgctgctaagggtagagagcaaggcccaggccccaccagaaccaactatctcaaagcttcctaaggagccaggctccagcactctttgctggggctagacacctctgacccatctcaactcctctcagtctcttgctgacaggcatgactggaagctgctcactccctgcatcctggttgtgcagaggtgccttcaccgggggcatctcttgcttagtggtccttaggccagagtgcccccggccagcagtagcagtcagagtagagggcagttttcctttgagctatctgtacatttgatcagtctatatgatctgtccagtgaaacagacatcacaagtctccggtgccgtcccttcctagcaccagccaagcctctgtgtgcttcgtgcaggctcccacaggcttcccacactccttgagcattactgtgtctacctgctcctgtcctcacacctcaggcctgctctgctctttccgcctttgctcttggggacctatagaggcttgggtgggaggtaccccgagttcaggacgctccaggagaaggttggcaatgcctatggaaggccagagagccatcctaagtgacgaagccctggtccagcctcttggtctgtcaggctctgcccgccattcctgaaggttcacctgtgcccgagagcagggaccagtgggcgtgcttgacacaagtcccgcagggtgtttatttttcccaggctcctccccaggaccatctctcatgccccctgtctggactggctctggtcggagcagcgggaggactgtcgggcacaccggggtggccaggggcctctgtgccccactagcgggaaggatgccaggtacttcagcgcctgcctgcttggctctgcctgaatcacttccttgtgcatgatttttatggcgccgtagagtcatggggctgctggggggtcatggcagccacaacaggcacctgagccctggcacacacgccctcagcccgtgttcaacctgtcctagtgctcgggggcctgggtcccagggatgatcaccatgtcctgcagggtgggggatccatgacacctcttttgcaagaatttgagcaagggttgtcaggacccccttgggggggcttccagcccagattggccctgtgctattcttggtgggagtggggctatgagggggtaatggccagatctcaacccctaggcttgtggttttgtgattctcgccctagcgtgtccatgcttccaagtgcttgagaacattgcaaactgtgcagccaagcttacatctccccagagcaatcatggcttacacctcaaggacattcgtacaaggggaataaatggacgctccatcacattcctgggactgagctgcctctctggcgtccagggggctgagggattgtgggcagcagcagatcagccatgtggtgtagaggagactggggcattgcaaggctttcctgggtgagcctgtggaagccttgctcgggttcctattaagtagttgggaaccttttgtctgttcagcttacatatgagtggccacttgattggggttacctggcccaaatggcttttggtaggcttcttctctcagggcactccagacctttgatatctgggtgcactatgtcttcacctccgttgcccttctcttcccagcctcctgttcatacttatgaccggcccagccttaggtgctaaggaaacccatacatagtgccatacaatggtagtgagggtgccccagtaaaccactcatttttatgtgggaggacaaattgaagccgggatcctgatggatgcacatctctatgtgatgtgggagcctagctcccaagaacccagggctgagccagaggccacccagagcgtgactggggtggtgctgccccctggtgttggcattgctgtctcctggtctgattcaccctgtgacttctgtttttttcagatcgtgagtccatcttcttcaacagccacaatgtgtcaaagccggagtcttcatcagtcctcactgaggtatgtctgtcgtccacggcagcctgtcaaggggttctagctgagctgtttagaagggcccacacaatcatatcagtgggcttcatggtcttgtatgtgtctggaagggagcacttaggacctggtgaggaccactttcagtgagtcagcttgcctctggagcagcctccctcttgccatcatggctggaacatcagtatgtcaggcttagtggggggtgcttggcggccttatctcatgcagctttacagaaagggcaaccagcttagagaaaggacaacacagaccgagttcatacagaggcaagcagggattaccctcacctctctgattacaaagttgagagtcttctagaaatttccttccttgatagtagcaaaaagtgccttgggctacagccttctgttccccacagaagtctggcttcagctctccatgggggagtcatgtgttctgggagctcagagtaggtccttctatctctcctgattatactcaacgacagaagctgccattgtcttgtacctaacctggttccaggcccttggcctggcctcgggtgcctgacctctgacctcagcagcacggcagttcctttcttgtgtggctctggctggcctcagagtcacagatccacctgcctctgcctcctgagcgctgggatt

SEQ ID NO: 824 - DNA, 365 bp, Mus musculus
ctgaacctcagcagaccgattgaggagcagggccccctggacgtcatcatccacaagctgaccgatgtcatcctcgaggcagaccagaatgacagccagtccctggaattggtgcacaggttccaagagtacatcgatgctcaccctgagaccatcgtcttggatcccctccccgccatcaggaccctgttagaccgttccaagtcctacgaacttatccgaaagatcgaggcctacatgaaagatgacagaatctgctcgccgcctttcatggagctcacgagcctgtgtggggaggacaccatgaggctgctggagcagaacggcctggccttccccttcagtatgtacaccgtgggctccgg

SEQ ID NO: 825 - protein, 122 aa, Mus musculus
  VARIANT (1)...(122): Xaa = Any Amino Acid
LNLSRPIEEQGPLDVIIHKLTDVILEADQNDSQSLELVHRFQEYIDAHPETIVLDPLPAIRTLLDRSKSYELIRKIEAYMKDDRICSPPFMELTSLCGEDTMRLLEQNGLAFPFSMYTVGSX
